United States Patent 8,344,211 (PLANT NUCLEOTIDE SEQUENCES AND CORRESPONDING POLYPEPTIDES) - sequence listing, part 17

SEQ ID NO: 65071 - DNA, 649 bp, Zea mays
  misc_feature: Ceres CLONE 1535582
  misc_feature: Translation starting site: 181
  misc_feature: SWISSPROT Homolog: EC 3.4.23.5 Cathepsin D
gctccccgcggtggcggccgctctagaactagtggatcccccgggctgcaggaattcgtctcacccctagaaaaattgactcactcacttagccactcttcttcctcctgatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcgggggcgacgtccctctcgtcgactacctccacacccagtactaacggggtcgtcgggatcggcacgccgccgcagaacttcaccgtcttcttcgacaccgggagctccaaacctctgggtcccccccctccaaaagctacttctcgaattgcctggcacctgcaccacaaatacaagtccggccaagtctagcacggtacaagggggaaggggaaaccctggaagattcccctaccggctccg

SEQ ID NO: 65072 - DNA, 643 bp, Zea mays
  misc_feature: Ceres CLONE 1535583
  misc_feature: Encodes the peptide sequence at SEQ ID NO. 65073
ctccccgcggtggcggccgctctagaactagtggatcccccgggctgcaggaattcgtctcacccctagaaaaaaacctccccaccctcttcctccactcaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtccccgagacccgtcccgcgcaccatcgacaccaccccgttccccaccaccttcgtccaggccgacaccacctcgttcaagcaggtcgtccagatgctcaccggcgccgagcagccggccaacaacgacgcgacagcggcgggggcagccgctgccgctgccgccaacggcggtggcgccggcgcccaggcggccagcggcggaccgtgctgccggccccagaagccgtcgttcaagctgtacgagcggcggagcaacctgaagaacctgatgaagatcgcgccgctggcaatgggctcgccgccgtcac

SEQ ID NO: 65073 - protein, 157 aa, Zea mays
  misc_feature: Ceres CLONE 1535583
  misc_feature (66)..(96): Pfam Name: VQ Pfam Description: VQ motif
MDVFTKQLLPMPHQRDPNYPSSSTSSSSSSSSSTPPSRPHHRAQPQPQPHNLPQSPRPVPRTIDTTPFPTTFVQADTTSFKQVVQMLTGAEQPANNDATAAGAAAAAAANGGGAGAQAASGGPCCRPQKPSFKLYERRSNLKNLMKIAPLAMGSPPS

SEQ ID NO: 65074 - DNA, 627 bp, Zea mays
  misc_feature: Ceres CLONE 1535584
  misc_feature: Encodes the peptide sequence at SEQ ID NO. 65075
  misc_feature (405)..(405): n is a, c, t, g, unknown, or other
ctccccgcggtggcggccgctctagaactagtggatcccccgggctgcaggaattcgtctcacccctagaaaaaacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatncttttgaagaatgcttttccaggagtaccaaagaatcaagtgaaatcctccacgagaatcaagtcatgtcctcaaggttccattccggaaagcccatttgactggaatccaaaaccctttattaatttgaaacccggcggccctcaaatttaagccaaggattggccccccaaaattaggagaatggttttttggggggaaaaaccgggggaaccccccccc

SEQ ID NO: 65075 - protein, 89 aa, Zea mays
  misc_feature: Ceres CLONE 1535584
  misc_feature (88)..(88): Xaa is any aa, unknown, or other
MAALQPSFSPAMTLKSSCSALKFPKTALLSGFGGIPRLQDAQDRNTSVAYLIPKAASVTDQSIAEPPKTKQNRHTVDPTAPEFLPLPXF

SEQ ID NO: 65076 - DNA, 2212 bp, Zea mays
  misc_feature: Ceres CLONE 1535588
  misc_feature: Encodes the peptide sequence at SEQ ID NO. 65077
ctcctcctccgacctcgtcccgcagcaacgcagcagcagcgtcagcggtaccgccgggtgcggctcctcctccctcctagccattcggccatgtccggcggcgggtgcagcatacgcgccatctggatccttacgcccaacgacacagtagccttctccaggcggttcgctgtggtggagaagcggtggcgtgccgcgtgggaggaggaagaaggagacggagagagacaccgttggggcaccggggcggcgaagatgccgctgcccgccgaccacgaggtcgccgccgcattcgccgagcgccggagaagggagggcactgcacgcagttcaggcatccgaacaaacgtatcatctgtgggactggattcttgggttgatgatccaattacccgccacattatctcattacacatggataaagaggaaggagatccctttatgctgtggcctgtggtcctacaaaagcgtggagggtactatgtccttgtgttgcctctggtggatcctcagccatttagagcatatgagaatctcttgaaaaggtctgattgtgggggttcggccaaggagaacaacaatctttcttcaatcctgttcaatcttccatgcataacaggagcatttatggttgcacaagttgttggggacataattactggtgatattgctgaacctgaggtgattgttagctctgggccatctgttggtggactcttggattcattgactggaagtataggtatttcagcacgagcgaagcctattgccgcacctgttgcagcaccaactgcatcagtctcttcccctgttggtgctgctcaatcagactccttaaaagggggtgtaaggccttttgacaaggatttactgcagaacttcatcattggtgcaatgccttttggcacacctcaagatctcaattatgccaatgttacttcgattagaactactggattttctggtgaccctcttccaacagaccagaaacaacctgcctggaagccctacctgtacaaagggaggcaaaggattctgttttctagcttggagactataaatgctgcactgtatgaccgtgatgatgttccagatttcctttctgtttcaggacaggtgacctgtagggctgaactagaaggactacctgatgtttctttgccattgactggtttaaaaactgctcatattaaggtttcatcattccatcactgtgttcaagcttcagagcccactgctaataagcaaaccctggtttttcagccaccattaggaaattttgtattgatgcattatcaagcaccatgcaacattgctcctcctgttaaagggttctatcagttgtccatggtttctgaaaatgaaggtgcttttctatttaagctgtcattgatggagggttacaagtctcccttcattatggacttttgcatgattacaatgccattccctcgaagaagagttgcatcatatgacggaaatccatcaattgggacagtttcaatgacagagcattcaattgaatggagaattgtctcaagtggacggggacttagtggtaggagcattgacgctaccttccctggtactgttaaatttcagcctagaacgacacagagaataaattcatcatctcgattcatttcaagcactggatatactgaagatagtgacagtgaacaagataacgttaagaatggagctagcttggatgactacataatggaaaaaatcaataaggatcttcaggcagttgatttagaagagccattgtcttggcaagcgtataattatgctaaggtttcttttaaggttactggaggcacgctgtctggtcttgcaattgatccaaaatctgtaaacatctatccttctgcaaaagctccagctgaatactcaatgcaggcttcttctggagattacatactgtggaacaccttaggaaaatgtccgacagcagcgttgcctagagaattatgactgttttccagcatacgatgccatcacatttttgtgcctgtcttttgctgcttgtacagacttcagagctgtccacgttgttcctcctaccagatctgtgatgggaagtttttgacatttgtatttagttctcttttaccgaggagaaaatctatgaacctacagatcttgttgtctgaagcccaatgacgagatacttatcttgaagccataaccataatcttatcagcaa

SEQ ID NO: 65077 - protein, 629 aa, Zea mays
  misc_feature: Ceres CLONE 1535588
  misc_feature (302)..(606): Pfam Name: Adap_comp_sub Pfam Description: Adaptor complexes medium subunit family
MSGGGCSIRAIWILTPNDTVAFSRRFAVVEKRWRAAWEEEEGDGERHRWGTGAAKMPLPADHEVAAAFAERRRREGTARSSGIRTNVSSVGLDSWVDDPITRHIISLHMDKEEGDPFMLWPVVLQKRGGYYVLVLPLVDPQPFRAYENLLKRSDCGGSAKENNNLSSILFNLPCITGAFMVAQVVGDIITGDIAEPEVIVSSGPSVGGLLDSLTGSIGISARAKPIAAPVAAPTASVSSPVGAAQSDSLKGGVRPFDKDLLQNFIIGAMPFGTPQDLNYANVTSIRTTGFSGDPLPTDQKQPAWKPYLYKGRQRILFSSLETINAALYDRDDVPDFLSVSGQVTCRAELEGLPDVSLPLTGLKTAHIKVSSFHHCVQASEPTANKQTLVFQPPLGNFVLMHYQAPCNIAPPVKGFYQLSMVSENEGAFLFKLSLMEGYKSPFIMDFCMITMPFPRRRVASYDGNPSIGTVSMTEHSIEWRIVSSGRGLSGRSIDATFPGTVKFQPRTTQRINSSSRFISSTGYTEDSDSEQDNVKNGASLDDYIMEKINKDLQAVDLEEPLSWQAYNYAKVSFKVTGGTLSGLAIDPKSVNIYPSAKAPAEYSMQASSGDYILWNTLGKCPTAALPREL

SEQ ID NO: 65078 - DNA, 636 bp, Zea mays
  misc_feature: Ceres CLONE 1535592
  misc_feature (135)..(135): n is a, c, t, g, unknown, or other
  misc_feature (319)..(319): n is a, c, t, g, unknown, or other
ctccccgcggtggcggccgctctagaactagtggatcccccgggctgcaggaattcgtctcacccctagaaaaactcgtcgagagagtcgtccccgctcgtgctctcagcctgcggcatctgtatcccgcggcantaaactacccccataggaagaagaatacccccaatcctcgagatgctatcttgcatcgagacgacttaccagtccgagtgctagggttcagttgcgacaagatctgaaaaatgttctggtcgaggggagcaggcgatgtcggctcaagtggcggtggtgcctattgaaggccctgtcgctgtgnccgtatgtgtgtcacactgatctgtcgtggtggatcaacatctcccgactgatcactctcgtaggcgacctgaaggctggcgtctcagactcccagatgtcgatctctgcaactaggggaggatgtggtgtccatacgcttatcaacgatgtacctttggcccggtcgcccggaaaagcaaactgcaactaaagaaattccctgggatgcgggaaaatgactgggaaaaccttaaattgggattccctaaaccccccgccctttccggggtgttttttttccaaaacgagggtccaaaaagggccgggggggatggt

SEQ ID NO: 65079 - DNA, 639 bp, Zea mays
  misc_feature: Ceres CLONE 1535593
  misc_feature: Encodes the peptide sequence at SEQ ID NO. 65080
ctccccgcggtggcggccgctctagaactagtggatcccccgggctgcaggaattcgtctcacccctagaaaaaagtccggagacgccggcgggggcctcgggaagagttatcttttctgcttaacggcccgccaaccctggaatcggttcagccggaggtagggtccagcggccggaagagcaccgcatatctcgcggtgtccggtgcgcccccggcggcccttgaaaatccggaggaccgaattccgtccacgcccggtcgtactcataaccgcatcaggtctccaaggtgaacagcctctggccaatggaacaatgtacgcgagggaagtcggccaaacggatccgtaacttctggaaaaggattggcatctgagggttgggctagggggtcccggccccgaacccgtcggctgctggcgtaatgctcgagctgctcacgcggccagagcgggccgccgcgtgccggccgggggacggaccgggaactgccccctcgggggccttccgcgggcgtctaacaaccgactcagaactggtacagacaacgggaatccaactgttgtattagaacagagcattgccacggtcctcgaggatgctgacgcattgtgatttctgcccagtgctctgaatgt

SEQ ID NO: 65080 - protein, 40 aa, Zea mays
  misc_feature: Ceres CLONE 1535593
PRGGGRSRTSGSPGLQEFVSPLEKSPETPAGASGRVIFSA

SEQ ID NO: 65081 - DNA, 646 bp, Zea mays
  misc_feature: Ceres CLONE 1535594
  misc_feature: Encodes the peptide sequence at SEQ ID NO. 65082
  misc_feature (359)..(359): n is a, c, t, g, unknown, or other
  misc_feature (464)..(464): n is a, c, t, g, unknown, or other
ctgcggaattcgtctccccctagaaaaactcccccactcgccatatgtcgccggaggccggaccaatcatgcggcccgccgaccagctactcctcccgttcctcctcctggccgttgcctccgtcgctgccgccggcggctcgtgggagaatggatatgggagcatcctccgcctcccctcctcgtctccgcgccggttcccccgctccgcggccgtcaacctgattttttccctcaacctccacccgggcgaacgcgttcccctcctctctcccccccccggggtagagggggggccttgggctcttttttttgccccccccccccaggagggggggggggggggctccttcccttcnccaaattttttccccccccccccgtgggggggcaagaatcctgcgggcccctgtgtggaggggtgtttgcccccccttttataaaattccttccgccccccgggnttttttttttcttttcttttttagagggaggggggccccacccacggcccgcccccccacgatttttttttggtcacccccttccgtgccccccccccgcctaggccgtcgcccgcctcctcctcttccaaaaaggagcggtttgacaaaagatagtggaaagttaattcccttcctctgcg

SEQ ID NO: 65082 - protein, 132 aa, Zea mays
  misc_feature: Ceres CLONE 1535594
MSPEAGPIMRPADQLLLPFLLLAVASVAAAGGSWENGYGSILRLPSSSPRRFPRSAAVNLIFSLNLHPGERVPLLSPPPGVEGGPWALFFAPPPQEGGGGGSFPSPNFFPPPPWGGKNPAGPCVEGCLPPLL

SEQ ID NO: 65083 - DNA, 663 bp, Zea mays
  misc_feature: Ceres CLONE 1535596
  misc_feature: Translation starting site: 173
  misc_feature (385)..(385): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaaccactccccgccgccgccaccacttgctcgccttcgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatgaaccactgtgttcagccactcccagactgtggttgtgtgcccaggctgccaaactgttctgtgccaacctaccggtgggaaggccagctcaccgaggggtgctccttncgtcgcaagggcgattaggtcctgcttctcttaacgtgagaagagataaatttggtgtttttgcaaacttctcaggatatgtactgtactcggtgaagattttngttattattatggctgttagcgtggcctgacaatgcttggggggtaaacctgcactttgtttgaacctagggacatctaaaaagggggcttgtttggcttttcctgaaggagtggcaatgcaatgaaatccaccggggggcgtttttttgtccaggtttaaccgaaaaggccct

SEQ ID NO: 65084 - DNA, 583 bp, Zea mays
  misc_feature: Ceres CLONE 1535600
  misc_feature: Encodes the peptide sequence at SEQ ID NO. 65085
ctccccgcggtggcggccgctctagaactagtggatcccccgggctgcaggaattcgtctcacccctagaaaaagacctctcctctcctcttctgagggtatcacctgagtcacacctccacagacactgatacacacacatgagacgtgctctgatcgtacctactgtcccgagtcccgagcaacagaatgtttcactgcttgccctcatctaactccccgctctcactgggcatcaccatatggtaaactgtgcgtattctcagtctgtacaagccatctttctaagaacatttggggcacaaatttccagtagcatttcttgtggtgaacatggactgcacacctggttctacttctcctatgagctatcaattctgcttctgagagctcacttggctgatgttcagcacatcaacggacaagaagctacaccgtcacctgctgctgaagctagacagatcaaacttaatgttagcgtgctgatccgattccctatgcttcgaacgacagctgactatgctgtgctggccagattgatctactacctgccgagactctatccaagtttaaccttcctgaa

SEQ ID NO: 65085 - protein, 113 aa, Zea mays
  misc_feature: Ceres CLONE 1535600
MVNCAYSQSVQAIFLRTFGAQISSSISCGEHGLHTWFYFSYELSILLLRAHLADVQHINGQEATPSPAAEARQIKLNVSVLIRFPMLRTTADYAVLARLIYYLPRLYPSLTFL

SEQ ID NO: 65086 - DNA, 653 bp, Zea mays
  misc_feature: Ceres CLONE 1535603
  misc_feature: Encodes the peptide sequence at SEQ ID NO. 65087
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (653)..(653): n is a, c, t, g, unknown, or other
ctccccgcggtggcggccgctctagaactagtggatcccccgggctgcaggaattcgtctcacccctagaaaacttgttggtcgtacttgagattttattttcactgaagccgggtctagtaacacgtatttcaacattgacacattcaaatgttcaactttatgtggttatacaattaccaacttaatatatgcaaatcttctatgcctagcatatattgatcaaaagaaagataagttcctcaaacctttcgagttctgaaagcttttggtcttttggctttcttgttattgtaaaagaatatttagttttcagtgtccggatatttgtactgaaggcccttctcccttctataaattatcatgtggttgtacgccaaannncaaaaacaaaaaagaaaaatgaaaaaaaaaaaaaaacgagacgctcgaggtacccaattcgccctatagtgagtcgtattacgcgcgctcactgggcgtcgttttacaacgtcgtgactgggaaaaaccctggcggtacccaactgaatcgctttgcagcaccatccccctttcgccagctggcggtaatagcaaaagaagccccgcaccgatcgccccttcccaaacagttgcgcagcctgaatgggccaatggaaatttgtaagctn

SEQ ID NO: 65087 - protein, 61 aa, Zea mays
  misc_feature: Ceres CLONE 1535603
PRGGGRSRTSGSPGLQEFVSPLENLLVVLEILFSLKPGLVTRISTLTHSNVQLYVVIQLPT

SEQ ID NO: 65088 - DNA, 757 bp, Zea mays
  misc_feature: Ceres CLONE 1535616
ggagctccccgcggtggcggccgctctagaactagtggatcccccgggctgcaggaattcgtctcacccctagaaaaaagccccgaaaccaaagccgagccgagagcccgagccccgaccagcccgacctcatcttctcctcgtcggcttcacccctccaccacttccgtggggtcgtcggaggccgacgaggaccagctcctcaagagcttccttcgggagggcggcaaggcccaacggaacaacaaattccccacgaaccttggttgcttttttttcccccccggggggggacaaaatttgccttattttttcttacccccggaggttgacgaagccatacccaaattttttcccccccccccgaggggaagaagggggtttttttcttctcaccccatttttgtgccccccccccccttaaccaaactgccccttgccaccccggcgtgggaataccgtacccccattttctcctattctcttacttctctcctcctgctgtacccccaattttcctgtttcaggcaggcaccgggggcttcgatgctactttcgcccgcgtttccccctagctcccccttgccttgcccgacctggtccccgattgatttgcctcccccctgcggggcgttgactatcctattctctatcgcctcgccgcctttcccccgctaatgttttataaaacgtcgtcccccccccctgcgtattctcccgtattcagagcctacgggcccttcattctgcgttattg

SEQ ID NO: 65089 - DNA, 503 bp, Zea mays
  misc_feature: Ceres CLONE 1535619
cccgcggtggcggccgctctagaactagtggatcccccgggctgcaggaattcgtctcacccctagaaaagtggcgctgtcccctccctggcacccaccctcacaaagcatcagcctctccaatcagacgcgagccacccaccgcgcgacctcagggtgcctgtgcctgctcccgctgttccttcctcatgggccaccggccttggccaaccttttggcgggccgttcggggcttcgccccgtttcccccgggggtggccctttgttggggtttggggcctttctccggggggcctcttgggtttaggggtccaaaatttccaaaaaaggggttttttttttgggggaaaacccgcgggggaaaggggccccccaaaaagggcccaaaatttaaaggctcccaaacccggggaaaaaataaaaaaaaaaacccggggcccccccagggggtccccccccccccccccttgggggggggaatggcgcccaaggggcccctaaaa

SEQ ID NO: 65090 - DNA, 892 bp, Zea mays
  misc_feature: Ceres CLONE 1535621
  misc_feature (1)..(1): n is a, c, t, g, unknown, or other
  misc_feature (14)..(14): n is a, c, t, g, unknown, or other
  misc_feature (20)..(20): n is a, c, t, g, unknown, or other
  misc_feature (23)..(23): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (93)..(93): n is a, c, t, g, unknown, or other
nccctgatgttttntttttnccncctctnnccnnnnaaaaaaannnnnnnnnannggggcgccttgcgccgtccacggaagcatctattaaanggatcccccgggctgcaggaattcgtctcacccctagaaaaaatacattgtcagtggatcagaagacaactgcgtgtacatatgggacctccaagggagaaatatccttcagaaattagaaggccatacggacactgtcatctcggtgtcctgccatccaacagagaacaagattgcttctggtggccttcataatgataggactggaagattatggctccaagatacctaatcaactctgctggtgtggcctacgcctcataaaaagtaatttgcctatcaataaaaaaaatctgtcctgcttccccctggaataaaaaatttttttttcccccccccccctcggggggaggggcggggggtctctatatctccgctctctctcaccgcgcccgctcacttgccccccttttatttaaaacccctcccgcaccttgcgtagtaactcccgggtccgtttccccccacccttcgacgccgcctcctgaacggtgatcccaccccccttttaccccgccgccggggggcgatattatcctcacacaagtggcccgccgtagcctgtcctgtccttctctcttcttctctcctgtgactccacccccctcctctcattttccacccccatccatacctactcttcactcacttctcctacatctctatttctcataccctctcttcttcatgacccacgcttgcctcgtgcaggcaactaaagagcatcggtcgtccctcgccccgagcagctccctgtgggatcattaacatatgaattatcatcctacataacaaatag

SEQ ID NO: 65091 - DNA, 677 bp, Zea mays
  misc_feature: Ceres CLONE 1535622
  misc_feature (677)..(677): n is a, c, t, g, unknown, or other
ggcggccgctctagaactagtggatcccccgggctgcaggaattcgtctcacccctagaaaatcgtgtcgtgtttgttgttgcccatctgtgtttttgattgcaaggtcgctctgtgtcggttgttagtgctgtgttcatcctcggtttcagcagactcatgcatcaaacagcatggactgcggatcgatggatgctgttacccccgtcacgctttattctaagttaatcttaaggaaaacatgctgcttcttggtgctgataaaaaaaaacaataacgagacgctcgaggtacccaattcgcccctatagtgagtcgtattacgcgcgctcactgggccgtctttttacaacgtcgtgacttggaaaaaccctggcgtttaccccagttaatcccccttgcaacaccatccccctttcccccaggctggggaaaatacgcgaaaaggccccggagccgatcggcccttcccgagccggttgcgcagccctggtttgggaaaagggagaatttgaagccgttggatattttgggtaaaagttccgcgttaaaattttttggtaaaattcccctccttttttttaacccaaaaaggcccaaaattttttaaaactcccttttttcatccaaagagaaaaccccctataaaagggttggagtgttttgttcccattttn

SEQ ID NO: 65092 - DNA, 731 bp, Zea mays
  misc_feature: Ceres CLONE 1535623
ggagctccacgcggtggcggccgctctagaactagtggatccccccgggctgcaggaatttcgtctcaccctagaaaaagtgtgtacacgtacgctttgcattgttgcagggtagcatgttacgtacgacgtcgtccatgtataagtgtgttgacgtgtgagacggacagagagagagagagacagggatcgatcgagagacggtcatgtcccttttgggctgttttggttattcatatcacaactttttgagtgtatacaagatttatttctgtggcgaaaaaaaaaaaaaaaaacgagacgctcgaggtacccaattcgccctatagtggagtcgtattacgcgcgctcacttggcgtcgtttttacaacgtccttgactggaaaacccctggcgtttacccaactaaatcgcctcccccccacttccccttttcgccagctggcgtaatagcgaaaaggccccgccccgatcgccccttcccaacatttgcccccccctgaaatggcaaatgaaacatttgtaacctttaatatttttgttaaaaattccccgttaaattttttgttaaaatcccctcctttttttttaaccccaaagggcccaaaatctggcaaaactcctctttttaaatccaaaaataattaacacccaaaaattagggttttaaatgttttttccccccttttgggaaccaaaaaccccccccttttttaaaaaaacgcgtgga

SEQ ID NO: 65093 - DNA, 646 bp, Zea mays
  misc_feature: Ceres CLONE 1535624
  misc_feature: Encodes the peptide sequence at SEQ ID NO. 65094
  misc_feature (400)..(400): n is a, c, t, g, unknown, or other
ggagctccccgcggtggcggccgctctagaactagtggatcccccgggctgcaggaattcgtctcacccctagaaaaatcagccatcccctcccgcggcaagtctctctgaattgtgggtctccggcgatggcggctcttgctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagnagtccctggagactatggctacgacccttttggcctgggcaagaagccagaggacttcgccaagtaccaggcctaccagctgatccatgcccgatgggccatgctcgggtgccgctggcgctttatccccagaggcgtgcaaacagttcgggcctaactgcggccccgaggcccttctggttcaagaccgggagccctgctcctcaacgggaaaaccccctcacctatttcgggaaacgcattccc

SEQ ID NO: 65094 - protein, 142 aa, Zea mays
  misc_feature: Ceres CLONE 1535624
  misc_feature (91)..(91): Xaa is any aa, unknown, or other
MAALAPSKILGTKLNFAGSSRYATAAPTAGAQKIVSLFSKKPAQKPKPSAVSSSSPDISDELAKWYGPDRRIYLPDGLLDRSEVPEYLTGXVPGDYGYDPFGLGKKPEDFAKYQAYQLIHARWAMLGCRWRFIPRGVQTVRA

SEQ ID NO: 65095 - DNA, 656 bp, Zea mays
  misc_feature: Ceres CLONE 1535625
  misc_feature: Encodes the peptide sequence at SEQ ID NO. 65096
  misc_feature (349)..(349): n is a, c, t, g, unknown, or other
  misc_feature (362)..(362): n is a, c, t, g, unknown, or other
tggagctccccgcggtggcggccgctctagaactagtggatcccccgggctgcaggaattcgtctcacccctagaaaaacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggatggctagggtctaagagctatcttctgttttatcattgtctctgnttctgtaagctancaagtgatgctgtgatgcttttactaagattctgatgagtggtgacgttaagagaaaattggctgtactgtgttgtaccccaagattccttgcagcattgctatgctgagtaacgaaccctttatcttataaatatggaggggtgcagtgattgatgtccaaaaaaaaaaaaaaaaacgagacgctcgaggtccccattcgccctatagtgagtcttatacgccccctcccttgccgtctttttcaacctcgtgactggaaaaacccgggcgttacccaactaatcggcctgcc

SEQ ID NO: 65096 - protein, 51 aa, Zea mays; identical to SEQ ID NO: 2355
  misc_feature: Ceres CLONE 1535625
  misc_feature (9)..(51): Pfam Name: Ribosomal_L39 Pfam Description: Ribosomal L39 protein

SEQ ID NO: 65097 - DNA, 691 bp, Zea mays
  misc_feature: Ceres CLONE 1535627
  misc_feature: Encodes the peptide sequence at SEQ ID NO. 65098
  misc_feature (27)..(27): n is a, c, t, g, unknown, or other
  misc_feature (30)..(30): n is a, c, t, g, unknown, or other
atagctggagctccccgcggtggcggntgntcttgtctaatggatcccccgggctgcaggattttccctcacccctagaaaaagctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatcccacgctgaccttacccctcgaatcgccaaccgtatgcagaacatgttgtgtgtggaaccatggatgcgctgactgtacaaacatgccagtaaagaagattgaacattgccttggaaaccctccaatccaatggatttcaaatggtttgggccttcaaaggggaccccccccttggggcaagaaaatttttgcaaatttaaaggcggatttgcctgggccctttgaattgggggcccctttttagccccacccgcggggttttttttgggcaatcggggggggggtttccccagggcccccccctttgtttaaaaagggggggggggggggtcttttgggagaaatattaaaaagtttttcccccccctaaaa

SEQ ID NO: 65098 - protein, 81 aa, Zea mays
  misc_feature: Ceres CLONE 1535627
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITWGAGGSHADLTPRIANRMQNMLCVEPWMR

SEQ ID NO: 65099 - DNA, 691 bp, Zea mays
  misc_feature: Ceres CLONE 1535633
  misc_feature: Encodes the peptide sequence at SEQ ID NO. 65100
tccccgcggtggcggccgctctagaactagtggatcccccgggctgcaggaattcgtctcacccctagaaaaagcatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccacgctatgaatctagtccttcctttcttgtatcttccatgtgacgcggcgtgtgcgtcccctcatgtgtgatgatgccagatgaatactacaaataagacgttgttgtgactgtgtgtcaaaaaaaaaaaaaaaaacgagaccctcgagggtaccccattcccccctaaagggagctctaattaccgcccgcctcactgggccggcctttttacaaacgtccttgaccgggggaaaacccttgggggttaccccaaactttaaaccgcccctttggaagccacatcccccc

SEQ ID NO: 65100 - protein, 63 aa, Zea mays; identical to SEQ ID NO: 28299
  misc_feature: Ceres CLONE 1535633

SEQ ID NO: 65101 - DNA, 843 bp, Zea mays
  misc_feature: Ceres CLONE 1535634
  misc_feature: Encodes the peptide sequence at SEQ ID NO. 65102
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (477)..(477): n is a, c, t, g, unknown, or other
  misc_feature (478)..(478): n is a, c, t, g, unknown, or other
  misc_feature (482)..(482): n is a, c, t, g, unknown, or other
  misc_feature (516)..(516): n is a, c, t, g, unknown, or other
  misc_feature (556)..(556): n is a, c, t, g, unknown, or other
  misc_feature (619)..(619): n is a, c, t, g, unknown, or other
  misc_feature (718)..(718): n is a, c, t, g, unknown, or other
ttccccccccccccccctnaccaaaannnnnnnnaattcccnnncnaaataaaagaaacagcaccctggccgccgctctaaaatagtggatcccccgggctgcaggaattcgtctcacccctagaaaaaagctcatggttaagaaagaggaatccttggacaaccttaatctcttctctatcattacagtgatgtcatttttccttttggcccctgttaccttctttacagaaggtgtcaaaattactcctacatttttgcaatctgctggtctgaatgtaaaccaagtcccttacaggtgtcttttcgctggactgtgtttccctgtataccaacaggtgtcttacatgattttggccatggtgtctcctgttacctcattctgtggggcaaccgtgttaaattttattctcgttctttggggggggggggggggtggtcttttggaacatcttgtttttcccccatcttccccanntcanaacctgcaaattgcactttggccgggaagttttnccgggtactccaacctttcaaggttcccttaaataccctnatttcaaaagaccggtttttaaaagccgcggaatggggtatgatgccagaccttttttgtttnttgtttggtatgcttaaaccacttatccgtggattctcagcgggaaatagtagcctttccacaaaatattttggttttttttgacgctccttatatcanatacagaaaatcaacaggcttcccgagagcatcccccacgtcccccccaccctccgtggccccctttatttcgcgcctctgcgtgaaacattctctatcaataattaaaaggaccacttccccct

SEQ ID NO: 65102 - protein, 137 aa, Zea mays
  misc_feature: Ceres CLONE 1535634
  misc_feature (115)..(115): Xaa is any aa, unknown, or other
  misc_feature (116)..(116): Xaa is any aa, unknown, or other
  misc_feature (128)..(128): Xaa is any aa, unknown, or other
MVKKEESLDNLNLFSIITVMSFFLLAPVTFFTEGVKITPTFLQSAGLNVNQVPYRCLFAGLCFPVYQQVSYMILAMVSPVTSFCGATVLNFILVLWGGGGGGLLEHLVFPPSSPXXNLQIALWPGSFXGYSNLSRFP

SEQ ID NO: 65103 - DNA, 616 bp, Zea mays
  misc_feature: Ceres CLONE 1535642
  misc_feature: Encodes the peptide sequence at SEQ ID NO. 65104
tccccgcggtggcggccgctctagaactagtggatcccccgggctgcaggaattcgtctcacccctagaaaaattcgggggttgctcgcgccgcggccgccgaggctgattgacgaggaggacctacgatctgtacgataggggtgactccgtctgtcggtgctcccacccgaagatctgcggctctgactcccgcgtctgccgggtctgagacgcccctcgcggcctgatcacgatatactgactcatgtgctgcacgctcagcgtccgccgcttcaccaaggacattgggttcatcaccctgccgttgaccaggtcactgtgctggtgtggagaactccttacatcagatagatgggtccttcataggcccgcacctatctcgccctcctaacttttgctcagcaccgtgtgactcatgtgatttgctcgcacttgatattgtgttgatggctactttgagcttgttggacccgcttcattctttataccgatatgctcacatcgtgatgtctgttcttaatcaaaagaatagaccgagatagggttgagtgttgttccagtttggaacgagactctctattacccaattcgcactcctacgacaagggtgagc

SEQ ID NO: 65104 - protein, 48 aa, Zea mays
  misc_feature: Ceres CLONE 1535642
MCCTLSVRRFTKDIGFITLPLTRSLCWCGELLTSDRWVLHRPAPISPS

SEQ ID NO: 65105 - DNA, 717 bp, Zea mays
  misc_feature: Ceres CLONE 1535649
  misc_feature: Encodes the peptide sequence at SEQ ID NO. 65106
  misc_feature (674)..(674): n is a, c, t, g, unknown, or other
agctccccgcggtggcggccgctctagaactagtggatcccccgggctgcaggaattcgtctcacccctagaaaaaaaacctgattcatctattgcaagtaaaggacatcttagtgtatcagatcttcttgacttcataagcccagtccaggaaagaaaagaaagcaatgtgcaaaggaagtgtcggcgtgcaaagaataataccagagctcatcatggtgaatcagttgaagaaaaggagaatttccagcatgactcaggatctcttggagcaagtaaagacggttttgaagaagaaaaacctgatgtgcatcctcctgctgtattagaagaaaattatgctgcccatgaagagcagaagcaatgtgatgttttatcaccagaagaatattctgatgaagggtggcaagcagctaatatgagaggaaggtccgcaaatgtaaggaagaaaagtagtcgcaggaaacccgctcttatgaaattaatggttgatcgtttcgaagatgatcatacaggttctgtgtataggactggtttacagcctcgaacaaaaggggagaaagatgattctgcaactgctcctagccagatttcatttggtagctttttaaaaactgacaagttgaatggggatcccagcattgctgaagataagtctttgaatggtactgctnaaccagaacatttacaaatccaacaggaaattacaggcccacc

SEQ ID NO: 65106 - protein, 238 aa, Zea mays
  misc_feature: Ceres CLONE 1535649
  misc_feature (225)..(225): Xaa is any aa, unknown, or other
APRGGGRSRTSGSPGLQEFVSPLEKKPDSSIASKGHLSVSDLLDFISPVQERKESNVQRKCRRAKNNTRAHHGESVEEKENFQHDSGSLGASKDGFEEEKPDVHPPAVLEENYAAHEEQKQCDVLSPEEYSDEGWQAANMRGRSANVRKKSSRRKPALMKLMVDRFEDDHTGSVYRTGLQPRTKGEKDDSATAPSQISFGSFLKTDKLNGDPSIAEDKSLNGTAXPEHLQIQQEITGP

SEQ ID NO: 65107 - DNA, 728 bp, Zea mays
  misc_feature: Ceres CLONE 1535650
ctggagctcaccgcggtggcggccgctctagaactagtggatcccccgggctgcaggaattcgtctcacccctagaaaaaccaccagtccccatccagtacaggccagcactgccgctgccgtgtcgccaccggcccccggctggctctccagcgactccgtcggcggcttgccttcccgcgccgcgccgggcccggatcgctcgccctttccgactgtcctgctcaacgccgccaccagcacgtcctttcccgcgccggaggtcccgctcgcctgccacagcggtgcggcgcaagctcccccaagcgtttctcaagtgacgagaagaagaaagagggggagaaggaggttggcgtcagtgggtcccgcggaccaatcagctagagagctgagtgatgtctcgcaagcgatgagcctcatgagatcggatcggaggccatcattccacgcactggtgatgaaaagctcgcttggtgcccctagctagctagtggcgaagcaggaaagctagccagccaagatcctgcttgtgagaaaaaaagggagtagatccagtaattttaggaatctggtcaacatacctacggcaagatggctgaaattggtaatccgcgacctggaaagggtagtcaaagtcgcacctgcaatcaaaaaggccgggggaaacagctaaccaaaacaagggggattgctttaagacccggaaacctgccacctgaggtcaaacc

SEQ ID NO: 65108 - DNA, 748 bp, Zea mays
  misc_feature: Ceres CLONE 1535656
  misc_feature: Encodes the peptide sequence at SEQ ID NO. 65109
  misc_feature (467)..(467): n is a, c, t, g, unknown, or other
  misc_feature (535)..(535): n is a, c, t, g, unknown, or other
tggagctcaccgcggtggcggccgctctagaactagtggatcccccgggctgcaggaattcgtctcacccctagaaaaattccgacgccgcactcgcagatcttcccttcgtcctccacgccccacccctcgcgtcgccgctatggccgacgaggccctggaccagccgccagacgcggccccgtctccgtctctggccccagcgacgccgccggcccccgccacctcgtcccccgcggcgctgctccgcccgcgtcgggaggcgttcgagcatgggctcctgcccatccccaagctcatcttcccggagggcatgctagcgcagaccctcgcccagctcaaggagaagctcgccgcctcagtccccgacgggcgcgtgcgcgctgcggcccctggctgaggcgctgcagatcccgcaggagcaggcggcgctcgccctcggcacgctcgcggcggtgctcccgggncgaggacccgtgctttggggacggcgccctggatggtgctgcccgcgacctccgcgacgtgctgctcntcctctatatccagtctttacaagcgcctccgttccgcggagccgcgcccaagggactccccccgcccgggggggagagtctggggcgttcccccccccgggttggaatggggaacctttcccgggctttccccgaaataaagtttgtgtcccagaaaaccgcccccgttttttagcccttccccagcgggagaaaaaattttctccgtgttt

SEQ ID NO: 65109 - protein, 85 aa, Zea mays
  misc_feature: Ceres CLONE 1535656
MADEALDQPPDAAPSPSLAPATPPAPATSSPAALLRPRREAFEHGLLPIPKLIFPEGMLAQTLAQLKEKLAASVPDGRVRAAAPG

SEQ ID NO: 65110 - DNA, 638 bp, Zea mays
  misc_feature: Ceres CLONE 1535657
  misc_feature (366)..(366): n is a, c, t, g, unknown, or other
  misc_feature (373)..(373): n is a, c, t, g, unknown, or other
  misc_feature (413)..(413): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
acccgcggtggcggccgctctagaactagtggatcccccgggctgcaggaattcgtctcacccctagaaaaagccctctcgctctcgctctccaccgccgctagggtttccaccgcccccggcgatgggcgccctcactgacagccggaagcgtctctcggcggaccgctgcctctcggccgaccatcgcctcccctatccctcgttccccccaccgccccttacccctccctccaagcggaccaagctcgccccattccctgaactcgatccctccacctccgccgtcccgcctatccgtccttctccccaaatcatccactccgccgccgcggcatccgcctccttcacgccgggcccttcctncctcttncacatcgcttccaccccgcttccgcacaggggcgactccngcgncnngcgcattggcgcgccggatccacggcccacagcggattcctcgcggtctcccggctgggtggggctggaaggacccacgctggcggccgtctggtgtttcccccgtaatcaccccgggcttgggttctgggatctccgcgggagggaaagggttggaaaaagggttccccacacggggggattttatttcccggccgcaaaacggaggcccgaggggt

SEQ ID NO: 65111 - DNA, 684 bp, Zea mays
  misc_feature: Ceres CLONE 1535665
  misc_feature: Encodes the peptide sequence at SEQ ID NO. 65112
  misc_feature (650)..(650): n is a, c, t, g, unknown, or other
tccccgcggtggcggccgctctagaactagtggatcccccgggctgcaggaattcgtctcacccctagaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccgggcgccgggaccggtcgctggcgcggcctccgctccggcctccgctgtggccgtggtgtcgtccgcactgctgtccctccttatgacggccctgatgcactagaagtatcatactagatttgagcgggaatttggttcacccgtgctattcctcattctttttggaacaaatatgcctgcaacctttatttatagaaaaaaggtgggatgatcctgctgctaaaaaaaaaaaaaaaaccgagccccctcagggtaccccattttccccctatgagggagttcttttttccccgcgcccccccgggggccgtcgtttttaaccccgccgggaccgggggaaaaaaccctggggggttaccccccaaccttataacccccctttggnagagcaaaattcccccctttttcccgccgggggg

SEQ ID NO: 65112 - protein, 70 aa, Zea mays
  misc_feature: Ceres CLONE 1535665
MAPRVASALLFVVAVLVASAAAQESMAPASAPGAGTGRWRGLRSGLRCGRGVVRTAVPPYDGPDALEVSY

SEQ ID NO: 65113 - DNA, 633 bp, Zea mays
  misc_feature: Ceres CLONE 1535667
  misc_feature: Translation starting site: 97
  misc_feature: SWISSPROT Homolog: EC 3.2.1.23 Beta-galactosidase
tcccccgggctgcaggaatgcgtctcacccctagaaaaagaatttccctcattttttgtctcttcaaactctctgttcttttttttttgcttttttatgatcgcaataaagttcagtaggggtatacccctcctgtttgcttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgccaccgatcgcccttcccaacagttgcgcagcctgaatggcgaacgcaaattgtaagcgttaatatttttgttaaaaattcccgttaaattttttgttaaatcagctcattttttaaccaaaaggcggaaatcggcaaaatccctttataaatcaaaagaatagaccgaaataggggttgagttgttgttccagttttggaaacaaaagccccctatttaaagaccggggaactccaacgttaaaagggcgaaaaaaccttctatccggggggaagggccccctacgggaaacccctccccctttttc

SEQ ID NO: 65114 - DNA, 851 bp, Zea mays
  misc_feature: Ceres CLONE 1535674
  misc_feature: Encodes the peptide sequence at SEQ ID NO. 65115
  misc_feature (8)..(8): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
ctttcccngatgggnnangggagcatggggatttcnttacattttnnttttgtattcatacccacccccgggcggccgctctagactagtggatcccccgggctgcaggaattcgtctcacccctagaaaaaagaagaggaagctggagatgctagagaagcaatacatcgatgaactgaagaaggaaattgatggcgttgctttctctagtttgtcaaacaaggaagcagataaatcaccgaatgcaaaagatgattctcagccagatcgtgaggaggatgcccgtaaccccgacgaggatgatgatgatgatattggctactgctctcatgtcctctgaagcggagaggccatctatacggctcccgaacaagccgccaaaaaagagacaaatacggaaggcccctcggaggtccccctttttttccccccccccctctggggggggggggggggggggggccccccgtcttcctcctgcgtttccctctcgcggcgcacgctcctataaaccgggggctccgttaccgcaagggatacccccccgggcgggcgtgagacgggcccccgcgttgcgtgatgcttggcccgattggagctctcgccccaccgcttttgcctgtttttgcctccttgttgtgcctgcggttgcgcccccgcgcgccgcagacgcgccgctcgccgcccgctgtgccgggccctcccccgatcccccctgccacccccgccgcggcaactacgtcgccgcgcgcgccccggctacccccaccaccctcgccacacactcggccaacgcattccccccccttgatccggagaggcccggccccttgcccccccctcccctctg

SEQ ID NO: 65115 - protein, 63 aa, Zea mays
  misc_feature: Ceres CLONE 1535674
MLEKQYIDELKKEIDGVAFSSLSNKEADKSPNAKDDSQPDREEDARNPDEDDDDDIGYCSHVL

SEQ ID NO: 65116 - DNA, 626 bp, Zea mays
  misc_feature: Ceres CLONE 1535675
  misc_feature: SWISSPROT Homolog: EC 3.2.1.23 Beta-galactosidase
  misc_feature (185)..(185): n is a, c, t, g, unknown, or other
ctccccgcggtggcggccgctctagaactagtggatcccccgggctgcaggaattcgtctcacccctagaaaaaaaaaaaaaagtatggcggctgatgtttcttctttctgtgtcgtatgagtatgttttttcctagtagattgtatcaggagtttttcatttcaaattaagctgcgcatgttcnttttgagccttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggtttgagtgtttgtcccagttttgaaacaagagtccactatttaaagaacgtggactccaccgtcaaagggcgaaaa

SEQ ID NO: 65117 - DNA, 652 bp, Zea mays
  misc_feature: Ceres CLONE 1535680
  misc_feature: Encodes the peptide sequence at SEQ ID NO. 65118
ctccccgcggtggcggccgctctagaactagtggatcccccgggctgcaggaattcgtctcacccctagaaaataatagcaatgattttgtatgtagtgttgcacctttggtatcacattgtggttttccttcactccattgtcggctcttagatgctgtaacactgaactccattgccggctccattgcccggggttgtgctcacgccatcagttttggagtctcttggatgctgtaacactgaactccattgccggctccattgcccggggttgtgctcacgccatcagttttggagtccggaggagggaggaaaagcagggtagccagaatctctattggcgtcgcctgtttcattgtgttcatgatgatcctttcagtaataggcctttttaggaagtaaaggaaacgtttgtgctctggtttctgcaaaaaaaaaaaaaaaacgagacgctcgaggtacccaattcgccccaatagtgagtccgtattacgcccgcttcctggccgtcgtttttacaacgtcttgactgggaaaacccctggcggttacccaaatttaatcgcccttgcaacaaaacccctcttttccccaacctgggctaaaaagcaaaaaaggccccgcaccgaattgccccttccccaaaaggg

SEQ ID NO: 65118 - protein, 78 aa, Zea mays
  misc_feature: Ceres CLONE 1535680
PRGGGRSRTSGSPGLQEFVSPLENNSNDFVCSVAPLVSHCGFPSLHCRLLDAVTLNSIAGSIARGCAHAISFGVSWML

SEQ ID NO: 65119 - DNA, 691 bp, Zea mays
  misc_feature: Ceres CLONE 1535681
  misc_feature: Encodes the peptide sequence at SEQ ID NO. 65120
  misc_feature (427)..(427): n is a, c, t, g, unknown, or other
  misc_feature (431)..(431): n is a, c, t, g, unknown, or other
  misc_feature (442)..(442): n is a, c, t, g, unknown, or other
  misc_feature (447)..(447): n is a, c, t, g, unknown, or other
  misc_feature (508)..(508): n is a, c, t, g, unknown, or other
ctggagctccccgcggtggcggccgctctagaactagtggatcccccgggctgcaggaattcgtctcacccctagaaaaagcggacggagagcccaggaaccgaaagcctaatcgcaatcccactcgcagcaacgacctacgcgccgcccctaactccaatccagaaccccagagtccagaggcagaccggcaagctggacacctgcggcatggagcgggtggcgctgctccgcacctcaggccgccgcctcctacaccgctgccgcaggggcaggcccgtcgtcgtgcccgctgccgcggcctcatccttggcacgccgggcgtcctcgttctcactcccggcgcgcggctactcgactctgccccgcggcggcgcgcgattcctggtcgctgcggcgccgctgcactgctccgggcggtactggncggncgctgcgccanctttnggggggaaggctgtccgcctccgctgttatctacctcgcctctcccgtggcctatgatacngatgacgtccatgagtttgccccaaaagtcggaatttgaaaaggcccctgaaccgacctttggagaatgggcaatccattggggtgtcctttaaagcccaaaaaaaaaggggggccgaaaaaaatggtcgtgggtcaaaagaagagggaaaaaaaagggttgggggtatgtgttcccccaccc

SEQ ID NO: 65120 - protein, 97 aa, Zea mays
  misc_feature: Ceres CLONE 1535681
  misc_feature (73)..(73): Xaa is any aa, unknown, or other
  misc_feature (74)..(74): Xaa is any aa, unknown, or other
  misc_feature (78)..(78): Xaa is any aa, unknown, or other
  misc_feature (79)..(79): Xaa is any aa, unknown, or other
MERVALLRTSGRRLLHRCRRGRPVVVPAAAASSLARRASSFSLPARGYSTLPRGGARFLVAAAPLHCSGRYWXXAAPXXGGKAVRLRCYLPRLSRGL

SEQ ID NO: 65121 - DNA, 830 bp, Zea mays
  misc_feature: Ceres CLONE 1535683
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
ttttttttncnnnttttgtttttgtttcttcnnnnnnnctttnnnaantctctctggagctccccgcggtggcggccgctctagactagtggatcccccgggctgcaggaattcgtctcacccctagaaaagccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatatatctcatctaatatccatccatccatctatagcagtattatgtatgcatccacatggtaataatctggctgaccgcatccgcatatggcggtctcatcgtccatctataccttgaaaactactaattaattactggagttattattaatactggggttaaccactacttaccgtaccttttaaatattaccaccgcctacccccaaaaaaaaaaaaaaaaaaacgaggacccctccgaggtacccccaattccccccctttggctggaagtgttattttttccccgcgctccacttgggcccgttctgtgtttaaccgacgttccttggacctggggaaaaaaccccttgggggttttccccgcaaatttaaatcagccccttggcgagcgcaatatcccccccttttccccccccctctgggcggtcaaatagtgtgaaaaaagaggactccggataccggagtcgcgcccctttttccccaaatgtgttgttgcgcacaaccctttggaatttgggcctaaaatgaggaatcttttcgtcataccggcc

SEQ ID NO: 65122 - DNA, 707 bp, Zea mays
  misc_feature: Ceres CLONE 1535684
  misc_feature: Encodes the peptide sequence at SEQ ID NO. 65123
  misc_feature (591)..(591): n is a, c, t, g, unknown, or other
  misc_feature (601)..(601): n is a, c, t, g, unknown, or other
ctggagctcaccgcggtggcggccgctctagaactagtggatcccccgggctgcaggaattcgtctcacccctagaaaaacccacccacgccaccgtgtggtccgagtccgaccctgtgactgtgagtactactatcccagcatgtgctcaggacctcgcaagccgtccacccctcctctcccggcggcgatggcggcggcgctcctgctcgagctggcggcggcggacgacgtggtggcgttcaggcgcgccgcggaggacgacaaagccccggccttggacgccgtgggccactggtacggcccgtccgccgcgggcgcggccgccggccgcccccgcctcgaggcgcgcacgccggccatggtcgccgcgctctacggcagcacggcggtgctggcgtacgtgctgtcctccgcgcggcagaagccgggcgcgcgtcgcccacggaaggggccacgccgctccacctcggcgcgggccggcgcgccccgggctccgtcgcggccgcgaacatcctcctccgcgcgggccgcgtcgcggaaccccccgccctttctgggccttccccgccggggaacttcttcttccgngcggcaaaanccgccgccaaaacgggaaccgggggctccgctttgttctttaagtcccccggggggggacaccgtgtgttcttcgcccaaaaaatccgccttcccccccccccggg

SEQ ID NO: 65123 - protein, 188 aa, Zea mays
  misc_feature: Ceres CLONE 1535684
  misc_feature (150)..(150): Xaa is any aa, unknown, or other
  misc_feature (153)..(153): Xaa is any aa, unknown, or other
MCSGPRKPSTPPLPAAMAAALLLELAAADDVVAFRRAAEDDKAPALDAVGHWYGPSAAGAAAGRPRLEARTPAMVAALYGSTAVLAYVLSSARQKPGARRPRKGPRRSTSARAGAPRAPSRPRTSSSARAASRNPPPFLGLPRRGTSSSXRQXPPPKREPGAPLCSLSPPGGDTVCSSPKKSAFPPPR

SEQ ID NO: 65124 - DNA, 722 bp, Zea mays
  misc_feature: Ceres CLONE 1535685
  misc_feature: Encodes the peptide sequence at SEQ ID NO. 65125
acaagctggagctccccgcggtggcggccgctctagaactagtggatcccccgggctgcaggaattcgtctcacccctagaaaaaccctccctccctccctccctccctcactcatcggcgcgccgccaatggccgtgtggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcggcctcgcccttctttccagggtcgccggcgccggccgctcctaagaacggccttggggagcgcccagagagcctggacgtccgcggcgttgcggcgaagccgggagcctcgtctaatgccgtgagggcgggcaagacgcgcgcccacgctgccgtccccaaggtgaacggtggcaagtctgcggtggcggatgtggagcacgagaccataactgtaccttcgtcggtgccgaggactttctacaaccagcttcccgactggagcatgctccttgctgccatcacaaccatcttcttggccgccgagaagcagtggacgatgcttgactggaagcccaggcggcctgacatgctcactgacactttttgggttgggccggatcatacatgatgggctcatgttcaggcagaacttctccatt

SEQ ID NO: 65125 - protein, 135 aa, Zea mays
  misc_feature: Ceres CLONE 1535685
MAASIAASPFFPGSPAPAAPKNGLGERPESLDVRGVAAKPGASSNAVRAGKTRAHAAVPKVNGGKSAVADVEHETITVPSSVPRTFYNQLPDWSMLLAAITTIFLAAEKQWTMLDWKPRRPDMLTDTFWVGPDHT

SEQ ID NO: 65126 - DNA, 594 bp, Zea mays
  misc_feature: Ceres CLONE 1535686
  misc_feature (32)..(32): n is a, c, t, g, unknown, or other
  misc_feature (480)..(480): n is a, c, t, g, unknown, or other
tggcggccgctctagaactagtggatcccccngggctgcaggaattcgtctcacccctagaaaaaacatgccacacagccaacttggctggagaaagaggtgtagagagactcgtctctagctctctgctcctctcgagtctcggctagagcgagagcggccaacgcaggcagcggtccagggctggaggcagccacagccaagccgaaggcaacgagtggagaccggacaccggagccgcggagcgggagaccatccttgacttgtttttttcgccccttggatgtgacgactgagacgcgcgcggccgcgcctctccccactccgctgaccggacctgcgtgccccgcgaccgcaccagcgcggagctgcgtatcccgccagcggtgagccggtggaaggaccccgcccgccctgctattctctgctccaatccaaaccagccttttccccctccgtgcgcccacagcatagccgganggagagacgagagtgaagaaaatgaagaaacccctaggcggcgcaaagatttgctccgagagaaggatgtgctttaggattcacgacaatggcttctttggtgcccgggtgtcc

SEQ ID NO: 65127 - DNA, 690 bp, Zea mays
  misc_feature: Ceres CLONE 1535696
  misc_feature: Encodes the peptide sequence at SEQ ID NO. 65128
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (387)..(387): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
tccccgcggtggcggccgctctagaactactggatcccccgggctgcaggaattcgtctcacccctagaaaaatcccacccctcgcccaatgcgtaggtgtatctgcatgtccaacaccaccatgcagacgttccagttagttttttctagatcagaaaaatcgagtcctaccgactcgccgcactgcgcgggatccacctcgtcgcaactcccgtgtgcgccgccaataatggagacccgggacactgatgcgacgccaactccgctactcctacacggcctctgctcggccgccggatgccgaagcgggccggaaggtctccgtgcaaccgcgcacggaaccgcgcaaacacaagggcagctnnnggagtcccccccccttcccnctnngncgggggcaatttggggcttccccgggcgggggtgtgtttttctaaacccaaggggcccgccccctccatccagagctttcctttttagggggccctgatacggggtaggtggctataaaaaaaaaatcaggggggggcctctttttcccgccaccccctcaagggcggagaaccggggggcccccccgatgcccccccgtttttccaaaaaataaaaaattgcgaggcctctttaataccacaggggggagaagtatttccagataaaaacctggggggctaccacctgctcaccat

SEQ ID NO: 65128 - protein, 60 aa, Zea mays
  misc_feature: Ceres CLONE 1535696
  misc_feature (23)..(23): Xaa is any aa, unknown, or other
  misc_feature (30)..(30): Xaa is any aa, unknown, or other
  misc_feature (31)..(31): Xaa is any aa, unknown, or other
  misc_feature (32)..(32): Xaa is any aa, unknown, or other
MPKRAGRSPCNRARNRANTRAAXGVPPPSXXXGGNLGLPRAGVCFSKPKGPAPSIQSFPF

SEQ ID NO: 65129 - DNA, 657 bp, Zea mays
  misc_feature: Ceres CLONE 1535697
  misc_feature: SWISSPROT Homolog: EC 3.2.1.23 Beta-galactosidase
  misc_feature (657)..(657): n is a, c, t, g, unknown, or other
ctccccgcggtggcggccgctctagaactagtggatcccccgggctgcaggaattcgtctcacccctagaaaaatatatatacatatgaggtttagggttgggggctggtgctggaattagattagattagctatcaaaatcctgataatagttgtaaccgtgaaataagacacttggacgaaattaaaattttcctgcaaagtgctattgttctgtgtacctaaagatcaattttgctggctcccggacagtgaacaacgatgtgcacgtgcttgataaaaaaaaaaaaaaaacgagacgctcgaggtacccaattcgcccctatagtgagtcgtattacgcgcgctcactggccgtcgttttacaacgtcgtgactgggaaaaccctggcgttacccaacttaatcgccttgcagcacatccccctttcgccagctggcgtaatagcgaaagagcccgcaccgatcgcccttcccaacagttgcgcagcctgaatggcgaaatgaaaattgaagcgtaaatattttgtttaaaattcgcgttaaattttttgttaaatcagcttcattttttttaaccaaagggcccaaaatcgggaaaaaatcctttaaaaatcaaaaaaattagacccgagataggggttgaatggttttttn

SEQ ID NO: 65130 - DNA, 687 bp, Zea mays
  misc_feature: Ceres CLONE 1535701
  misc_feature: Encodes the peptide sequence at SEQ ID NO. 65131
tccccgcggtggcggccgctctagaactagtggatcccccgggctgcaggaattcgtctcacccctagaaaaatcaagaacagcgagttcagccgcatgcgcaagaggattgctcgtatgctaaccgtgaaaagagagcgggaaattgaacaaggaatcaataaaagattgtctaggaagcttgataggaaatggaagcagagcattgtggtcagaccaccaccatctctaagggggaacaaagaggagtagaaagccgcaaaaagagggcaatgtgcaaagtcgtttcatgcgagtgttgcaggaaggtcccttcatgatttcaacccttattgcgttgttatgtattccatgtttacattttgctaagcattgctatctgaatctgaatttcagtccccacacccatctgtaaatcttgacttatttaaatttacactttcatctgtgttatcagtaattgaggatggcctgtcatttgcacctgaaaggtgcatgccttccttgccagataaaaaaaaaaaaaacctagacgctcgaggtacccaattcccccctataggggagtcgaattacgcggtgctccctgggccgttttttttaacaccgcccttgactgtgaacaacccttggtgttacccaactttaattccccttggaaaccacctccctcctttcgcccgcctg

SEQ ID NO: 65131 - protein, 51 aa, Zea mays
  misc_feature: Ceres CLONE 1535701
MRKRIARMLTVKREREIEQGINKRLSRKLDRKWKQSIVVRPPPSLRGNKEE

SEQ ID NO: 65132 - DNA, 699 bp, Zea mays
  misc_feature: Ceres CLONE 1535704
  misc_feature: Encodes the peptide sequence at SEQ ID NO. 65133
  misc_feature (431)..(431): n is a, c, t, g, unknown, or other
  misc_feature (445)..(445): n is a, c, t, g, unknown, or other
  misc_feature (504)..(504): n is a, c, t, g, unknown, or other
  misc_feature (511)..(511): n is a, c, t, g, unknown, or other
aaagctggagctccccgcggtggcggccgctctagaactagtggaacccccgggctgccaggaatcgtctcacccctagaaaaagcctctcccaccgccgccgccgccgcggcgacctgctcgccgccaatctctaccccgccggcgacaccaagcttctcaagcagcacctccagcaccaggccacgcccaccaaggacatccaggagattgtccgccgccagcaggcggagacgccgcctccgccggcggtgcagctcgccaaggccgtggcggagccgaagacgcctcctccgccgccgccgccgcagcacaggcagccggcgcggaagacgcccggcagcggcgccacgaccagcggcgggagcgaacgggacggggccacgcctaggagcacgggaagcgcggggatgccggaagttcgcatctcnggtggggcactggntcacctcgtgagctgggagaggccacgacgcctcacccgagagatgtctcggggaggtnggctacnggatcctgtacaggggccgctgcacgactccacttgatcgccgtcaggatctcctcaatataggggccagcccaaaaaggattccaaggggagcccaaaccatttggcctggtcccgacaaaaaccccccccaggtgcttggtaccgcgctaaaagggccttaaggatccttttgtacaaaaattggc

SEQ ID NO: 65133 - protein, 45 aa, Zea mays
  misc_feature: Ceres CLONE 1535704
  misc_feature (12)..(12): Xaa is any aa, unknown, or other
  misc_feature (32)..(32): Xaa is any aa, unknown, or other
  misc_feature (34)..(34): Xaa is any aa, unknown, or other
MPEVRISGGALXHLVSWERPRRLTREMSRGGXLXDPVQGPLHDST

SEQ ID NO: 65134 - DNA, 855 bp, Zea mays
  misc_feature: Ceres CLONE 1535711
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (719)..(719): n is a, c, t, g, unknown, or other
ttccccctcctccctcccttccgtattccccctcccccaaaaacttnnnnnaacaaaactggcgctccccgcggtggcggccgctctagaatagtggatccccgggctgcaggaattcgtctcacccctagcgccgtacacgtgcgtgcgtgtaagtaataagagcaaacgtcgtcccgtgtgtgttgctcgatccatactccttccatctacttattaacgcctgcaaataacgattaggtgcatgcttctcgaacgtgtaacgatccctccctgttactaactctaatgatatgcgtgacgtcaatttagcttttcctctccccttttctttctttccccacgcccagaagcacaaacttgccctcttctttactttccttcgtttcatcgtctgactaaagttcgccctatacttttttttttttcctattcaagacgcggggggggcgcttttctttgttattttggttttttttcccccccccccccctctgcatctcctcacgtttcagacacccttttatcgatccccgccttcggcaaatttattcattgcgaatcctccttaactgctacagccatctgctctcccctctggccatctccccccatggctcttatacacattactattacacccccgccctctccttttccctgcttagcaatgcccgcctgttgcccttcgccgtttatcatctgcctttttcccgccntcctatttccgcctcccgcgtctttctgtttgtgtcatcccctcctcctttatctgccttcctcccttaccccgctttatatgcgccaacagtgtgcagtttttctgtattactgtagtatctgtcgactcacccc

SEQ ID NO: 65135 - DNA, 703 bp, Zea mays
  misc_feature: Ceres CLONE 1535715
  misc_feature: Encodes the peptide sequence at SEQ ID NO. 65136
ctccccgcggtggcggccgctctagaactagtggatcccccgggctgcaggaattcgtctcacccctagaaaaagttccccacccatatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgttttgccatgggtccaatggctcgtcttggaaacctgcacttcagtaggccatctatcgtgtttcctagctatatccagagttttgtgcttagacaaatcagtcagtcgtttttgggaacctattatgatggacctttatttggctgctatatccacctacctggttaagtaaaaaaaaaaaaaaaaacgagacccctcgagggtccccatttcccccttatagtgaggccgtattaccccccccttcactgggccggcgttttttccaacccgccgtggactggggaaaaacccctggcgtttcccccaccttttatccgccttggaggaccaattccccctttttcgcccagtgtgggggaaataagcgaa

SEQ ID NO: 65136 - protein, 71 aa, Zea mays
  misc_feature: Ceres CLONE 1535715
MREFMERCHILVRRHRFAMGPMARLGNLHFSRPSIVFPSYIQSFVLRQISQSFLGTYYDGPLFGCYIHLPG

SEQ ID NO: 65137 - DNA, 624 bp, Zea mays
  misc_feature: Ceres CLONE 1535716
  misc_feature: Encodes the peptide sequence at SEQ ID NO. 65138
  misc_feature (624)..(624): n is a, c, t, g, unknown, or other
tctgaactagtggatcccccgggctgcaggaattcgtctcacccctagaaaaaaaccctagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaacccaagcgcccccgccagacctccaccaagggggtatgggacccccaagttccctgaggaacctgaggttttcctaggaagggccaccaaaaagaggggttagggcttaaacctaaagaataggaaagaaagcctggcctttggtttccctcgcccccccccccggggggggggggtgggggaccctgggggtttttccttaaagatggacaccccaaagggggggggttaccggcatagaaggggcaaagggaactctttcgcgctggtgcaaaaagggtttttttgttttttacaaaacgttcccgggcgcgccaccccctttctcccataacacgcgcgccggcgtggttttctcccctccgcgggtcgcgccccctcccctgctctcataatttcatagttatttccgcctccccccttcccgccn

SEQ ID NO: 65138 - protein, 41 aa, Zea mays
  misc_feature: Ceres CLONE 1535716
  misc_feature (3)..(42): Pfam Name: Ribosomal_L29e Pfam Description: Ribosomal L29e protein family
MAKSKNHTAHNQSFKAHKNGIKKPKRPRQTSTKGVWDPQVP

SEQ ID NO: 65139 - DNA, 685 bp, Zea mays
  misc_feature: Ceres CLONE 1535718
  misc_feature: Encodes the peptide sequence at SEQ ID NO. 65140
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (682)..(682): n is a, c, t, g, unknown, or other
tggagctccccgcggtggcggccgctctagaactagtggatcccccgggctgcaggaattcgtctcacccctagaataagcggccgccggggcgtcccggatcgtggtggtgcttgccgtcgctggtgagtccgtgagacgtgtgtctcccggccgttcagcgcagagcgcatccggccatcccgttcgtaccttaccggcaccttcttctgcggatcgatccggctaagccagcgcgcgcgatgcgccggcggtgggacagctgcttctcgggcggcgacatccgcgtgggcgggcgcgtcccccccgaggagccggagccggatggcttctccttcgccgagcccctcccgtcgtggcccacttattgcttaatcgatccggggccgcattctgccaggcgggggattcgcgcgggggacgatacgtatccgcggatgggagctggagctcgccgcggccaccgcgttccagaaatctgacactgctcgggnnnnnnnngtgggggagaaaaaaccccccttccaggttgacagggagaaagcagtctttccaaatacgtatgcgcttgtctctcttttgggggaacttggtgaatttatagaaaaaacaatttgccctaccaacttgttatcaacttaatgaccagtaaaaaaatggcagaaaacaaattacccatttncat

SEQ ID NO: 65140 - protein, 79 aa, Zea mays
  misc_feature: Ceres CLONE 1535718
MRRRWDSCFSGGDIRVGGRVPPEEPEPDGFSFAEPLPSWPTYCLIDPGPHSARRGIRAGDDTYPRMGAGARRGHRVPEI

SEQ ID NO: 65141 - DNA, 692 bp, Zea mays
  misc_feature: Ceres CLONE 1535722
  misc_feature: Encodes the peptide sequence at SEQ ID NO. 65142
  misc_feature (437)..(437): n is a, c, t, g, unknown, or other
ctcaccgcggtggcggccgctctagaactagtggatcccccgggctgcaggaattcgtctcacccctagaaaaagctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccangggcaacgccactgttcctgctatggagatgaccaagtggtttgacaccaactaccactttattgtccctgaaatgggcccaaacaccaagttctcctatgcttctcacaagcctggtaacgaatataaggaagctaaggggctcggtgttgatccgtggccatacttgttggaccagtctcgtacctggttgctctaaaagctgcccaggggggggaaaaaggattcccccttttttccctttttagaaaatcc

SEQ ID NO: 65142 - protein, 164 aa, Zea mays
  misc_feature: Ceres CLONE 1535722
  misc_feature (2)..(165): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (99)..(99): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMAXGNATVPAMEMTKWFDTNYHFIVPEMGPNTKFSYASHKPGNEYKEAKGLGVDPWPYLLDQSRTWLL

SEQ ID NO: 65143 - DNA, 638 bp, Zea mays
  misc_feature: Ceres CLONE 1535724
  misc_feature: Encodes the peptide sequence at SEQ ID NO. 65144
  misc_feature (434)..(434): n is a, c, t, g, unknown, or other
  misc_feature (480)..(480): n is a, c, t, g, unknown, or other
  misc_feature (481)..(481): n is a, c, t, g, unknown, or other
aaagctggagctccccgcggtggcggccgctctagaatagtggatcccccgggctgcaggaattcgtctcacccctagaaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggatggccgcgcccgccaaggtgcgcgccttgccgcccaggcgggtggacgcggtcgcgatggtctcctatcgcgagacggagacggatgaggagcatgangatgctgctgcccgcatctaggagctgcccgtcatgccctgggccnnactcgtcggcagcggttacacccttttgagggatccacaccacacaaggggtcttgctttcacagaggaggaaaagggatggaccctactttgcgtggaactggtccctccgggcagtactatcctcaggaaactcaaaattaagaaggttcatgaa

SEQ ID NO: 65144 - protein, 82 aa, Zea mays
  misc_feature: Ceres CLONE 1535724
  misc_feature: SWISSPROT Homolog: EC 1.1.1.40 Malate dehydrogenase (oxaloacetate-decarboxylating) (NADP(+))
  misc_feature (76)..(76): Xaa is any aa, unknown, or other
MLSTRTAAVAASASPASPWKLGGRSEGGASCDGCRTYRNTLRRMAAPAKVRALPPRRVDAVAMVSYRETETDEEHXDAAARI

SEQ ID NO: 65145 - DNA, 659 bp, Zea mays
  misc_feature: Ceres CLONE 1535727
  misc_feature: Encodes the peptide sequence at SEQ ID NO. 65146
  misc_feature (403)..(403): n is a, c, t, g, unknown, or other
  misc_feature (413)..(413): n is a, c, t, g, unknown, or other
  misc_feature (414)..(414): n is a, c, t, g, unknown, or other
  misc_feature (434)..(434): n is a, c, t, g, unknown, or other
  misc_feature (441)..(441): n is a, c, t, g, unknown, or other
  misc_feature (442)..(442): n is a, c, t, g, unknown, or other
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (463)..(463): n is a, c, t, g, unknown, or other
  misc_feature (473)..(473): n is a, c, t, g, unknown, or other
  misc_feature (481)..(481): n is a, c, t, g, unknown, or other
  misc_feature (484)..(484): n is a, c, t, g, unknown, or other
  misc_feature (490)..(490): n is a, c, t, g, unknown, or other
  misc_feature (493)..(493): n is a, c, t, g, unknown, or other
ctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgncacatcaccnngtcacgaggcccagtccccncgcgccnntgagcngcnngcgtggttacngtgggtgccngtgtagcngcngctacngcngtggcgggcgccttgatggcggcggcgctaccgcggtggcggcgcggcttcggttgcggcggcgctacggttggtggtggcggcgctacggcggtggaaaccttgggggcgggacgggaactccaaagggactggaagaactggccgggggggccccccgcccaat

SEQ ID NO: 65146 - protein, 89 aa, Zea mays
  misc_feature: Ceres CLONE 1535727
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (81)..(81): Xaa is any aa, unknown, or other
  misc_feature (88)..(88): Xaa is any aa, unknown, or other
MAASDVEYRCFVGGLAWATDDHSLHNAFSTYGEVLESKIILDRETQRSRGFGFVTFSTEEAMRNAIEGMNGKELDGRHITXSRGPVPXR

SEQ ID NO: 65147 - DNA, 639 bp, Zea mays
  misc_feature: Ceres CLONE 1535733
  misc_feature: Encodes the peptide sequence at SEQ ID NO. 65148
  misc_feature (388)..(388): n is a, c, t, g, unknown, or other
ctccccgcggtggcggccgctctagaactagtggatcccccgggctgcaggaattcgtctcacccctagaaaaccctcgcttctcgcaccccttcgtttccctcgttttcttccctcccttccccctaccccgcgcaaaccctcgcccgccgcctcctcctcctcagatcccagctccaggaccctgccgcccgcccgcgcccgcgaccgggcctccgatccgcgcacccgcgcctgccccgatccccatggcggcggcggccggtgacggggccggcgaagccatggcacgggcgctgctgcagcagcaccggccgttgcgacgcccgcaggggagtacaccacttcgggcgcgccttccgccgccaccgacgagatggtggaagcnggtgtcctcaggacgccattgaaacggaacttaacgacagaacagaaaatgaagctgccgaatcaaatgactggatgagccctggatatggctatgctggcagcaccccatttcctacacccccttcaggtaaaggtttaaaacatccccccagcctaaggctacaaagggccagaaatctggtccccgacccttttggggtttgggtcccccgggcaatccttccactcctggtgggggctgcccctttg

SEQ ID NO: 65148 - protein, 59 aa, Zea mays
  misc_feature: Ceres CLONE 1535733
MSPGYGYAGSTPFPTPPSGKGLKHPPSLRLQRARNLVPDPFGVWVPRAILPLLVGAAPL

SEQ ID NO: 65149 - DNA, 662 bp, Zea mays
  misc_feature: Ceres CLONE 1535734
  misc_feature (68)..(68): n is a, c, t, g, unknown, or other
  misc_feature (392)..(392): n is a, c, t, g, unknown, or other
ctggagctccccgcggtggcggccgctctagaactagtggatcccccgggctgcaggaattcgtcccnttcacccctagaaaaaaccgcttcccttccgcggcttccacaccaccttagctcggccggtggcggtctgcttccgaccgtccgccggtttgcttgcttgcttgcttcatctgcctccgccgcacctcgcctccgtccagccagccagccagcgccaagtcaagcgatccggccgcacccagcctcgacctacccggccgaccctgtgtgggcggtgtgtttgcccttacacggcctcgcctcgcctcgaggtgtgagctcctccgacatctgctgcggcgacgacgtttctgcaagcgggctatcttacctttctcgacgcangagtgagtctgtgagtggtcactgcagggaggggctcttccaccacctgcaaggcggggagagtaaaaaaaagcagcagcttgcattccttgctagggacccgcgttggtcaactccagagaaaacttgaccgggtttgggcttcaaaatttccatgaacttttgaggtaccccggggataaatccaaattaaagggtggttctctttggaacctggttttttggggctggggaataccccaaccttggtggtgtcccccccccatattt

SEQ ID NO: 65150 - DNA, 694 bp, Zea mays
  misc_feature: Ceres CLONE 1535738
  misc_feature: Encodes the peptide sequence at SEQ ID NO. 65151
tccccgcggtggcggccgctctagaactagtggatcccccgggctgcaggaattcgtctcacccctagaaaatatgattgttttgattgaccgaatataaccttttcctcaataagttgtacgcggagccacaagtagtatataaaatcagaatatttcactcatgagagtgtgttctggttttacgcgagctgcttatgttattgctagctgttagtttattacctgtcatttttactttctatttctaatacaacctttttctttttctaataatctttatttcgattcagaaaaaaaaaaaaaaacgagacgctcgaggtacccaattcgccctatagtgagtcgtattacgcggcgctcattggccgccgttttacaccttcttgactgggaaaaccccccccctttccaaacttaatcggcctttgaagcacatcccccctttccccaagctggcgttaatagccaaaaaggccccgcaccgaatcgcccctttccaaaagtttgccccaccctgaatgggcgaatgggaaattggtaagccttaaacattttggtttaaaattcgcggttaaaattttttggttaaaaccaccctctttttttttaaacccaataaggccccaaaatcgggaaaattccccttaaaaaaatgaaaaaaattagccccgagatagggcttgaattgtct

SEQ ID NO: 65151 - protein, 32 aa, Zea mays
  misc_feature: Ceres CLONE 1535738
PRGGGRSRTSGSPGLQEFVSPLENMIVLIDRI

SEQ ID NO: 65152 - DNA, 807 bp, Zea mays
  misc_feature: Ceres CLONE 1535739
  misc_feature: Translation starting site: 584
  misc_feature (38)..(38): n is a, c, t, g, unknown, or other
ttccgtctcctcccctcccttcctatctcttccaattnatcccttttaaaacaacacacagcgttccccgcggtggcggccgctctataatagtggatcccccgggctgcaggaatttcgtcccctcccctagaaaaaaccgaccagagctacctcgacgacggctaaatcgccgccggctgggtgctcacctgccacgcctaccccacctctgacgtcatcatctatactcacaaggaggaggagctcaccggcgcataatcattcatgcccatccatctctatccctgtgggtcctcgttttgtgttaattgtaaacgctcgtacacccaacggcctttttttttcacttttacttatggttccgtgtcaacctttcacatttggtactggcccctttttctatttgcctcctcccccgaacctttgaatatggtttttggccccccccccccccccccccactctttttcgagtggtgtgtgggtgtgtgcccccccccccgcttcccaaaaacgaatttaaaaaatatcggttgtgtgctttcccgaggcgctcccctcactcccctcctcccccgctgatgattcttattattttcgcccaccccttcacttggcccgttgtgttttgtattacactttcttatcctttatttggtgtgatattaacaccggcgggtttacctcccgtcttcttatatttgtcttcttaccccattcctattctcattctctttcttgcgccgcttaggtgtccatatcttagtgccaaaagatacctccgcgtcgtctctgaggtttccgc

SEQ ID NO: 65153 - DNA, 653 bp, Zea mays
  misc_feature: Ceres CLONE 1535747
  misc_feature: SWISSPROT Homolog: EC 3.2.1.23 Beta-galactosidase
  misc_feature (21)..(21): n is a, c, t, g, unknown, or other
  misc_feature (45)..(45): n is a, c, t, g, unknown, or other
  misc_feature (63)..(63): n is a, c, t, g, unknown, or other
  misc_feature (74)..(74): n is a, c, t, g, unknown, or other
  misc_feature (106)..(106): n is a, c, t, g, unknown, or other
  misc_feature (128)..(128): n is a, c, t, g, unknown, or other
  misc_feature (167)..(167): n is a, c, t, g, unknown, or other
  misc_feature (174)..(174): n is a, c, t, g, unknown, or other
cacccgcgggtgggcggccgnctctagaactagtgggatcccccngggctgcagggaattcgntctcacccctnagaaaaaaaaaaaaaaaaaaacatgaacgggngctaagcgattctgccgaagcntgtgggatgtcaaaatggcatcggtagggggagcgttcncgccttnagagggaagcaaacgctgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacagtcccccctagtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaatttgtagcgttaatattttgttaaaattcgcgttaaatttttgttaaatcagct

SEQ ID NO: 65154 - DNA, 777 bp, Zea mays
  misc_feature: Ceres CLONE 1535749
  misc_feature: SWISSPROT Homolog: EC 3.2.1.23 Beta-galactosidase
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gtggtgtttgttttttttngaaaaagacacccccnncccctcttnaannntttttctggaactccccgcggtggcggccgctctagaatagtggatcccccgggctgcaggaattcgtctcacccctagaaaaaagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgaaggtgccatcgtcgccccaaaaaaaaaaaaaaaaacgagacgctcgaggtacccaattcgccctatagtgagtcgtattacgcgcgctcactggccgtcgttttacaacgtcgggactggaaaaaccctggcgtacccaacttaatcgccttgcagcacatccccctttcgccagctggcgtcaaaacgaaaaggcccgccccgatcgcccttcccaacatttgcgcaccctgaaaggccaaatgaaaattgtaaacgttaatatttttgtaaaaattccgcgttaaattttgttgtaaaatcagctccattttttttaaccatatagggcccgaaattccggcaaaaatccccttaattaaatccaaacagaatataaaccccaaaataagggttttgaattggtttgttccccgagttttgggaaacaaaggaaggcccccccttatttaaaagaaaacctggggaacctcccaccacccttccatataggg

SEQ ID NO: 65155 - DNA, 700 bp, Zea mays
  misc_feature: Ceres CLONE 1535753
  misc_feature: Encodes the peptide sequence at SEQ ID NO. 65156
  misc_feature (382)..(382): n is a, c, t, g, unknown, or other
  misc_feature (402)..(402): n is a, c, t, g, unknown, or other
tcaccgcggtggcggccgctctagaactagtggatcccccgggctgcaggaattcgtctcacccctagaaaaaacggatcgaaaacgaattaccctcggtgccctccctctcggcggcggcgcaagtccccttcatctccggcgcggcaaatggcaggtggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcagcgtcgtcgtcgaggagtagttcttatgtgtccccctcccaagggggagagggggggttnttttttaaaaactcactctnccaccccaccacaaagtgaaatgcttgtggagatttggcttgaaaattaagcctaacccatttgaaaaccccaaaaaaaaaaaaaaaaaaccagacccttccaggtaccccatttcgccctaaaggggaggccgaattacccgccttcactgggccctccttttaacaaacctcttgaacttggaaaaacccttggttttaccccagtttaaacccgccttgagcgaaaatccccctcttattcgccgcgggggtgaataaacccaaaaaggcctccccccctttgtcctttctcaag

SEQ ID NO: 65156 - protein, 63 aa, Zea mays; identical to SEQ ID NO: 37580
  misc_feature: Ceres CLONE 1535753
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase

SEQ ID NO: 65157 - DNA, 640 bp, Zea mays
  misc_feature: Ceres CLONE 1535758
  misc_feature: Translation starting site: 215
ctccccgcggtggcggccgctctagaactagtggatcccccgggctgcaggaattcgtctcacccctagaaaaacacatagtattcgacaggctcacaattccagctcaggccaccagcaagcgcatcggaaaggcagcatgcaagcaagcgagtaaccacaccacaacaacagggaggaggaacagaacagaggcagagagagagagagagccatggcggcggtcgccgtgggcggggggcactggaggaggctgcggacgctggggcgcggcgcgtcgggcgccgtggtgtcgctggcgtgggacgccgcgtcgggggagctggtcgcggtcaagtcggccggcgcgatcggcgcggcggcgctgaggcgggagcacgcggtgctggccgggctgcgctcgccgcacgtcgtgcgctgcgtcggcggcggcaatgcggcggaagaaggggtcgtcgtaccagctcttcctcgagtacgcccccggcgggtcgctcgccgacgaagtgcccccgagcgggggctccctcggggagcgcgccgtccgcgcgtcccccgccgacgtgcttgcggggggctggcgtaccttcccgccccgttccgttgtggaacgggaaactcaagcccccgaaacggggtg

SEQ ID NO: 65158 - DNA, 642 bp, Zea mays
  misc_feature: Ceres CLONE 1535759
  misc_feature: Translation starting site: 102
  misc_feature: SWISSPROT Homolog: EC 3.2.1.23 Beta-galactosidase
  misc_feature (571)..(571): n is a, c, t, g, unknown, or other
tccccgcggtggcggccgctctagaactagtggatcccccgggctgcaggaattcgtctcacccctagaaaaatactagaaaaaaagtaactgaataagggatgcatcaaagccagattttatactgctttcctaggtttgttttgccactattgaacggctgtaagagtttagctatatactaccatggtactccaatcatcgtgtacaaaaccatattgtattacatgcaagtgcgagtgagatttaagcgtaaacagattgttgtataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattgtaagcgttaatattttgttaaaattcgcgttaaatttttgttaatcagctcatttttttaccaatangccgaaatcggcaaaatccctttataatcaaaagaatagaccgagatagggttgagtgttgttcccagttg

SEQ ID NO: 65159 - DNA, 523 bp, Zea mays
  misc_feature: Ceres CLONE 1535765
  misc_feature: Encodes the peptide sequence at SEQ ID NO. 65160
  misc_feature (208)..(208): n is a, c, t, g, unknown, or other
  misc_feature (236)..(236): n is a, c, t, g, unknown, or other
  misc_feature (241)..(241): n is a, c, t, g, unknown, or other
ctccccgcggtggcggccgctctagaactagtggatcccccgggctgcaggaattcgtctcacccctagaaaaagtcagccagccagccagccatggagacggcctccttcctctcagtggcgctggccctggcggccctcgtccccgtctcgctgctccttgtgaacctgctcctctactgcaaactgccccccggggccgcgggcnggcgtccctggtgggtaacctgttcgantgcanccccgtgcggttcccggtgtttctcccagaaatggggcccccgtacgggccattttgaagggtggtgggcattcccccccggggggggtcccccctcgaacttggccaagagggtctataaccccaaacaaaatttttccaaaccctttggggggcccccccccccaaaaattttttccccggggggggggggggaagcccttttttttgggggggaaaaataagggccccccccccaaaaattaatgggggggggcgccgaaaattttttctcccccccct

SEQ ID NO: 65160 - protein, 123 aa, Zea mays
  misc_feature: Ceres CLONE 1535765
  misc_feature (39)..(39): Xaa is any aa, unknown, or other
  misc_feature (48)..(48): Xaa is any aa, unknown, or other
  misc_feature (50)..(50): Xaa is any aa, unknown, or other
METASFLSVALALAALVPVSLLLVNLLLYCKLPPGAAGXRPWWVTCSXAXPCGSRCFSQKWGPRTGHFEGWWAFPPGGGPPSNLAKRVYNPKQNFSKPFGGPPPPKIFSPGGGGEALFFGGEK

SEQ ID NO: 65161 - DNA, 877 bp, Zea mays
  misc_feature: Ceres CLONE 1535766
  misc_feature (1)..(1): n is a, c, t, g, unknown, or other
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
nggggcgggggaggccgtgnactacctgtccccgtcgaggnncaactatatggggcgtccgtgggggcggccgctctagaactagtggatcccccgggctgcaggaagtcgtctcacccctagaaaaatccaagctcaaagcaagcagatctaagctccaggcagcgtcgcgacagagtgagctagtgagtagcacgacaacaacaatggctctcctggaaggccgcgaaaccaagcggatttgcggcgcagggcaaggagcccgcgccccagctcagccgagacggggactaagccttcagccgcgaatagcggcggcgtttagaaggttgaacaaaagcccccgggaaaaccaaaaggaaggtgtaaaaacagcaaacaggggggcgggggggcaaaaaatggccgttaaggtagcgggggggaggggaaaatggaagccttccttggctaggaggtgaaattccagggtggtgcccaacacccccccaggcccgtcccttttgcgggggaaccttccccagggtgcacctcgtgaggtgggtcgctcccccctacttgggttgttgaaaatatgccgctaaatgagagcttccttctccatatcacaaaccccacgcgtttcggtgccggggtgtaagtggagagaagacgcattagtgacgtttcttatggggcccccaatttttggccacccgtagtgggataggcccgtatatagaagtagcactgtaacagaagaggaccgggatatttataaaagcggcgcgggggtcgggtaacaacagtgtttgtttattctccgcgcggggttgtgtggcgcgccgggagccacgcagccgccgtctttggagcggttcgggagtagactagagcc

SEQ ID NO: 65162 - DNA, 654 bp, Zea mays
  misc_feature: Ceres CLONE 1535767
  misc_feature: Encodes the peptide sequence at SEQ ID NO. 65163
  misc_feature (409)..(409): n is a, c, t, g, unknown, or other
tcaccgcggtggcggccgctctagaactagtggatcccccgggctgcaggaattcgtctcacccctagaaaaagtgtctgtgtgtgtgagagagagaggagagccggccatgtccttttggctgtttggtttatttttgagttcatgcggtctttatttatttccatgtacccagtacccaccttgtaccatgcatgttccttatgatacactcacctctttttgtttgcaaactgtgttacgcatgctgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttccccanctggcgtaatagcgagaggcccgcaccgatcgcccttcccacagttgcgcagcctgaatggcgatggaaattggtagcgttaatattttgttaaaattcgcgttaaatttttgttaatcagctcatttttttaaccattgaggcgaatcggcaaaatcccttataatcaaaagatagaccgagataggttgagtgttgttccagttttgaacagagtcactattaaagacgtggactccacgtca

SEQ ID NO: 65163 - protein, 102 aa, Zea mays
  misc_feature: Ceres CLONE 1535767
  misc_feature: SWISSPROT Homolog: EC 3.2.1.23 Beta-galactosidase
  misc_feature (72)..(72): Xaa is any aa, unknown, or other
MFLMIHSPLFVCKLCYACCKKKKKNETLEVPNSPYSESYYARSLAVVLQRRDWENPGVTQLNRLAAHPPFPXWRNSERPAPIALPTVAQPEWRWKLVALIFC

SEQ ID NO: 65164 - DNA, 734 bp, Zea mays
  misc_feature: Ceres CLONE 1535768
  misc_feature: Encodes the peptide sequence at SEQ ID NO. 65165
aagctggagctccccgcggtggcggccgctctagaactagtggatcccccgggctgcaggaattcgtctcacccctagaaaaagagggtcctgcgttcccttcttctgctgcggcggcggaggctctttcagttccatccatcttctccctcgtggctctccttcctctctcccgtagtcccgccgaccccccgcgccggccaaggaaatcaagcgaaaacgccagattttgattgttccacatcttctttcatctctgaggggtttcccgtcttcctcgcctgctctaatggctaaagaacaggatggatcccccaaggtgcgccacccagaattccaaaggatacgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccagctcaagtacagtgagtataccccttgccaagatccaaggaaagctaggaagttcccaaagaaaatgatgcagtacagggagcggcactgcccaaagaaagaagacatgctccggtgcttgatccctgcgcctccaaactatagcaaccccttccagtggccaaaag

SEQ ID NO: 65165 - protein, 148 aa, Zea mays
  misc_feature: Ceres CLONE 1535768
MAKEQDGSPKVRHPEFQRIRVTLTIGVIGLCVTAYILGAWQGTSNGISSPLISTRTQCKDPVRSSGARLDFQAHHQVGFNESALAVEKFPPCQLKYSEYTPCQDPRKARKFPKKMMQYRERHCPKKEDMLRCLIPAPPNYSNPFQWPK

SEQ ID NO: 65166 - DNA, 655 bp, Zea mays
  misc_feature: Ceres CLONE 1535769
  misc_feature (201)..(201): n is a, c, t, g, unknown, or other
tcttcactagtggatccccccgggctgcaggtattcgtctcacccctagaaaaaaaaagttgcagaataaggagccatgctcccttgtgtaatttcataagactacaaccctattagggcttgtttggttgtgtctgtatcgaaggggattgaaggtgattaatttttcttctattctaatagagggggttttaatctccntccatactcttcaatccacacctaaccgaacaagcccttaatatgatatcttacattgccgtatctgtgtaatatcatgaataaaattttgctattatgtattctaaagtttatgaactaccttacttggcacacttctcagcttaaaggaaaaaaaaaaccagacccttcagtacccccctcgccctaaagtgagtcgaattacccccgcctccttggccgtcgttttcaacctcctgaatgggaaaacccttgggttacccaacttaaatcccctttgaacaaatccccctttttcccagttggggtttataaccaaaaaagcccccccccgattccccttttccaaaaatttcccccccctctaatagggcataggaaaatttttaacctttaatttttttgttataaattcccgcgcaaattttttttggaaaccctctctcttgttttt

SEQ ID NO: 65167 - DNA, 758 bp, Zea mays
  misc_feature: Ceres CLONE 1535770
  misc_feature: Encodes the peptide sequence at SEQ ID NO. 65168
  misc_feature (399)..(399): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (422)..(422): n is a, c, t, g, unknown, or other
  misc_feature (426)..(426): n is a, c, t, g, unknown, or other
  misc_feature (429)..(429): n is a, c, t, g, unknown, or other
  misc_feature (430)..(430): n is a, c, t, g, unknown, or other
  misc_feature (548)..(548): n is a, c, t, g, unknown, or other
  misc_feature (549)..(549): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (659)..(659): n is a, c, t, g, unknown, or other
  misc_feature (743)..(743): n is a, c, t, g, unknown, or other
aaagctggagctccccgcggtggcggccgctctagaactagtggatcccccgggctgcaggaattcgtctcacccctagaaaaaactctctctctctctctctctctgaactggcatttgggccatcgatcactggtaacgcgcccgctcactcactcgcatcacactccgtaactccccgacccccgcgcgcatgggcgatccccgggcccgcacgtccaccgtcgccgccggcgagctgcggccgccggagccgccgctcgacccgctcgagttcctctcccgctcctggagcgcctcggggcgcgcgttcgcgccaccgccgccgacgccgccgccggccgcgcacgcgctcgcggccagccccatcgcggaggacccctcgtgcgagtttgaacngggggtnnncccccccccgcccncccnccnncctcccggggagcctccctttcttcctttccgccctcccgcggggccccccgtttccgcgggcttcccttccgttgggagggggggatcccccttggggcggggggtcccccccggtnnaatttggggnnnccccccttttccccctcggggggggggggtgtcttccccagcgggggggggccccccccttccagcgggggggggggggggtttcttcttttcccccnaaaaacccccccgcgcggggtttttctccccggggggggaaatttaatgttagggcccccccccacaaaatttttcttcgctgnaaaaagagggggggt

SEQ ID NO: 65168 - protein, 170 aa, Zea mays
  misc_feature: Ceres CLONE 1535770
  misc_feature (69)..(69): Xaa is any aa, unknown, or other
  misc_feature (72)..(72): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (119)..(119): Xaa is any aa, unknown, or other
  misc_feature (123)..(123): Xaa is any aa, unknown, or other
  misc_feature (156)..(156): Xaa is any aa, unknown, or other
MGDPRARTSTVAAGELRPPEPPLDPLEFLSRSWSASGRAFAPPPPTPPPAAHALAASPIAEDPSCEFEXGVXPPPPXXXPPGEPPFLPFRPPAGPPVSAGFPSVGRGGSPLGRGVPPGXIWGXPPFPPRGGGVSSPAGGGPPLPAGGGGGFFFSPXKPPRAGFFSPGGEI

SEQ ID NO: 65169 - DNA, 916 bp, Zea mays
  misc_feature: Ceres CLONE 1535771
  misc_feature (5)..(5): n is a, c, t, g, unknown, or other
  misc_feature (16)..(16): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (46)..(46): n is a, c, t, g, unknown, or other
  misc_feature (884)..(884): n is a, c, t, g, unknown, or other
  misc_feature (916)..(916): n is a, c, t, g, unknown, or other
ccccnttggggggggngggttaggtaaannaaannggggggggntnttgtattgtggctccccgcggtggcggccgctctagaatagtggatcccccgggctgcaggaattcgtctcacccctagaaaaatcaggcatccaagcttaaagcaagcagatctaagctccaggtagcgtcgtgacagagtgagtgagtagcacgacaaccacaatggcttccctgaacgccgcgaaccctagcgtagttgctgcgcagggcaaggagccggcgcccaccctctccgtagacggcctataatctctccgcccgccaacactggccgcttttcttaaggttgtagctttaggccgggggaatttcaacctggattgtggatatatccccaccccggtccgtcttcctgccccaacacgtgccgtttacctgccccccctctaagtgtggggggggcgttgccttgttcgtgtcatcgaatgtgtattgtttccccccgcccatcgcaaccgtcgctcaatgcttttggccttttatccttcccgcgtagagagacgcgcggggggtgcgcccttcctttccgcgggctcgcgggtgggcgcctggcgattgcgtcgcttgcaccggactccttcctgctttcacccaccctcacacccccatgaacgtaggagtacacgcgttgatggtgtgttctgtgctatcaccgcgaactggccaagcgagaaggggcgacatgataatcccagtcgcacgacgccgtagatcgtccgtcttcttttcttgttgttaatacgtcatttatcccttcggcttgcgcgttttgttttttttgtgctgtcgcccacctacggctctacgtttcttctctgttttttttgttggtgtncctcttgtgcctctgtccccttcgtcaacttn

SEQ ID NO: 65170 - DNA, 628 bp, Zea mays
  misc_feature: Ceres CLONE 1535772
  misc_feature: Translation starting site: 171
  misc_feature: Pfam Name: Hpt Pfam Description: Hpt domain
  misc_feature (299)..(299): n is a, c, t, g, unknown, or other
  misc_feature (304)..(304): n is a, c, t, g, unknown, or other
  misc_feature (409)..(409): n is a, c, t, g, unknown, or other
ggcggccgctctagaactagtggatcccccgggctgcaggaattcgtctcacccctagaaaaaatccattgctcccaccagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcgaangaagntgtcactttgtttttcaaggactcggcccagctaatatcaaatgctgaacaggctctggaaaaataccccaaagatttcatagatgggatgcatacatgcagcanctaaaaagcagctgttccagcattggtgcttcaaggatgagagtgattgcctgtcatcccggatttctgcggacgggaaatgttaaaggttatttaaatctttcccaaaagttaaaaggaaccccgggccccctagcaaaaacaaaaggcctttttcccgttttaaaaaaaaggggccctgttggaacccccacacccccgggaattaaaaaaaaagga

SEQ ID NO: 65171 - DNA, 675 bp, Zea mays
  misc_feature: Ceres CLONE 1535774
  misc_feature: Encodes the peptide sequence at SEQ ID NO. 65172
ggcggccgctctagaactagtggatcccccgggctgcaggaattcgtctcacccctagaaaaaaaaaccagcactactcatccgtcgccccacggaagtttcggcggcgccggcgtgctcgtgatctcgaccaaggcgtgcctccgctccggtcacccgtcgctccacgcaaccatggtaagcgagcctcttctcgtctggttatggctcgcaagcggacgtaggtgcaagcacggtagcggtggattcggatctggctgcaagcacggtagcgctggattcgattgtttttttgtttagagatgggttaagagcgtaggtttggctgttgactagggctactgttgttttggctggttgcccgtgctggattgcatctgataaattgcaatttgacatcacctctttaatacaaaagaaagaattgctttttacgcaaaaaaaaaaaaaaaaaacgagacgctcgaggtacccaattcgccctatagtgagtcgtattacgcgcgctcactggccgtcgttttacaacgtcgtgactgggaaaaacccgggcgtttcccaactttaatcgccttgcagcacatcccccctttcgcccgctggcgtaaatagccaaagaggccccgcaccgaatcggccctttccccaacagttgccccaaccctgaaatggcag

SEQ ID NO: 65172 - protein, 41 aa, Zea mays
  misc_feature: Ceres CLONE 1535774
MVSEPLLVWLWLASGRRCKHGSGGFGSGCKHGSAGFDCFFV

SEQ ID NO: 65173 - DNA, 625 bp, Zea mays
  misc_feature: Ceres CLONE 1535775
  misc_feature (180)..(180): n is a, c, t, g, unknown, or other
  misc_feature (185)..(185): n is a, c, t, g, unknown, or other
  misc_feature (186)..(186): n is a, c, t, g, unknown, or other
  misc_feature (216)..(216): n is a, c, t, g, unknown, or other
  misc_feature (219)..(219): n is a, c, t, g, unknown, or other
  misc_feature (405)..(405): n is a, c, t, g, unknown, or other
ctcaccgcggtggcggccgctctagaactagtggatcccccgggctgcaggaattcgtctcacccctagaaaaatttccaagggctctacacgaagttaggcggccaagtgttcgcaaccaacccctcttcctcgcccactgaaaggttcagaagctcccgttttagcatagcgaccganacaanngagtggggggggcggaaagcttttggcccntgncaggatgaagtttatgagactcggcaaccgggcggacaccttctttcgcgccgccgactcccgtgagtctgtctgccccgaagtggcaccgaactggcaaatccccttgaaataatggcttttaccatttccaaaaagttccccctggcccccaaaatggatggctcctgaaaacccttttgcccnaaaccccgggaaatttttctttaaagttcccgggggttccccgggggggcccaaaggggttttaaagccctgcccccaaatttttgttcgggttcccccttccaggggggacgcgccccaacttggcccccttgggggggggggggggggcccccccccttttttttgaaggccccccaaagggggaaacccctggggcaaaaattaagggttttttccc

SEQ ID NO: 65174 - DNA, 734 bp, Zea mays
  misc_feature: Ceres CLONE 1535778
  misc_feature: Encodes the peptide sequence at SEQ ID NO. 65175
ctggagctccccgcggtggcggccgctctagaactagtggatcccccgggctgcaggaattcgtctcacccctagaaaaagcaacagcaatggagcacacgacgacccaacacacggcagccgccggggagcaggagagcccccccacggcgttggccttgagaagcctcgccgactacaccgtcggggccatccccaccctattctatgtccccgacttcatctcccactccgagcaatcacagctcctccaccatatttaccaggcaccggcgcccaagtggaaaaccctcaagaaccggaggctacaaaactggggtactctttgtcttcttcgcacttggtggttttggcttggagattgctttagcttcctcctttccttgacacggtgtcggattgagcaggaggagtggtgcatgagaaggggctcctgccgcaggcctgtgagtgtgctcataaaagcttgcaaattttagcttggttttgtgaatcaaactgaagatcaggcatagcgttgcataactgaagtttggcccgtaatctaattttggttcccatgtgcttggtttcaaatgtcttatcttgtgaaaattcaagttcaaattcaaagagtagtaggtatgcttgaagaataaattttcctacaatgtgattgccagtagaactgtgggaagctcaccaagtagttggcacttttactggataggataactaacactattgagttgctg

SEQ ID NO: 65175 - protein, 129 aa, Zea mays
  misc_feature: Ceres CLONE 1535778
MEHTTTQHTAAAGEQESPPTALALRSLADYTVGAIPTLFYVPDFISHSEQSQLLHHIYQAPAPKWKTLKNRRLQNWGTLCLLRTWWFWLGDCFSFLLSLTRCRIEQEEWCMRRGSCRRPVSVLIKACKF

SEQ ID NO: 65176 - DNA, 624 bp, Zea mays
  misc_feature: Ceres CLONE 1535780
tggagctccccgcggtggcggccgctctagaactagtggatcccccgggctgcaggaattcgtctcacccctagaaaaaaaaaaaaaaaaaaacacagtcccactcctctctctctcgcgctctctctctttcatcgccaccaccgcccgtgaatcggcacgcgtgcttcctgtcgatttttgagctgtgactgtgagcgccatggccgtggaagctgtgtccggaaatggcaccaaagcatgggccccggcccgggcaaaggaggtgagcaccaagcaggcgttttttccgggaggagaaagcactccttgggcagatttcaggagaaccgacggtaagggcttttgccaaatttcccccaaagggtaagggggggccctctgggaggggaaatttttttccaaacgggaaaccccggggggggggggaaaaaaaaaaaaaaaaaacaaaaagcccccggggggcccccatttcccccccaaggggggggggtattatcccccgcccccccggggggggttttttttaaaaacggggggggggggggaaaaacaccgggggggccccccacaaaataaaccgcgctgtgggggaaaaaaccccccttttttttgggggggggg

SEQ ID NO: 65177 - DNA, 666 bp, Zea mays
  misc_feature: Ceres CLONE 1535784
  misc_feature: Encodes the peptide sequence at SEQ ID NO. 65178
  misc_feature (366)..(366): n is a, c, t, g, unknown, or other
ggtgctccccgcggtggcggccgctctagaactagtggatcccccgggctgcaggaattcgtctcacccctagaaaaagcagactagctcgtaagacaagcaagcacacgcgtctcgtagtactgggggagaacgacgaagcaaacaccaccaagataatgacgtccaagggaacgaggccgtggagcaggctctccgaggccgagaccgccgtgaaccgcgccgtcgccgggagccgcgtggggagatacttcaagctggacgcgcgcaagagctccttcaccaaggagctccgcgccggcgccgccacgtttctcaccatggcctacatcatctccgtccacgcccgcgtcctgaccgactccnggcggccgtgcacggtgcgggactgcaaccccgtgccaccaactcgaccgtggcggccacgccgcctggggcggaatgcaccgtcgcccggggctattacccggggtaccaacagtgccttgcgcgcacaagagcgaactggtcctggcacgggcgttggcgccatggccgcttcctcgccattgggctttttcgcaacttccggttgggctgcccccgggattgggggcaacggcttactcgctacaaattggtcggttcccccgggtccggccccatcgctacagcacggcctgccgt

SEQ ID NO: 65178 - protein, 169 aa, Zea mays
  misc_feature: Ceres CLONE 1535784
  misc_feature (70)..(70): Xaa is any aa, unknown, or other
MTSKGTRPWSRLSEAETAVNRAVAGSRVGRYFKLDARKSSFTKELRAGAATFLTMAYIISVHARVLTDSXRPCTVRDCNPVPPTRPWRPRRLGRNAPSPGAITRGTNSALRAQERTGPGTGVGAMAASSPLGFFATSGWAAPGIGGNGLLATNWSVPPGPAPSLQHGLP

SEQ ID NO: 65179 - DNA, 694 bp, Zea mays
  misc_feature: Ceres CLONE 1535788
  misc_feature: Encodes the peptide sequence at SEQ ID NO. 65180
caaagctggagctccccgcggtggcggccgctctagaactagtggatcccccgggctgcaggaattcgtctcacccctagaaaaagttccgctcgctcgcccgccacggagagacgacactctacgtgtgtgcctgcgagagcgagagcgcaccagaagagcagacggcttcctctgcggcctgctggtcgcttctcttctctccagtccatggcaaaggacggtacatggcggggggcgggggcggccgggacctgccgtcgacgcctacgtgggcggtggcactggtgtgagccgtcatcgtgctcgtctccgtctccgtggagcatggcctccacaagctcggccactggttccgtacgcggcataagaaggccatgcgaggaggccctggagaaaatcaaagcagagttgatgctgatgggcttcatctcgctgctcctcgccgtggggcagacgcccatctccaagatatgcatcccggccaatgatggcagcatcatgctgccgtgcaagccgacgaaaggcgactccgccgacgccgacgacgacaagagcgacggccgccggagactgctctggtacccgccgtacactggatacgatgagcccgggtaccactgccgttttctcgccggctcagctgcggaagacgactactgcagtgaccaaaggcaggtgtgcctcatctcct

SEQ ID NO: 65180 - protein, 122 aa, Zea mays
  misc_feature: Ceres CLONE 1535788
MASTSSATGSVRGIRRPCEEALEKIKAELMLMGFISLLLAVGQTPISKICIPANDGSIMLPCKPTKGDSADADDDKSDGRRRLLWYPPYTGYDEPGYHCRFLAGSAAEDDYCSDQRQVCLIS

SEQ ID NO: 65181 - DNA, 661 bp, Zea mays
  misc_feature: Ceres CLONE 1535792
  misc_feature: Translation starting site: 141
  misc_feature: SWISSPROT Homolog: EC 3.2.1.23 Beta-galactosidase
  misc_feature (283)..(283): n is a, c, t, g, unknown, or other
  misc_feature (291)..(291): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
ctccccgcggtggcggccgctctagaactagtggatcccccgggctgcaggaattcgtctcacccctagaaaaattcgtttcgtttcggggttttttcttcttcatttcctctgccttttctccacttccgattttacaaatggtcaatgtgtatgaagtaattaatacgaatgttcattcgtggttggcttgcattgtacgccccgtgatattggggcatgcatgggtgcaaattgcaaagttgatgtacctatataggttttgtttgaatttaacatctcnagttaganctcnnnnnnnnnnnnnnnnnnnnaaaaaaaaattaaaaaaaaaaaaaaaaacgagacgctcgaggtacccaattcgccctatagtgagtcgtattacgcgcgctcattggccgcccttttacaacgtcttgattggaaaaaccctggcgttacccaacttaatcgccttgcagcacatcccccctttcgccagctggcgtaataccgaggagccccgcaccgatcgcccttcccaacagttgcgcaccctgaatggcaaatgaaatttgtaaccttaaaatttggtaaaaatcgcgttaaatttttgtaaatccgctcattttttaaccaataggccgaaatcggcaaaatcccttataaatcaaaagaa

SEQ ID NO: 65182 - DNA, 687 bp, Zea mays
  misc_feature: Ceres CLONE 1535799
tggcggccgctctagaactagtggatcccccgggctgcaggaattcgtctcacccctagaaaaagcaccgcagagagaggacagaggagcgagccatcatccccccccgagccgtgccaaccaagagccatccacccaccaccaccaccccggccgcttccttgtccctgcccctccgttggtctcctttgcccatctcatcctctctctctctctccctctctctctctctggcggtcggcgtggctccgggggcgcgaagcgcgggctcggcggggcgactcgccggcggcgacctgcaggtttgggtatgagaggggtcacccacgcggcgcccaccacaagcgcccccccccccccgcggacgcctcatggacggcctcctcatcttcgtcttctacttcttgctggccacccgggccggccgcgaccactcttaaatcccccccctctaattgtttacccgcccccggcacgcaattgtctcgggaccccctccccaaaaaactcgaatttggggggcctaaccaccccagccctccaccggggatcagggatccaagggacccccccccccgcaaagtggttctccccccccgggaggttttttttcccccccctttggtggggggaaaaaacccttctcccccccccctttaataaaatatggccaatggggggagaggg

SEQ ID NO: 65183 - DNA, 697 bp, Zea mays
  misc_feature: Ceres CLONE 1535801
  misc_feature: Encodes the peptide sequence at SEQ ID NO. 65184
  misc_feature (571)..(571): n is a, c, t, g, unknown, or other
aaagctggagctcaccgcggtggcggccgctctagaactagtggatcccccgggctgcaggaattcgtctcacccctagaaaaagttcgtctccctcctcgcgttcctctcttccgctcgccgccgccgcatccgtcaccttcacactgcgctccctccctccctccctgtctgcggcgactgggtgttctaccaccgccctcgctttcgcgggcgaagagcgcccaccagtttccttggatctttgagctttggaagatgccgaggtggacagagaattctgcttccaccaaatcagctgaattggtgaaacaacaagaccgtttggagtttgacgatcctgatgaggtagacgaagaggaagaagttgagtatgaggaagttgaggaggaggtcgagtatgaagagacagaggacgagtatggacagactgaagctgtacgccaagttgatgctaaacatgacagtaaaatggtggatgctgatgtctcttctgatgatctcaaaaactctgcgagtctgttggggaagtagtcgaagtgcgaatgccaagaaagagtgggtaggctgnatgcctttgtcaatttcaaaactaaagagctgggcttcaaggcccatccgaaggtggaaccataaaaatttaaagggaagaaaataaaaattttcttctcccagggctaaaaacgggcttttattg

SEQ ID NO: 65184 - protein, 91 aa, Zea mays
  misc_feature: Ceres CLONE 1535801
MPRWTENSASTKSAELVKQQDRLEFDDPDEVDEEEEVEYEEVEEEVEYEETEDEYGQTEAVRQVDAKHDSKMVDADVSSDDLKNSASLLGK

SEQ ID NO: 65185 - DNA, 650 bp, Zea mays
  misc_feature: Ceres CLONE 1535806
  misc_feature: SWISSPROT Homolog: EC 3.2.1.23 Beta-galactosidase
  misc_feature (386)..(386): n is a, c, t, g, unknown, or other
tggagctccccgcggtggcggccgctctagaactagtggatcccccgggctgcaggaattcgtctcacccctagaaaacgaggtgtacggcggcgtgacgatgaacaacacgctgtgcctcggcgtgttcctggcgctcatctacttcaggaacctgacgtgggacttctcgtcggaggtgctcatcatcctgctggtctgcgtcgtcatggccctcttcaccagcttccggaccacgttcccgctctggacctgcctcgtcgcctacatgctctacccgctctcgctgatcatcgtctacatcctcgactatgtcttcggctggtcatagacctgattggctcaagtgaacacctggttttcagacagcccgccggtgtttctgnttgacctccttgtatttttaactatatgtccagacttttttctgaaaaaaaaaaaaaaaacgagacgctcgaaggacccaattcgccttatagtgagtcgtattacgcgcgctcactggccgtcgttttacaacgtcgtgactgggaaaaaccctggcgttacccactttattcgcctgcagcacatcccccttttcgcagctggcgttataagcgaggggccccgcaccgatcgcccttcccaacagttgcgcagcctggaag

SEQ ID NO: 65186 - DNA, 621 bp, Zea mays
  misc_feature: Ceres CLONE 1535807
  misc_feature: Encodes the peptide sequence at SEQ ID NO. 65187
ccgctctagaactagtggatcccccgggctgcaggaattcgtctcacccctagaaaaaaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtatctgatctactcatttttcttttcttccccttttggggacataggtaggtctagttaagatctgccccccccactctttgaattttagctaaaaaccaggcgaatttagtcttcttcctttacaaaaaaaaaaaaaaaaaccgagacccctcgagggaccccatttcccccttatagtggggccgttatttacccgcccctcccctgggcccgtccgttttttccaaccgtccttgaaccgggggaaaaacccctgggggggtttacccaaaattttaattcgcccttttcaacgaacat

SEQ ID NO: 65187 - protein, 45 aa, Zea mays
  misc_feature: Ceres CLONE 1535807
RSRTSGSPGLQEFVSPLEKNPNTTIPFNKRTALHGSQKTQSTQSP

SEQ ID NO: 65188 - DNA, 629 bp, Zea mays
  misc_feature: Ceres CLONE 1535808
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (441)..(441): n is a, c, t, g, unknown, or other
  misc_feature (547)..(547): n is a, c, t, g, unknown, or other
  misc_feature (590)..(590): n is a, c, t, g, unknown, or other
ggagctccccgcggtggcggccgctctagaactagtggatcccccgggctgcaggaattcgtctcacccctagaaaactatgtaccagaaagctatgcagctcagaaataaggtttcctcggagccatccattctaaatgaggctaaggcatcagcagctgttctggctagtggctaaggcatcagcagctgttctaccatcttatctaatgagatggtaagcagtatgtgaataaagctggtgttgcttaccttcagtttgtgaatgccattatgtactgtaataaaaaactctgtattgtactccctagcattatcattatgcttttgtcttctttgtatcacaatgggattgttagtgatgaaaattgcaccaggggtgcctgtgttctcaacaaannnnnnnnnnnnnnnnnnnnnnnnnnnnnnnnnnnnnnngcnctttttcctggcaaaccctgcacgcctccgcaccgcaaccgcgtcgtcggcgtgcgcgatcccgaggagcccagccatcagcttccttgggcggggtgtgtatgcncgtacgtcggccgtgaccagatccgctgacccaaggcattggngaaccggccctcctcggcgcggaacccttcgcggacctc

SEQ ID NO: 65189 - DNA, 717 bp, Zea mays
  misc_feature: Ceres CLONE 1535815
  misc_feature: Encodes the peptide sequence at SEQ ID NO. 65190
  misc_feature (265)..(265): n is a, c, t, g, unknown, or other
  misc_feature (284)..(284): n is a, c, t, g, unknown, or other
caaagctggagctcaccgcggtggcggccgctctagaactagtggatcccccgggctgcaggaattcgtctcacccctagaaaaatgcatcccgattactatctgccgagccgaccagcggcaccagaacccacaaggttcactcatggcgcccacgtccatgctcccgttcgcgccctccaatacgtcgctgccctattcctcccgcgccacaactgccgccgcgttcgctcctcgtgggctccaccacgccgcggcggaaagnagacgcggcggcggcaacnggctcgcgtgcgctgcgcctcggcgccgccgcggagggggtcttgtggtcatggcgtccgacgactactacgcgacgctgggcgtgccgcgcgccgccagtaacagagacatcaaggccgcgtaccggaagctcgcgcgccagtatcatcctgatgtcaataaggagcctggagcgactgagaagtttaaagagatgagtgcagcatatgacgtgctgtcagatgaagagaggatggcgttgtaagaccaatatggagaagctggtgaaaagagtgcacctggaagcatcggaggagcttaacaaccaatccatttgatctgcatgagacatattttagactagcataggtggttgatactgctgcaccagagatcgtgtaggaaagcaagataagactgctatacggtgagaagaatcagatatgatgtgat

SEQ ID NO: 65190 - protein, 127 aa, Zea mays
  misc_feature: Ceres CLONE 1535815
  misc_feature (68)..(128): Pfam Name: DnaJ Pfam Description: DnaJ domain
  misc_feature (40)..(40): Xaa is any aa, unknown, or other
  misc_feature (47)..(47): Xaa is any aa, unknown, or other
MAPTSMLPFAPSNTSLPYSSRATTAAAFAPRGLHHAAAEXRRGGGNXLACAAPRRRRGGGLVVMASDDYYATLGVPRAASNRDIKAAYRKLARQYHPDVNKEPGATEKFKEMSAAYDVLSDEERMAL

SEQ ID NO: 65191 - DNA, 843 bp, Zea mays
  misc_feature: Ceres CLONE 1535816
  misc_feature (1)..(1): n is a, c, t, g, unknown, or other
  misc_feature (12)..(12): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ngggggggcgtntccctctaccccnntnnnnnnnnnnnagatatannnnnnncaccaaagaaccccacctcgctcccggccgctctataatattggatcccccgggctgcaggaagtcgtctcacccctagaaaaaccaaccacaggtcagtcgggactacccgctgtatttaagcatatctataggcggaggagactaaacttacgaggattcccctactaacggcgagcgagccggtagcaacccgtcttgagaaatcgggcgccctccccgccccaattgtagtctggagaggcgtcctcctcgacggaccgggccccagttctcctggaagggactccccccgagggggagagccccttcccccccgaaatctgaaccacacacaaggcccccttaaggaaggcggtttttttttttcccccccccccccggggggggggagggggggttttttttaatttcttaatacaaaacccccccccgggcaaaagaatgtagaggcttctcttttccgccccgtggacgggggggcggcggctacacctccccccccctgtcgggctcggcccttatttaccaccctcccctcgtccccgaggataataccccccctttctcctcccctgggcgtttcgtcccccgccccgcgccccggcacgtatcccccacggtttcgcccgccccgcgacactgacatttcccggtggtacaggaccgctttcccgcggttctagcccccctttatgtggatttcgtcgagccgtcacccgcgattgtcttcgcccgacccgcctccctcggctcccatctctgtcggcgctgcctcgcggattcaaccg

SEQ ID NO: 65192 - DNA, 673 bp, Zea mays
  misc_feature: Ceres CLONE 1535822
  misc_feature: Encodes the peptide sequence at SEQ ID NO. 65193
ccccgcggtggcggccgctctagaactagtggatcccccgggctgcaggaattcgtctcacccctagaaaaagcatctcaagccaccatcgaccttcaagtctcgccgacgaccccgaggccttcgctgagctcaaggtgaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggccccccccgtgacctttaggtgtccggatgcatgtgatcccacgccccctttcgggggggggggtgatgtaaactattgttcaatttccccccacaattgtgttcattgccaaaaaaaaaaaaaaaaaacgagacgctcgaggtacccatttcccccctataggaggcgtatttcgcgcccctcccctggccgtctttttacaacgtccgggactgggaaaaacccctggcgtttccccaacttaaatcgcccttggaggaacatccccccctttcgccggacttggggtaaaaaaccgaaatagagccccgcccccgattctgcccctttcccaaaaagtttgcgccacccctgtaaaggg

SEQ ID NO: 65193 - protein, 45 aa, Zea mays
  misc_feature: Ceres CLONE 1535822
MFSMFGFFVQAIVTGKGPLENLADHIADPVNNNAWAYATNFVPGK

SEQ ID NO: 65194 - DNA, 802 bp, Zea mays
  misc_feature: Ceres CLONE 1535823
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
tcttctttttgttctttttttctttttttcgggtcggacaccnnnnctcnnaannnnnttatttggtgctccccgcggtggcggccgctctagaactagtggatcccccgggctgcaggaattcgtctcacccctagaaaaatacctttctcggccttttggctaagatcatgtgtagtatctgttcttatcagtttaatatctgatatgtggactatgtgtccacttcgatattaaatttattttttgtgggggagggctcgctacatgggcttgccacttaaacccctcgaacgtcgctcgggccgttgcacttatgggctaagccagggcgcgcccccaaaaaaatgaaaaaaaaaaaaaaaaatcgaggcccctcgaaggaaccccaatttccgccccctataagtaaagtcgcattttaccccgcgcgctcacatgtggccccccccttttttacacaaatcttttcgtgtatttggggaaaaaaaccccggtgggttttttcccccaaaattttaaacccggcgttgtttggaaaaaaatatagcccccccttttttcccccaggtttgtgggggggtttatatatctcaaaaaaaaggggcccccccccccctaattacccccctctctttccaaaaaaaaatgtttccctcaccctcccaaaacccgccgccacttacccaaaaaattgtggggggggcgtgtttttatttatctggtggcaaaaataataggcgcggtcaaaaaaatttttttttgaaaaaaaagccccgcctttttttttttataaacaaaa

SEQ ID NO: 65195 - DNA, 660 bp, Zea mays
  misc_feature: Ceres CLONE 1535824
tggagctccccgcggtggcggccgctctagaactagtggatcccccgggctgcaggaattcgtctcacccctagaaaaatgttagcgtttgctgcagtgctcttctatggagctccgaccccggactggaattatctcgtaggcccttccaggtgctactctacttcagctgctgtccctgtgcaactcgtccgggcaagttttgtggctcgctcgtggttttgtagctaggttaagcgagtgaagtacactcggtagcgcagtatttcctggcgagatgtttattcctctgttaatggacctaccttactatctaaaaaaaaaaaaaaaaacaagacgctcgaggtacccaattcgccctatagtgagtcgtattacgcgcgctcactggccgtctttttacaacgtccccactggaaaacccctggcgttacccacctaaatcgcctttgcagcacatccccctttcgccagctggcttaataaccaaagaggcccgcaccaatccgcctttcccaaagttgccccaaccctgattggcaaatggaaatttgaaacccttaaaattttttgttaaaaattccccttaaaattttttgttaaaccacctcattttttttaaaccaaaaggggcaaaatccggcaaaatccctttattag

SEQ ID NO: 65196 - DNA, 857 bp, Zea mays
  misc_feature: Ceres CLONE 1535825
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (65)..(65): n is a, c, t, g, unknown, or other
ttttttgtgtgtttgggtggggggctggaanntntttgtttggtgcccgcccctaaaaaatcacnccgtggcggccgctctagaactagtggatcccccgggctgcaggaatgcgtctcacccctagaaaaatcaggcatccaagaagctcaaagcaagcagatctaagctccaggcagcgtcgcgacagagtgagtgagtagcacgacaacaacaatggcttccctgaaggccgcgaagcccagcggagtttgcggcgcagggcaaggagccggcgcccaagctcagcgagacggcgacgaagccgtcagccgcgaagaaccgcggcgttaagaaggctgagcagaagccccgggaaaccaaaaggaaggtgaagagcagcaaaccggcgggcggcggccaaaaaagtgacctaccaccccccccccccactgtaatggaggctttccttgcccttgagtgaaatccattggccacgcccatggaaatcttaagtgctttcccttttcttgggtaacctttccccgggtgaacccggacgtgggagcgcgtcccccccccctggtgtggaatgaatcgcccacaattgaaattcactaacaaaattaaagaacccttaggcatggtggaactggtggctttcttatggagagaggccgaatcacactttggtgtatctcctccgccgggtttctcccataattccgccacccaataaagtgaggtcgtttactctcatccgggctcccgcaattgtgtgctcgttctaattttacaaaacacgtcgtcattacttggaaaaaaaacccaatggggcgctctgccccccacgcctttaaaacccacccctgcccccc

SEQ ID NO: 65197 - DNA, 795 bp, Zea mays
  misc_feature: Ceres CLONE 1535828
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (423)..(423): n is a, c, t, g, unknown, or other
  misc_feature (548)..(548): n is a, c, t, g, unknown, or other
  misc_feature (633)..(633): n is a, c, t, g, unknown, or other
  misc_feature (680)..(680): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
nnnnnaaaannnnnnnnnnntttgggcgggactncctctttttnnnnaaaaaattggggatccccgcggtggcggccgctctagaactagtggatcccccgggctgcaggaattcgtctcacccctagaaaaagtaaattgcaaaggtgtatgcgtatctggttttcaattggatccatctcatcttctctacatagttttgtttgtgtggattttgtagcatatgctctttttgcagtaaaaaaaatgtggcagttgtttggctggtgactgcctattatgagcctgcggcaataaatgttcagcaaattgcggagtaaacattgagagctcctgaacctggagagaaagtgtgtattgtatatttgcgttgttcctgtaaagcatgtttagtcaaactcgaatattgtctataatacgtantaaatctcaggcggaaacatgggcgagctttcttggtttgggtggtccactggattccgctggtccattaaactcttagaaaaaaaaacaaatccttcccaatgtcccccatttcccccctattnctgaattattaaatcaccccccccctctctggcccggttgtttttaaaactctcacggaacggggaaaaaccccggggcccttcnccccccctttatattgaatttagaagcaaaaccccccactttatagnaatttctcccattaaaaaactaaataaaggcccnnnnnccaaaattcccacccttccaccacacaatagacccccacccccaagaaaggcccaaataggcaaaactgcacacgcc

SEQ ID NO: 65198 - DNA, 665 bp, Zea mays
  misc_feature: Ceres CLONE 1535829
  misc_feature: SWISSPROT Homolog: EC 3.2.1.23 Beta-galactosidase
acccgcggtggcggccgctctagaactagtggatcccccgggctgcaggaattcgtctcacccctagaaaaaacctggacggggtcgacgagcgatcatcaaggctcgtggcctaggccaatggcccacattgcacttggtgggtgcgttggcttaccatctccccaagtgggagagtggacgtcataatttgtgatagagggggtatgcgttcgcgcggccctgccaaatctaaaaatattaattttggtccttggtgccggttgctgtgcgcatgatgtcgcgcggccccttacaaatcggaaaatattacttttggtccttgggtgcgcaggttgctatgctatgcgtgtgtttcgaaggaaatacttgtaatcgaaattttcataagcgtttacttttggtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattc

SEQ ID NO: 65199 - DNA, 659 bp, Zea mays
  misc_feature: Ceres CLONE 1535836
  misc_feature: Encodes the peptide sequence at SEQ ID NO. 65200
  misc_feature (353)..(353): n is a, c, t, g, unknown, or other
  misc_feature (354)..(354): n is a, c, t, g, unknown, or other
  misc_feature (405)..(405): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (456)..(456): n is a, c, t, g, unknown, or other
  misc_feature (475)..(475): n is a, c, t, g, unknown, or other
ccgctctagaactagtggatcccccgggctgcaggaattcgtctcacccctagaaaaacggctttctgccgaccaagttttcagtccttccccgtgcagttgatttcttctgctagatcaccaagtgggctgcattcatcccctgcgcatgagacaagttctgccgtgctgtagcactccgccatgtaactaatgcagcacgatgcatcgacctgtttgattcgtggctaactgtgccacactttgtctaaggttagtcgttcgaattgaagaactaatcttaggcataaaagttaggtaaaatgtggcaagttaggcagccaactaaacatacaacacgggtggtttagtcnnaaaaaaaaaaaaaaaaaaaaaaaaaaaaaaaaaaaaaaaaaaaaaaaaaanaaaaaaaaaaaaaaaaaaaaaaannnnnnnaaanaannnnnccccccaggnaccccatttccccctttantaattcaaattacccccgctcactggcctaatttttaaaagggggtgacgggaaaaaccccgcctttacccaatttaatgacctggcaccaattcccctttttcccaattggggaaaaagaaaaaggcccgcacctatcccccttcccaaagtgggaaaaccgaatgggaaaaggaaattttag

SEQ ID NO: 65200 - protein, 35 aa, Zea mays
  misc_feature: Ceres CLONE 1535836
MTWHQFPFFPIGEKEKGPHLSPFPKWENRMGKGNF

SEQ ID NO: 65201 - DNA, 657 bp, Zea mays
  misc_feature: Ceres CLONE 1535838
  misc_feature (445)..(445): n is a, c, t, g, unknown, or other
tccccgcggtggcggccgctctagaactagtggatcccccgggctgcaggaattcgtctcacccctagaaaaactagttacatgcatccatgtttacatatacattaatcctgtaacactatcaacacgaatgccttgaattttacagggtaaacaaggcagggagggcagctggtgtgcttgagaaccatgaggaggggaggcgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccctgacctctaaaagtacttttgagtgcttggtgatgacttgctatatgtatgatggtggatgagnttgatcgtccatgcttgatgttcatattcatctgtcatctggatttgcggcacttcagtgataaaattgtcatttggatactggtaatggtacgtcttgtgaaagtccctcaaaaaaaaaaaaaaaaccagacgctcgagggtcccaatcccccctatagggagtccaattacccgccctcatggccctcgtttttcaacgtccggactggg

SEQ ID NO: 65202 - DNA, 653 bp, Zea mays
  misc_feature: Ceres CLONE 1535839
  misc_feature: SWISSPROT Homolog: EC 3.2.1.23 Beta-galactosidase
  misc_feature (572)..(572): n is a, c, t, g, unknown, or other
  misc_feature (576)..(576): n is a, c, t, g, unknown, or other
tggagctccccgcggtggcggccgctctagaactagtggatcccccgggctgcaggaattcgtctcacccctagaaaaataatcaatcaataacggtgaggtgaggttgctattatatgaagtagtagtaacacctcaacaacaacaacccaatgcaatgggaactcgcgtgtaatttgctccttcttcttcaaatataattccgcctcaattgtatgtatgtatgtattaagtctgtctgcctgtaaaaactaaagctttttgtttctttacgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaaacagtgcgcagcctgaatggcgaatggaaattgtaagcgttaatattttgtaaaaattcgcgttaaatttttgtaaatcagctcatttttttaccnatangccgaaatcggcaaaatccttataaatcaaaagatagaccgaataggggtgagtgttgttcagtttggaacaagagc

SEQ ID NO: 65203 - DNA, 661 bp, Zea mays
  misc_feature: Ceres CLONE 1535844
  misc_feature: Translation starting site: 74
  misc_feature: SWISSPROT Homolog: EC 3.2.1.23 Beta-galactosidase
tacccgcggtggcggccgctctagaactagtggatcccccgggctgcaggaattcgtctcacccctagaaaaaatgataatgggaagtcgttcggttgcactggctccaattcctgaagatgagtctggtgctccctgctgtatgaaatggatcccactcgtatattcgtcaccgcgccgcactggtgtaacgtgttgcctcagagtttgcttttagctggttccttttttaaaaataagtactgtttttggttggctaccagtcattttgaacttcagtagctaaaaaaaaaaaaaaaaacgagacgctcgaggtacccaattcgccctatagtgagtcgtattacgcgcgctcactggccgtcgttttacaacgtcgtgactggaaaaaccctggcgttacccaacttaatcgccttgcagcacatccccctttcgccagctggcgtaatagcgaagaggcccgcaccgatcgcccttcccaacatttgcgcaccctgaatggcaaatggaaaattgaagcgttaatattttgttaaaatccgcgttaaatttttggtaaatcagctcatttttttaaccattagcccgaaacgggaaattcccttataaatcaaaaaaatacaccgaaaaagggctgattgtttgttccattttgaaa

SEQ ID NO: 65204 - DNA, 650 bp, Zea mays
  misc_feature: Ceres CLONE 1535847
  misc_feature: Encodes the peptide sequence at SEQ ID NO. 65205
ctccccgcggtggcggccgctctagaactagtggatcccccgggctgcaggaattcgtctcacccctagaaaaagtctccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttccccccagtttgaccgtcgaggaggtctgattggatacatggcaacgccgagttgaactaccccagctttcttatcagtagcagagcatgctactctatgtacttttggaacctaagctattagacctgtcagtgttggatgtctgggatctgcattttttggagaataccaattttactcgtttcagaaaaaaaaaaaaaaacagacgctcgaggtacccaatcgccctatagtgagtcgtattacgcgcgctcactggccgtcgttttacaacgtcgtgactgggaaaaccctggcgttcccaactaatcc

SEQ ID NO: 65205 - protein, 69 aa, Zea mays
  misc_feature: Ceres CLONE 1535847
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPSLTVEEV

SEQ ID NO: 65206 - DNA, 681 bp, Zea mays
  misc_feature: Ceres CLONE 1535853
ccgcggtggcggccgctctagaactagtggatcccccgggctgcaggaattcgtctcacccctagaaaaagagtgtggcgcaacctgcacctcttgaaccggtgcgatgccgggatcgtgccgtacgatctgctgatgcccttctcccagccgggagtcaccgggagggggatccccagcagcatctccatcggatccgtcctcagcatgccttattccaattacatcgagctgggtactgccactgaatgctaatgctgcttcgaccaataaaccgtctgtgtgtctgattgttttgtgcctgtctgtcaacgcctcaagaggcacgtttgacgtgacgctcgaggaaccccgttcccctcaaagtgccccatactccctatgctgagtggtattacgtctcgctacctggtcaccggttaacaccctggcgttctggaaaaaacccggcctttgcccaaatttaccctttttgccagcttggcctcctttcaaacaggtgccggaattaatcgaaaattccccgcacttatgcccccccttccaatgcggtatgggcaaccccggaaaggggtaaattggtaaattttgaaaaactcccaagttattttttttttaaaattttcctccgccctcaaatttttttgtgtaaacaatacagggggcccactataattcccg

SEQ ID NO: 65207 - DNA, 661 bp, Zea mays
  misc_feature: Ceres CLONE 1535857
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (502)..(502): n is a, c, t, g, unknown, or other
ttttnnnnnnnnnnnnnnnnnnnnnnccccccccnntttttnttttttnnnggcttcctcgggggggggccctctgnnngggagttcccnnngatagttggagctccccgcggtggcggccgctctagaactagtggatcccccgggctgcaggaattcgtctcacccctagaaaatacggctcgtacccaccttacggtggagcatcctatgggtctcctccaggtgctccagctccagcgcctcacaacggtggaagttatggtgctgcaccatactcgtcgagctatggatactaatccggagcaagagctgcctcagaactagggaaaggagggttatcgttaatggttttgtttgccagcccaatcccccggttgagaaacccaaaaatgttatttggtaagaacgggggaactttggggtttcaaaggtgggtttttaaaacccaggggcaaaaaaacccccctggctttttggggggggggaattttcctataanaaaaaaaaaaaaccggggccccccgggggaccccaattcccccctaaggggagcctattttcccccgccctctggggggcggttttttttaaacccccccggagggggggaaaaaaccggggggttccccccacatttttaagcgttgggaaaacacac

SEQ ID NO: 65208 - DNA, 683 bp, Zea mays
  misc_feature: Ceres CLONE 1535861
  misc_feature: Encodes the peptide sequence at SEQ ID NO. 65209
  misc_feature (420)..(420): n is a, c, t, g, unknown, or other
  misc_feature (421)..(421): n is a, c, t, g, unknown, or other
  misc_feature (494)..(494): n is a, c, t, g, unknown, or other
ggagctccccgcggtggcggccgctctagaactagtggatcccccgggctgcaggaattcgtctcacccctagaaaaaagtcccccataggccgtagaccagagcagtagaccgccatggcgaaccgcagcaggcagctcgttaccaccgcactgccgctcgcggcggcagcagcagcctcgctcgccgtcgtgctcctgctctgctccacgggctcatcggaagccgacggatacctcgggcgcgtgggtgcgccgtggggccgtaccctcacggtcctcccattcagccccgcggacctgctgcccctcctgccgcggggcgtcgccatggccgcgctccgggcgctccgcggcgtctcgaacatcttcccggtgttcgtcggcgccgcgtcggccggcgggtcgggctcggtgcccnngcagcggggggacgtgagatgaagggggcctgcttctacgaaacgaggcgtggctggtgttcacaacgagacngggttcaagtacggcggcgggacgctccatatcaagacatcaaaccgccagctgggacttgcaaaaatcggtattgatttgcaccccctaccgaagtcccgggaatacaactttttggggccaaaagccaccttttgattttaaaaatggggacaccaactctaatattaaatttgtgaaaaccttatg

SEQ ID NO: 65209 - protein, 108 aa, Zea mays
  misc_feature: Ceres CLONE 1535861
  misc_feature (102)..(102): Xaa is any aa, unknown, or other
MANRSRQLVTTALPLAAAAAASLAVVLLLCSTGSSEADGYLGRVGAPWGRTLTVLPFSPADLLPLLPRGVAMAALRALRGVSNIFPVFVGAASAGGSGSVPXQRGDVR

SEQ ID NO: 65210 - DNA, 654 bp, Zea mays
  misc_feature: Ceres CLONE 1535865
  misc_feature: Encodes the peptide sequence at SEQ ID NO. 65211
  misc_feature (594)..(594): n is a, c, t, g, unknown, or other
cggtggcggccgctctagaactagtggatcccccgggctgcaggaattcgtctcacccctagaaaaagtcgtcccccccggccccgacccccctccgtttgccaacgactccgggctccactgtcgctcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaagattacactgggcgagaggtcaacgtcgacaatttcttcgctgttctgcttgggcacaaactgctctcaggggtgggagcgcaggttngtggacagtgccccaaggaccatatatttgttttctaccgggaccatgggggtctggcct

SEQ ID NO: 65211 - protein, 166 aa, Zea mays
  misc_feature: Ceres CLONE 1535865
  misc_feature (45)..(166): Pfam Name: Peptidase_C13 Pfam Description: Peptidase C13 family
  misc_feature: SWISSPROT Homolog: EC 3.4.22.34 Legumain
  misc_feature (147)..(147): Xaa is any aa, unknown, or other
MVADRLRLALLLSACLCSAWARPRLEPTIRLPSERAAADDAVGTRWAVLIAGSNGYYNYRHQADICHAYQIMKKGGLKDENIVVFMYDDIAHSPENPRPGVIINHPQGGDVYAGVPKDYTGREVNVDNFFAVLLGHKLLSGVGAQVXGQCPKDHIFVFYRDHGGLA

SEQ ID NO: 65212 - DNA, 680 bp, Zea mays
  misc_feature: Ceres CLONE 1535870
  misc_feature: Encodes the peptide sequence at SEQ ID NO. 65213
ctggagctcaccgcggtggcggccgctctagaactagtggatcccccgggctgcaggaattcgtctcacccctagaaaaaacacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccgtgtcgtccgtcaccgtggagaggatgctcacggtgacggcgtcggtggaggcgtcgccggccatcgggcagatgtacttccagcgcgccgtcgacgacatcggcgacctcctcggcaagacgctgctgctcgagctcgtcagctccgagctcgacgcaaagtcgggcgtggagaagacgcgggtgacggcgtacgcgcaca

SEQ ID NO: 65213 - protein, 135 aa, Zea mays
  misc_feature: Ceres CLONE 1535870
  misc_feature: SWISSPROT Homolog: EC 1.13.11.12 Lipoxygenase
MMNLNLKQPLVLPAHHSNVVGSRLSSSSPSAAAASRRTGGGVSSRSGSRRHVRLPRISCSATEEVSGAVSSVTVERMLTVTASVEASPAIGQMYFQRAVDDIGDLLGKTLLLELVSSELDAKSGVEKTRVTAYAH

SEQ ID NO: 65214 - DNA, 814 bp, Zea mays
  misc_feature: Ceres CLONE 1535872
  misc_feature: Encodes the peptide sequence at SEQ ID NO. 65215
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (51)..(51): n is a, c, t, g, unknown, or other
  misc_feature (52)..(52): n is a, c, t, g, unknown, or other
  misc_feature (464)..(464): n is a, c, t, g, unknown, or other
catattctcccactataaccaaacaaatcancaacanncacaaaaaaaaannaaaaacctggagctcaccgcggtggcggccgctctagaactagtggatcccccgggctgcaggagttcgtctcacccctagaaaaaaaaacgccgcctccagtcgttcttcgtaagccttcagaccgacgaatttgagcgactgcacccatagcgcgatccattgcctgggaagaagcaacttgttgcgagcctcctctatggcgagctccgactgtggatccggcatcgcccccaaggacgtgtcgggcatctacggcctgccgctggtgggcgcctggcgctacggtgtctagttctactacttcccgggggaggacaagtacttctagtcccgcgtggagcgctactgctccagggtggtggacatgaaacttgccgaccggggcccattaatgggaggggggtatgtnaccccccccataaggtctttggaggcccgaaagctttcccgcggggcctcttttaacaaatgaaacaaggttggtagaagggaagggaccttggttcaacggggggaccttacattgcccggtgtcaacctttcttttcaattggccgggatgtgccggcggtttctgttcccgtacactggggagcctcttctcgaaggccctttgcgtgaacccaattggttaacagggggggtggctctttttttcccttccatggctttatccccgcaaaggggagaaaagattgtattcccgcaccggttatcgggcctccaagattatttccacccgtggtggatggctcagcc

SEQ ID NO: 65215 - protein, 31 aa, Zea mays
  misc_feature: Ceres CLONE 1535872
MASSDCGSGIAPKDVSGIYGLPLVGAWRYGV

SEQ ID NO: 65216 - DNA, 754 bp, Zea mays
  misc_feature: Ceres CLONE 1535873
  misc_feature (52)..(52): n is a, c, t, g, unknown, or other
  misc_feature (53)..(53): n is a, c, t, g, unknown, or other
  misc_feature (69)..(69): n is a, c, t, g, unknown, or other
aaagaaatccaacccccccaaaacaccataacacccacaaaacaaaaacaannaaactggagctcaccncggtggcggccgctctttaactagtggatcccccgggctgcaggaattcgtctcacccctagaaaaatcttctcaaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccacagcggatgcgccgccactctagccatggccgtcgcgccggccggaaacgccctcttaggcctccacggccgtcacttgcacgccaggtgtgctcgccccccatgcgaccttagtgaaggctcccaagatggcttatgaacacatttaagaagtaatacaacaagccgccgcggaagatcgagcatcctgacccgtcctttctccgctacacccactccatgccgtcccaggacggacaaaattgtccctcctttgcgtgcgctcagaagaaccgggtaacctaccctttcccaaccgcatttggaaatctaccactttagacgtgcccttgcacctaaatgcactgtctaccagtttgggccccgtggatacaatatctgagcggccattttcttatgcaccaagaagggttccccgggcccccccgacatatccgatcaaatcagattgtttg

SEQ ID NO: 65217 - DNA, 646 bp, Zea mays
  misc_feature: Ceres CLONE 1535878
  misc_feature: SWISSPROT Homolog: EC 3.2.1.23 Beta-galactosidase
ctccccgcggtggcggccgctctagaactagtggatcccccgggctgcaggaattcgtctcacccctagaaaaaaaggtcaagggacaggtcagcacgccggcggttcctctcttcctcattttcttctttcttgtcaactcgccggtggccccccttcctcaccatcttccccgtagcgaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccg

SEQ ID NO: 65218 - DNA, 649 bp, Zea mays
  misc_feature: Ceres CLONE 1535880
  misc_feature: Encodes the peptide sequence at SEQ ID NO. 65219
  misc_feature (649)..(649): n is a, c, t, g, unknown, or other
ccgcggtggcggccgctctagaactagtggatcccccgggctgcaggaattcgtctcacccctagaaaaaacgccgcccaccgctgccgcgtcatccgcccgtcgtcgcctgccccgcggcttctgcccccattcgccgccgaagcacgccgagccccgtcccagatcgccgcggcgcttcctgccgccgccggcgaagcgcagggttggaaatctgtttgacggaccactcagtgagtggcttcatgttaaatccatttctggtttcaagatgcttcaccaatgacatctggaaactgtaatagtatgtgctgatcttctatgcttcaccacctgatcatcaatgggctctttcctgaggaaacagcctagctacctcttcattttgataattctgcaccttgttgctcatgaggcaagaacactgagttcagatggcgaagcacttcttgccttcaaaaaggcagttacaaattcagatggagtcttcctaaattggcgtgagcaagatgcagacccctgcaattggaagggtgttagatgtgatagtcatagcaagagagtgattaatctgattcttgcataccacagattagttgggcccataccaccagaaattggaaggttaaatcagttgcaaaccttgtcn

SEQ ID NO: 65219 - protein, 102 aa, Zea mays
  misc_feature: Ceres CLONE 1535880
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MGSFLRKQPSYLFILIILHLVAHEARTLSSDGEALLAFKKAVTNSDGVFLNWREQDADPCNWKGVRCDSHSKRVINLILAYHRLVGPIPPEIGRLNQLQTLS

SEQ ID NO: 65220 - DNA, 683 bp, Zea mays
  misc_feature: Ceres CLONE 1535893
  misc_feature: Encodes the peptide sequence at SEQ ID NO. 65221
  misc_feature (431)..(431): n is a, c, t, g, unknown, or other
ggagctccccgcggtggcggccgctctagaactagtggatcccccgggctgcaggaattcgtctcacccctagaaaaaacacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatnatacgctgtgtgtcaattaatgggttctaggctgctgctgatgcggctgcttcgttcgtgttgccccgtctgattatgtactgtaacccttggctgtcagcctgctgtgctaaaaaccattggttctgtgtggattaaaaaaatacacaggagagagaacccacgcaagagagagagaaagagggggacacacaagcgctctcctcgcgattggacagggcgcgagcagcccgaggccgcgagcagctgagg

SEQ ID NO: 65221 - protein, 77 aa, Zea mays; identical to SEQ ID NO: 63685
  misc_feature: Ceres CLONE 1535893
  misc_feature (4)..(73): Pfam Name: DUF1909 Pfam Description: Domain of unknown function (DUF1909)

SEQ ID NO: 65222 - DNA, 561 bp, Zea mays
  misc_feature: Ceres CLONE 1535895
  misc_feature: Encodes the peptide sequence at SEQ ID NO. 65223
  misc_feature (209)..(209): n is a, c, t, g, unknown, or other
  misc_feature (351)..(351): n is a, c, t, g, unknown, or other
acccgcggtggcggccgctctagaactagtggatcccccgggctgcaggaattcgtctcacccctagaaaaagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtncgtcatcgtcgacgtcgtcgaccagacagggctcttgtgatgccccgacatggtcgttgccaatgactttcagcgctttcctgactgacatcagattgacataaacgtgtccaaagaagactacactgatcaagcaatgganggagctgatttaaaagcaattgggagataactcctggggcaagaacttaatttttcaaaaagggaagccttccctccttggcttttacaaggttcaaggtcctgtttggcaaaaaataaaaggggggggtgcctttaggaagaaactttttaaactttaaaaagggggggccccccccctaaaaattttttgggggggccccccttcccg

SEQ ID NO: 65223 - protein, 46 aa, Zea mays
  misc_feature: Ceres CLONE 1535895
MPFKRFVEIGRVALVNYGKEYGRLVRHRRRRRPDRALVMPRHGRCQ

SEQ ID NO: 65224 - DNA, 640 bp, Zea mays
  misc_feature: Ceres CLONE 1535899
  misc_feature: SWISSPROT Homolog: EC 3.2.1.23 Beta-galactosidase
tccccgcggtggcggccgctctagaactagtggatcccccgggctgcaggaattcgtctcacccctagaaaaatccaagcgtgattatctactacttgtaatgcatcctcttcttctcccccatgtttggtctatttttgggcgtgctaggatgcacctggccggcatgcagctgcgcgatatggttgagctgagcttgagccaccgacatgtgtgtaaaactgtcggtcgagagaacacgcagagtggaaccggcgatgtgcaaaaaaaaaaaaaaaaacgagacgctcgaggtacccaattcgccctatagtgagtcgtattacgcgcgctcactggccgtcgttttacaacgtcgtgactgggaaaaaccctggcgttacccaacttaatcgccttgcagcacatccccctttcgccagctggcgtaatagcgaagagcccgcaccgatcgcctttcccaacagtgcccagcttggatggcgaatggaaattgtaagcgtaatattttgttaaaatcccggtaaatttttgttaatccactcatttttttaacaaaaaggccaaatccggaaaatccctttaaattcaaaaaataacccaaaaagggttgaaggtttttcccgtttggaaaaaaaac

SEQ ID NO: 65225 - DNA, 668 bp, Zea mays
  misc_feature: Ceres CLONE 1535900
ggagctccccgcggtggcggccgctctagaactagtggatcccccgggctgcaggaattcgtctcacccctagaaaaaacccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggttgggttctagttctagaagtgtactactactagtcgttaggcccccccccaagagaggttctttttccacacctcccttgctcaagtgagtcctgtcctgagcggatctacccaccactgccatctgttttttactgtggatgttgggttccgccagtttcttcgtgtgctcttggtttgctccagagaggaaaaacaaaaaacaaaaaaaacagtctagatggctgctgctatagatatgtcaggcgaggagctgatgagagcactcgagccttttatccgggatgcctctgctcacggatcc

SEQ ID NO: 65226 - DNA, 691 bp, Zea mays
  misc_feature: Ceres CLONE 1535902
  misc_feature: Encodes the peptide sequence at SEQ ID NO. 65227
agctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcttcgtggcgagctccatcctgcacatgctcaaccttcgccaactggcccgaggaggtgcaaatcgcgccacgccggcgcaacagcaaggttcaggaaagtggggttcgccaaccagggcttccccaccacccgagtccgaattcgaggaaaccctcaaggcccctcggggccaaaggtcggcaagtccccccaaggaagggttttaaagggttttaagaaaacaaaacgggtaaaccctttttttc

SEQ ID NO: 65227 - protein, 164 aa, Zea mays
  misc_feature: Ceres CLONE 1535902
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAIFVASSILHMLNLRQLARGGANRATPAQQQGSGKWGSPTRASPPPESEFEETLKAPRGQRSASPPKEGF

SEQ ID NO: 65228 - DNA, 518 bp, Zea mays
  misc_feature: Ceres CLONE 1535903
ccccgcggtggcggccgctctagactagtggatcccccgggctgcaggaattcgtctcacccctagaaaaaattgatgtaacgtgttcttgtctgctattgcttcccagcctctggtgtttcttccctgtagtcattccgaacatgatcttttgtattgagaagtatgaatatagcgcgcgtaacgtggtggcgcgccaaaaaaaaaaaaaaaacgaacgctcggggtccccattcccccctaaagggggccatttaccccccctccgggcccgtcttttacaacccgggctgggaaaacctggggtttccccaataatccctttgggaaatcccccttttccccggggggggttaaaaaaaaaaagcccccccccatttccccttccccaagtttcccccccctgggggggaaggaaatttttccccccccattttttttttaaaaacccccccccaattttttttttaaaacccccccttttttttttccccccgggggggccaaccccgcccctt

SEQ ID NO: 65229 - DNA, 862 bp, Zea mays
  misc_feature: Ceres CLONE 1535904
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (379)..(379): n is a, c, t, g, unknown, or other
nnnnnnnnnnnnnnnnnnnngggggggcgggncnttgtaaatnnnnnaattttggttgctccccgcgggggcggccgctctagtttattggatcccccgggctgcaggaattcgtctcacccctagaaaaagccttctctagttcgctcccctacacgccgcgtgcgcgcgccgtgctctctctcgctcgtggggacagctgcgcgaccgccgccgccctacgccaggcgcccaggtcttcgccagtaccttcgccggcgacgaactagcacccacagtttcgcagggctgcagtctgtgtctggaggccctttttattcatatgcctcgtttgcttgtcggtgaattcttgaaagttgagctgttattaatgtttttnacagataattgggttaccccccccggtgtatttttttttccccccccccccgggtgggggggggggggccttttccctcccccttccccgccccgcccgtggtgggtttttgtgtcgcgccgggtagaacaatcgtatctgtgaaataggttttcccacgctgtgtcccgcttcccactccgtggtgtaatctcccgtttttacatctggtaagctttccccatttcactttaccttttgggcggccctcttttatgttcatcaaagttggtcttccctattgagcatctatgttacctttatcgtgttaccgctttccctgttcttcctcttatctctctcctccttacatgtgataattcaattaatctttctccccctgtttcctgtgtttctctatggagtccgtcctgcctgggtggcttggagcatcatatcacggtgcccatttcaccctttctcctccgtgagccgccctgtgcg

SEQ ID NO: 65230 - DNA, 691 bp, Zea mays
  misc_feature: Ceres CLONE 1535907
  misc_feature: Encodes the peptide sequence at SEQ ID NO. 65231
  misc_feature (472)..(472): n is a, c, t, g, unknown, or other
  misc_feature (529)..(529): n is a, c, t, g, unknown, or other
aagctggagctccccgcggtggcggccgctctagaactagtggatcccccgggctgcaggaattcgtctcacccctagaaaaaagtcatagaacggggttgcgaggtagcccaattctacagcactagtctttttcgtctcggtcgccatgtccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaggccgacgccgatcgtgcccggggagggtgcagctggtgagcaagaaaacacacatgggctcactggaggagaataaccagaaggtgctgcttgagctgacngggggcgactccaccaacgaccgggtgggggcttgaccttggtggccttgcttgaanttgagcgggcacatgcagggcaaaaaaatcaaaaaatgaaaaactgcctgaaaatcgggggagaaaaaccttatttctttgacggcctttccttgttacctttctggaaacccccaaaagaattttcccccctcgggggggggaccaagaaactcccccccc

SEQ ID NO: 65231 - protein, 49 aa, Zea mays
  misc_feature: Ceres CLONE 1535907
MQGRGRRRSCPGRVQLVSKKTHMGSLEENNQKVLLELTGGDSTNDRVGA

SEQ ID NO: 65232 - DNA, 670 bp, Zea mays
  misc_feature: Ceres CLONE 1535908
  misc_feature: SWISSPROT Homolog: EC 3.2.1.23 Beta-galactosidase
  misc_feature (173)..(173): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
ctggagctccccgcggtggcggccgctctagaactagtggatcccccgggctgcaggaattcgtctcacccctagaaaaaccttgttgtttttgcaggagaagtttattcccttatcttttggttagttacatcatgtggaggccttgaagcttagaatgtttatgtgtatcntcttatggaaaggcttcacccttccaattattataatcagttatgcactttgggtactatcaggacttgtaataattacaattcttcttatgttgtaaaatttgagctttgtaaatgtaaaatatgttttgtaaagtcttccgctcnnnnnnnnnnnnnnnnnnnnnnnnnntnnnnnntnnnnnnnnnnnnnnnntnnnnnaaaaaaaaaaaccgagacgctcgaggtacccaattcgccctatagtgagtcgaattacgcgcgctcactggccgtcgttttacaacgtcgtgactgggaaaaccctgccgttacccaacttaatcgcttggaacaaatccccctttcgcccgttggcttaatagcgaaaaggcccgcaccgatcgccccttccaaaatttgcccaacctgaatggcaaatggaaattttaaactttaaaatttttgttaaaatccccgtaaaatttttgtaaaaccccccccatttttttaacca

SEQ ID NO: 65233 - DNA, 679 bp, Zea mays
  misc_feature: Ceres CLONE 1535911
  misc_feature: Encodes the peptide sequence at SEQ ID NO. 65234
aagctggagctccccgcggtggcggccgctctagaactagtggatcccccgggctgcaggaattcgtctcacccctagaaaaagattttgcttatggttcagttgccagatacctccagcttgacagaaagaagtgctgtcttcccattaatcttgcagaacacgtatgcaagcagtcctacaaccattcagaattaggagcggcgatatcatgggacgatgctctgcgatcgggcatgagacgcttccagcacaagtactacaacctgttcacctgcaattgccactcgtttgtggcgagctgcctgaaccggcttgcctacaatggctccctagagtggaatgtcttgaacgtggccgcccttgtctggtttcatggccgatgggtggacagaatgtcttccgttcggtcgttcttacctgtcctaaccgtgacatgcattggcatcttaatggctggctggtctttcctggtagggatggcagcgttctctgctcttctgattggatggtttgtttttacagtgtactgcgttaagggtttggtatgttgactggaaaaagaattactgaaagcactccattagtgcattgcagtctaggaattatggatgtaatcgctgtgcagtgctggagtcaggtaaattactcgtgtcctcagcctcagtgattcagacct

SEQ ID NO: 65234 - protein, 183 aa, Zea mays
  misc_feature: Ceres CLONE 1535911
  misc_feature (21)..(157): Pfam Name: DUF778 Pfam Description: Protein of unknown function (DUF778)
AGAPRGGGRSRTSGSPGLQEFVSPLEKDFAYGSVARYLQLDRKKCCLPINLAEHVCKQSYNHSELGAAISWDDALRSGMRRFQHKYYNLFTCNCHSFVASCLNRLAYNGSLEWNVLNVAALVWFHGRWVDRMSSVRSFLPVLTVTCIGILMAGWSFLVGMAAFSALLIGWFVFTVYCVKGLVC

SEQ ID NO: 65235 - DNA, 689 bp, Zea mays
  misc_feature: Ceres CLONE 1535915
  misc_feature: Encodes the peptide sequence at SEQ ID NO. 65236
tggagctccccgcggtggcggccgctctagtctagtggatcccccgggctgcaggaattcgtctcacccctagaaaaaactcgcctattcatccgttcgcctctgtgcctctctgagctcgcactcgctcgtgaacgctccccgacctccgtccgtctccgtgtggtccggctcactttagcagttcagcctgctaggactctctgcgagtagcatagcagcagcttcttgcgaggcagaggcagagccttgtgttgcgttgcgtcttccttcctgcttgagcttattagttggctcgcgatggccggcggcgtggtggtgagctccggcgggggcaaggactaccccggcaagctcaccatgttcgtgctcttcgcctgcatcgtcgccgccaccggcggcctcatctttggatacgacatcggcatctctggtggcgtgacgtcgatgaacccgttcctgatgaagttcttcccgtcggtgtaccgcaaggagcaggaggcggagcggaaccagagcaaccagtactgcaagttcgacagccagctgctcaccatgttcacctcctcgctctacctggcggcgctcgtggcctccttcttcgccgccaccgtcacccgcgtggccggccgcaagtggtccatgttcggcggcggcgtcacgttcctggtcggcgccgcgctcaacgg

SEQ ID NO: 65236 - protein, 129 aa, Zea mays
  misc_feature: Ceres CLONE 1535915
MAGGVVVSSGGGKDYPGKLTMFVLFACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLVGAALN

SEQ ID NO: 65237 - DNA, 694 bp, Zea mays
  misc_feature: Ceres CLONE 1535916
  misc_feature: Encodes the peptide sequence at SEQ ID NO. 65238
  misc_feature (408)..(408): n is a, c, t, g, unknown, or other
ctccccgcggtggcggccgctctataactagtggatcccccgggctgcaggaattcgtctcacccctagaaaaagtcgttctcccgtgccctcgcgtgcgctctatctgtttctggtggcgacgacttgacggtccccgctgctgccgtgcctaggcctctactgcgggagttcgggaccttcaccggcgacgagcacccatcgggttgcttcgcataacttccttcttccgggatacgattagttacgattccttcaactttatctcgatttgtaggaggttgcacagagcccatccaacagggtgtctcagacatactgatggatgggctgcccaatatccttgagaaatcatcacgtgagtgcatgtactcttggtacttcgtcagggaagaacccccccacttntctctatcaggcaagatggtcttactgacaacaaggaatcagacattccgcctttatattgttcatttataccgggaagttggccccgggcctgagcttacctccatgccactagccacggcaggcatgcctttgccaacccttacggttttgaccatttcccttgcccatagatggttggcaggacagtcgcatcgctctgctgtttttttgggtctctaaaggtttaaagaatatccctttgtccccttggaccattggattttataaaggggccgaggaatca

SEQ ID NO: 65238 - protein, 102 aa, Zea mays
  misc_feature: Ceres CLONE 1535916
  misc_feature (29)..(29): Xaa is any aa, unknown, or other
MDGLPNILEKSSRECMYSWYFVREEPPHXSLSGKMVLLTTRNQTFRLYIVHLYREVGPGPELTSMPLATAGMPLPTLTVLTISLAHRWLAGQSHRSAVFLGL

SEQ ID NO: 65239 - DNA, 668 bp, Zea mays
  misc_feature: Ceres CLONE 1535920
  misc_feature: Encodes the peptide sequence at SEQ ID NO. 65240
ggagctccccgcggtggcggccgctctagaactagtggatcccccgggctgcaggaattcgtctcacccctagaaaaaggtccccgtagcgccatgaacctgccgacgccgctcccgcccaccagctccccggccgcggctccccgcgccagccgtgcgcctgtcgtgcctgctgcccgacgcggcaccggccgccggcgtcggcggcagaaaccgtcttcgtccccgtccacccgcgagaccgaggccgagtacgagcagccggacgccctcgcccgcatcctccgcacagaggccgccatctcgggcgtctcccgcaaggctgcggccgcgcggcagcagtccacgaacctttggccccgcgccgtcctcgaggccctcgactccgctgtcgccgcctgccgctgggagtccgccctcgagatcttcgagctgctgcggaagcagcactggtacgagccgaggtcgcagacctacgcgcggttgctgatgatgctcggcaagtgccggcagcccggtcccgccgccggcctcttcagggagatgctctcggagcggctccggccgacggcagacgtgtacacggcgcttatcggcgcgtacggctacagcggcttgctggagcacgcgctggccgctgtcgagcagatgaaaggcgccgctgactg

SEQ ID NO: 65240 - protein, 191 aa, Zea mays
  misc_feature: Ceres CLONE 1535920
MNLPTPLPPTSSPAAAPRASRAPVVPAARRGTGRRRRRQKPSSSPSTRETEAEYEQPDALARILRTEAAISGVSRKAAAARQQSTNLWPRAVLEALDSAVAACRWESALEIFELLRKQHWYEPRSQTYARLLMMLGKCRQPGPAAGLFREMLSERLRPTADVYTALIGAYGYSGLLEHALAAVEQMKGAAD

SEQ ID NO: 65241 - DNA, 667 bp, Zea mays
  misc_feature: Ceres CLONE 1535921
  misc_feature: Encodes the peptide sequence at SEQ ID NO. 65242
ctccccgcggtggcggccgctctagaactagtggatcccccgggctgcaggaattcgtctcacccctagaaaaaattgggaacctggagaaatcaggtcccgtcagtctcagttagagatggttgttaagctatatgagcaaatgtttggcccaaacggtccacaaacagaggaggagctaggtgaaattcctgatgcccaaacaagatacaatgagttcaaagcatcgcagaaggctgactcttccagccagccttcctatgatatcattgacaatgggcaggagttcgacattttcagtgttgtaactgatcgtgcatcatttgaaaagtttcaagcaaaaaaacctccccttgcttactgggttgaaatgaggaaaggtcgaatagcatggcttgagaaatatgttccaacaatttctcataaagacaagtacagggtttattttaatactcctgatggtgctttagaacgtattcctgcttgggctgcatatgttcttccagatgctgaggggaagcaatcctatgcagtacattgggaaccacctcctgaagaaatttacaaatggagatttggacgtccaaaggtgaagggttcacttagaatatatgaatgtcatgtttggaataagtggttcagagcaaaaggtttcatcatttcagga

SEQ ID NO: 65242 - protein, 183 aa, Zea mays
  misc_feature: Ceres CLONE 1535921
  misc_feature: SWISSPROT Homolog: EC 2.4.1.18 1,4-alpha-glucan branching enzyme
MVVKLYEQMFGPNGPQTEEELGEIPDAQTRYNEFKASQKADSSSQPSYDIIDNGQEFDIFSVVTDRASFEKFQAKKPPLAYWVEMRKGRIAWLEKYVPTISHKDKYRVYFNTPDGALERIPAWAAYVLPDAEGKQSYAVHWEPPPEEIYKWRFGRPKVKGSLRIYECHVWNKWFRAKGFIISG

SEQ ID NO: 65243 - DNA, 670 bp, Zea mays
  misc_feature: Ceres CLONE 1535923
  misc_feature: Encodes the peptide sequence at SEQ ID NO. 65244
ctggagctccccgcggtggcggccgctctataactagtggatcccccgggctgcaggaattcgtctcacccctagaataaaccccatcccggactccccccctcccccaacactctcgtgctttcttagccgctgagcatatccctccccgccacgatctcgatggtggagatgtctgtggtggagctcaggacgctgccgctcggcttccgcttccacccctccgacgatgagctcgtcacccactacctctagggctcgatcaccggcgggatcaactccgattccgaggtcatcccccagatcgacgtctgcaagtgcgagccgtgggacctcccggcatagtccctgatccggtactacgatcctgagtggttcttcttcgcccccaaggaccgcaggcaccccaccggtatcatgtcgaacagggtcaccgaggccggatactgtaacgctactgttcaggtcgggataatcagatccaaaggcgacgagcgcaagcaccataccatcggtctgaagaagaccctcgtcttccaccgtggtcgtgccccctatggcgagcgcacggtgtggatcattgcacagtaccgcaccacccagtctgatctccagtcggcgcgcatggcggttatgttctttatccctctcccgtacgcctatgagaaaa

SEQ ID NO: 65244 - protein, 84 aa, Zea mays
  misc_feature: Ceres CLONE 1535923
  misc_feature (1)..(61): Pfam Name: NAM Pfam Description: No apical meristem (NAM) protein
MSNRVTEAGYCNATVQVGIIRSKGDERKHHTIGLKKTLVFHRGRAPYGERTVWIIAQYRTTQSDLQSARMAVMFFIPLPYAYEK

SEQ ID NO: 65245 - DNA, 679 bp, Zea mays
  misc_feature: Ceres CLONE 1535924
  misc_feature: Encodes the peptide sequence at SEQ ID NO. 65246
tggagctccccgcggtggcggccgctctagaactagtggatcccccgggctgcaggaattcgtctcacccctagaaaaacacgaggctgaacgcttgaacctgaacctccaaagcagcaaccccagcagctttagctcctcctcatcgcagccgcagcgccgtcccctactcttccagcgaccaactgctgtctctccggcgacggcagaaccgtctctgcaggtgcagggagggacccgggagatgagtctggggctgctcaacacagagcgcaaccaccttctctccccgaagccgcagagccctcgggatgccgccgtgtcgtcgctgctgaggtcacccagggcgtcctgcggctcctgcagccagagccccaagccgaagcccaccaagatggggcacggcccccttggagcgctcgctcagcttcaagaactgggaggcggacgacagccggggcggcatcaacggagcgcgcccgggggccctggggctgccgcagcaggagaggccccgggcgcgtgggctccgtgtcccccgcaggcgcagggcctggatcgaggaagatctccccctccccccccccggggagctggaccaggggggccaccacccccgtaaaaagaaggtaacagggcctcgcccacccccgccgcagactcgtccaacggggccaat

SEQ ID NO: 65246 - protein, 125 aa, Zea mays
  misc_feature: Ceres CLONE 1535924
MSLGLLNTERNHLLSPKPQSPRDAAVSSLLRSPRASCGSCSQSPKPKPTKMGHGPLGALAQLQELGGGRQPGRHQRSAPGGPGAAAAGEAPGAWAPCPPQAQGLDRGRSPPPPPRGAGPGGPPPP

SEQ ID NO: 65247 - DNA, 702 bp, Zea mays
  misc_feature: Ceres CLONE 1535925
  misc_feature: Encodes the peptide sequence at SEQ ID NO. 65248
ggagctcaccgcggtggcggccgctctagactagtggatcccccgggctgcaggaattcgtctccccctagaaaaagaacacactactccgtccctcgtctcctgcccaaaaccaatggaggccacgacagcgctcgcgctctcctcctcgtccctcgccaccgcacgccgctcgccggagaaggcgaccgctgcgtccctcagcctccgccgtttctcagctaccacctcgctccacctccgcgctgcacggagcccagcgcttcgctcgcaccagtcacccttccagggatggaggcggcgggggagggcgggcgggctggtggttcgcgcggagatgtttggccagctcaccaccggcctcgagggcggcgtggaaccacctgagggaagttgagtcacccacccccaaaaaaatagttgaaccaatgccgggaattcagaaaagctcttttggaggccgatggaagttttgccctttcgcgcgacaatttcttcgggtcttttagggaaaaacggctgtggtccccggggcgggcattgaaggtggcccacccgccccacgccggattgttaaccgtttggcggtatattcacctttgcacccaccttgattggcccggggaggcgccaaaacttttaatgggttgtccaaaaactgcggggctcacgccctagggggccatcgggcggggggtttgc

SEQ ID NO: 65248 - protein, 93 aa, Zea mays
  misc_feature: Ceres CLONE 1535925
MEATTALALSSSSLATARRSPEKATAASLSLRRFSATTSLHLRAARSPALRSHQSPFQGWRRRGRAGGLVVRAEMFGQLTTGLEGGVEPPEGS

SEQ ID NO: 65249 - DNA, 624 bp, Zea mays
  misc_feature: Ceres CLONE 1535930
  misc_feature: Encodes the peptide sequence at SEQ ID NO. 65250
  misc_feature (458)..(458): n is a, c, t, g, unknown, or other
  misc_feature (459)..(459): n is a, c, t, g, unknown, or other
  misc_feature (486)..(486): n is a, c, t, g, unknown, or other
  misc_feature (487)..(487): n is a, c, t, g, unknown, or other
ggagctccccgcggtggcggccgctctagaactagtggatcccccgggctgcaggaattcgtctcacccctagaaaaaatcgatgcgcaaggctctggaggcacagaacaagaagcttgtgctcatttcgaaccagggcagcgtgtccttgtctgcacaagcgttacatgagcgaggccctggcgctgaagccggtggtagtctgcagacaggtctgaggaatattttcgaagcgatggagaacttcacctctgcatctgcaaatacgtacagggagctccatcttcgcgccgaagaagagaaagcccgggttgcgcaggagagcggcagcgtttcctagttccacatgaggacatgagcatttgtcggtggaaagagggggactaacgccagtggcagcgtttctacggcacagtggcacacccaacccctagtggcagctgatgcaccttgctcgnncagtgcctcagttttttttgggttcanngctctctctgatgtagaggcctgtggtactgggtgaagttaccaggttgtgaaatggggggggctgcatttcctttgattcgggatgaaaagggatcctccctaaaccttaattgggaaaccccattttttaatatt

SEQ ID NO: 65250 - protein, 85 aa, Zea mays
  misc_feature: Ceres CLONE 1535930
MRKALEAQNKKLVLISNQGSVSLSAQALHERGPGAEAGGSLQTGLRNIFEAMENFTSASANTYRELHLRAEEEKARVAQESGSVS

SEQ ID NO: 65251 - DNA, 558 bp, Zea mays
  misc_feature: Ceres CLONE 1535948
  misc_feature: Encodes the peptide sequence at SEQ ID NO. 65252
  misc_feature (313)..(313): n is a, c, t, g, unknown, or other
  misc_feature (331)..(331): n is a, c, t, g, unknown, or other
  misc_feature (440)..(440): n is a, c, t, g, unknown, or other
  misc_feature (451)..(451): n is a, c, t, g, unknown, or other
  misc_feature (459)..(459): n is a, c, t, g, unknown, or other
  misc_feature (466)..(466): n is a, c, t, g, unknown, or other
  misc_feature (467)..(467): n is a, c, t, g, unknown, or other
  misc_feature (472)..(472): n is a, c, t, g, unknown, or other
  misc_feature (480)..(480): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
tggagctccccgcggtggcggccgctctagaactagtggatcccccgggctgcaggaattcgtctcacccctagaaaaaaaaaaaatccaattttctccgcgacgaaggagaggcatccctcccttccgcgtggtgtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctncggctgggggcctcttcngctccaagttccaaggaaccccccccaacctttttttaaaaaggggggggaaaacctccttttagaagaggcccccccaaaaaaaattgtgaggggggagaaaaccacnccctcttcttntttttttnatccttnnccttnttctctgnctttcgnnnnnnaaaaaacccccccttcctctttttgggggaaaaaaaaaaaaaaaggggctcccccccccccccccc

SEQ ID NO: 65252 - protein, 101 aa, Zea mays
  misc_feature: Ceres CLONE 1535948
  misc_feature (20)..(20): Xaa is any aa, unknown, or other
  misc_feature (26)..(26): Xaa is any aa, unknown, or other
  misc_feature (66)..(66): Xaa is any aa, unknown, or other
  misc_feature (69)..(69): Xaa is any aa, unknown, or other
  misc_feature (71)..(71): Xaa is any aa, unknown, or other
  misc_feature (73)..(73): Xaa is any aa, unknown, or other
  misc_feature (76)..(76): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
MGDHEARGDDFEKKAEKKLXGWGPLXLQVPRNPPQPFFKKGGENLLLEEAPPKKIVRGEKTTPSSXFFXPXPXSLXFXXXKTPPSSFWGKKKKKGAPPPPP

SEQ ID NO: 65253 - DNA, 671 bp, Zea mays
  misc_feature: Ceres CLONE 1535958
  misc_feature: Encodes the peptide sequence at SEQ ID NO. 65254
agctccccgcggtggcggccgctctagaactagtggatcccccgggctgcaggaattcgtctcacccctagaaaaaacgtgtctttctccgccgccgaactcgaacgcggcacgcctcttgcctccccacacgaagaagcggaccacacgccaccagctccacctccacggaaccagacggtctcctcctccttttctttctcccgtggactgccagtgccgccgggtagagatcccacatctgcgcctcgaccaattcctccttcctccgagaatggtgatcctctatccaggctgtgttgctccaacagttcaccgtgattttctgcccagatgggtgctgctgaacaacagctcgagaatgtactgccatgtctttccagatagaacgaaaccgaaaaggcaatacaggcatcagtgggtgccttgcttctccaagggatcttcgttccaagatccactgccctctgtaaagccttcacgccttcttccagcagaggaactaaagacatatcccaacactgttcctgaggagatatttaacacgatcatactagatgactccgatgcattctatgtgctagaactgagcacgagtagagaatttagttcctctttggataaaaattctgcaatcttaatctgcctattcgatgtcgacggtgactccc

SEQ ID NO: 65254 - protein, 132 aa, Zea mays
  misc_feature: Ceres CLONE 1535958
MVILYPGCVAPTVHRDFLPRWVLLNNSSRMYCHVFPDRTKPKRQYRHQWVPCFSKGSSFQDPLPSVKPSRLLPAEELKTYPNTVPEEIFNTIILDDSDAFYVLELSTSREFSSSLDKNSAILICLFDVDGDS

SEQ ID NO: 65255 - DNA, 672 bp, Zea mays
  misc_feature: Ceres CLONE 1535962
  misc_feature: Translation starting site: 200
  misc_feature: SWISSPROT Homolog: EC 5.4.2.2 Phosphoglucomutase
  misc_feature (353)..(353): n is a, c, t, g, unknown, or other
  misc_feature (393)..(393): n is a, c, t, g, unknown, or other
ctccccgcggtggcggccgctctagaactagtggatcccccgggctgcaggaattcgtctcacccctagaaaaaaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatncagtaagaggtgcaacaattgtggtctctggtgatggccnctatttctcaaaaatgctgttcagatcataacaaaaatggctgctggccatggagtaagacgtgtttgggttggacaaacagtctcaggtctactcctgctgaatctgctgtcatccgggaaaaagtgggggcaaatggaatcaaggctacgggggccttcaccttgaacgcaagcctttaccccggggggccctaaggaggacttcgggaacaataaaaaagggaaaagggggggccgcctccgaaacctgtaccccaaaaatttcctctaaaaaacc

SEQ ID NO: 65256 - DNA, 660 bp, Zea mays
  misc_feature: Ceres CLONE 1535963
  misc_feature (37)..(37): n is a, c, t, g, unknown, or other
  misc_feature (660)..(660): n is a, c, t, g, unknown, or other
taggctcgcaccgtccaaccatctgctataagaactngtggatcccccgggctgcaggaattcgtctcacccctagaaaaaccaccaggaggagggacacgaggccgccgagaagaaggacaggcttctcgccaggctgcaccgcaccagctccagttgcagctcgtcgagcgaccaccatgaatacgaggtgatcgatgagaacggcgagattgtccagaggaacaacaacaggggccttaaggagaaggtcaaggagaagctggcggcccacaatggccacgatgagggcgaccaccgccagacgcccgcgccgcccgtggtggtggacacgcatgctcaccaccgggagggagagcacttcccggcgccggcgcctcccccgcacgtggagacgcaccaccccgtcgtcgtccacaagatctgaggacgacgactcgaagattcagaccccaccacaggcgccggaggaggagaagaaaggcctgctggacaagatcaaggagaagcttcccggtggccactagaagccggaagacactgctgccgccgccgccgcgccggccgtccacgcgccagcgccggcgccgcacgccgaggtcgacatcagcagccctgatggcaagaagggcttgctgggcaagatcatggacaagatan

SEQ ID NO: 65257 - DNA, 665 bp, Zea mays
  misc_feature: Ceres CLONE 1535965
  misc_feature: Pfam Name: zf-C5HC2 Pfam Description: C5HC2 zinc finger
ctccccgcggtggcggccgctctagaactagtggatcccccgggctgcaggaattcgtctcacccctagaaaaatctgttaacttgaggtggaaaagcatatgtggacctgatagcacaatatgcaagtcactgaaggtaaatgccagccacaatataactacataattagtgtcagttatttcacttccagtggaatctaatttttttaaattactctacttaggcacgaattgaaatggagttggtacaaagacaaaatatatcctctccatgtcaatctaggaaaatggatagtgagtttgattctactgatagggaatgtgcattgtgttactatgatctgcatctttcagcttcaggctgtccatgctccccagagaaatatgcttgcctggtacatgcaaagcagctttgttcatgcgattgggacaaaaggtttttcctatttcgttatgatgttaatgagttgaatatcttagctgatgctttagggggaaagctaagtgccattcacagatggggtgtctctgatcttggattaagtttgagctcctgtgtcaaacgggaaaaggtccaagattccaagactgttcgcagattaactgatggcccaagacggtcctacatgtcacaggcatcaacagtatcattgattccttcttc

SEQ ID NO: 65258 - DNA, 687 bp, Zea mays
  misc_feature: Ceres CLONE 1535969
  misc_feature: Encodes the peptide sequence at SEQ ID NO. 65259
  misc_feature (45)..(45): n is a, c, t, g, unknown, or other
  misc_feature (60)..(60): n is a, c, t, g, unknown, or other
  misc_feature (64)..(64): n is a, c, t, g, unknown, or other
  misc_feature (320)..(320): n is a, c, t, g, unknown, or other
  misc_feature (329)..(329): n is a, c, t, g, unknown, or other
  misc_feature (338)..(338): n is a, c, t, g, unknown, or other
  misc_feature (412)..(412): n is a, c, t, g, unknown, or other
aagctggagctccttgcggtggcggccgctctagactagtggatntcttgggctgcaggnattncgtctcacccctagaaaaaacggggggcggggctagccaaccagaccaacccaaaccctagctcaccgctcgttccattccaatccatggaggtggcgctatgagccgccgccgggacggcgggacgtggagctggtgcggccggggaagacgagtcgaggatgacggccagatcggacgatcccggcgtctcgccagggacgtcggcggcggcgggcggctagatctggggcagcgggggaggggctcctcctgncgtgttccntaaccgaancaacgtacccccagcggggactccgtgtcccccgcaaacctgggggggggggggggccccccctaccaaaaaantttgggccccccccacagccccccggaggtattccccagcttcaccgggggggtcgacgcctcccgcccgccggcggccggtgaaacgggttacccgggatcccctaaggcgggggctccgggccaacggcgcgcgggggagcacccccgccagtggttcgtccctcccgagcatccgcccatccgcggcacccaatacggacttcttcgaagggggcacctgggaccctcgcgccgcgaccggcgtgctgacctgagagaggcgggaggagccc

SEQ ID NO: 65259 - protein, 55 aa, Zea mays
  misc_feature: Ceres CLONE 1535969
  misc_feature (52)..(52): Xaa is any aa, unknown, or other
MSRRRDGGTWSWCGRGRRVEDDGQIGRSRRLARDVGGGGRLDLGQRGRGSSXRVP

SEQ ID NO: 65260 - DNA, 641 bp, Zea mays
  misc_feature: Ceres CLONE 1535976
tggcggccgctctagaactagtggatcccccgggctgcaggaattcgtctcacccctagaaaaaattttgtcggtagatagcacatgcatactggtcgggcttgacaactaaacacggcccatctgaaaaacctgcttgtctagctcgtcctcttcttggcgtccttgtcctctgttaatagaagcgttgcaatctctgctcgtactgctccacctggtgctctcccgtgaagccaccttcgctgactcttgctgcttcataaccgacttcctggaggggggagtgatcgctcaacttcctcaagatcggcatgtacgactatctacttcggctgctgcaacggaagattggaaacgtgtctggcgatgcaagctgtacattcgtttaactgattgcgaactctgattctgccgtttgactctgcacgaccgtacaagcacagatactcggcgtcgtccccaatatcagcttctgcatgaccgtgctcgttctaccactgtgcgcactgagtgcaccatggctacatcgcgttcttaatctttttcaggcgatagcacgcttgtaggtgctctcgatccgacattatacatgccccaacacctgcatggcaaatgaggcatgatgtatgcacgcactacat

SEQ ID NO: 65261 - DNA, 717 bp, Zea mays
  misc_feature: Ceres CLONE 1535977
  misc_feature: Translation starting site: 567
  misc_feature: Pfam Name: HCV_capsid Pfam Description: Hepatitis C virus capsid protein
  misc_feature (45)..(45): n is a, c, t, g, unknown, or other
  misc_feature (52)..(52): n is a, c, t, g, unknown, or other
  misc_feature (63)..(63): n is a, c, t, g, unknown, or other
  misc_feature (69)..(69): n is a, c, t, g, unknown, or other
  misc_feature (79)..(79): n is a, c, t, g, unknown, or other
  misc_feature (317)..(317): n is a, c, t, g, unknown, or other
  misc_feature (318)..(318): n is a, c, t, g, unknown, or other
  misc_feature (399)..(399): n is a, c, t, g, unknown, or other
  misc_feature (411)..(411): n is a, c, t, g, unknown, or other
  misc_feature (413)..(413): n is a, c, t, g, unknown, or other
ccctggagctccccgcggtggcggccgctctagaactagtggatntcttggnctgcaggaatncgtctncaccctaggnaaaaaatcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggcccttcccccccgggggggggggatcctcccgtcnnggttctcacccccggacccgccctccccctccggccgccgattttttttccccccccccccgggggggggggggggggctnctccaacttccnantccgccccccgccgcccgcgcgaaaaacccctcgctgccggggggggggcggggagcccctccctggcccccctcggggatggctgccaccggttggcgcatcccggcccccccgccgcggtgcccggcccaccggggggttgccccctccccatggcggggggccgtccgcgcgcgggcgctcgcgccgggcgcctgctgccccagcacagtggggcgacctcgttttgcgctgtggggctctcgctgttcggctgccctgcctctcctgcgtggcgccctgcgcgggtggggagtcggcggc

SEQ ID NO: 65262 - DNA, 643 bp, Zea mays
  misc_feature: Ceres CLONE 1535978
  misc_feature: Encodes the peptide sequence at SEQ ID NO. 65263
  misc_feature (183)..(183): n is a, c, t, g, unknown, or other
  misc_feature (377)..(377): n is a, c, t, g, unknown, or other
tcccgcggtggcggccgctctagactagtggattcttgggctgcaggaatcgtctcatcctcagaaagcggacgccgcatcactccctcgccactcgcgcgcccgggctccttcccgccacgctcacgacgatgccgtccccgacgtcctatcttctcctgaatccctccaaccctcctcctncgccgactctcggcccgcgcctgaccggttcatgtctcctgcgacgcccacggggcggcgggaggcgcgaggtcatccccgccgtgccagcgggccaagaaacgatcgtattcttcacgccgccccgccggtgtcccggagggtggattgtccgtgcagaaggcgggggggggggggcttacccaggtgggcancggggacccccccctggcctggttgaggaggggcaccaggagggcccttctcggtgcttgtccaccttcccgttgcctttctccgaaaggtccccctttgcccccctctgggtctaggaccggggattgacccgggagaggccccccgcctactctttggagaaggcccccagggaccacccggacttcggtttttgtgagggggggggggttccctcccccccggggtcgacccctgtgtttcctcggcggttttcctcgggcca

SEQ ID NO: 65263 - protein, 120 aa, Zea mays
  misc_feature: Ceres CLONE 1535978
  misc_feature (18)..(18): Xaa is any aa, unknown, or other
  misc_feature (82)..(82): Xaa is any aa, unknown, or other
MPSPTSYLLLNPSNPPPXPTLGPRLTGSCLLRRPRGGGRREVIPAVPAGQETIVFFTPPRRCPGGWIVRAEGGGGGAYPGGXRGPPPGLVEEGHQEGPSRCLSTFPLPFSERSPFAPLWV

SEQ ID NO: 65264 - DNA, 676 bp, Zea mays
  misc_feature: Ceres CLONE 1535980
  misc_feature: Encodes the peptide sequence at SEQ ID NO. 65265
  misc_feature (71)..(71): n is a, c, t, g, unknown, or other
  misc_feature (426)..(426): n is a, c, t, g, unknown, or other
  misc_feature (505)..(505): n is a, c, t, g, unknown, or other
agctccccgcggtggcggccgctctagactagtggatcccccgggctgcaggaattcgtctcacccctagnaaagcagcggttcctgcctcgtgcacgtctgtataacccgacggagcgggcgcccgaggacgacgagggaggaaggcagccagtcagccagaggaacctagagccagtcccgtcccgtccatcagccgccacaccacaaacacccaccactctgctctcgcccgcttgctttctctcccccgctccagcttatggcggaggcggcgccagcagccggcggcggcatcggggacatcctcgccacgagcgatcgggacttcctcgtccgcaactccggcgagcaggtgaagatcagcagcgttgaggcgagccctgtggccatctacttctccgcctcatggtgccccgcatgcangaggttcacgccccagcttattgaagtatacgaaaaactggcctcacaaggcaagagcttcgaggtcgtctttgcttcngccgatcgcaatgaggaaagcttttcatgattactttgccaagatgccatgggtggctgtccccttttctgaccgtgaaggcccgtgaggccctttgatggcccgtttcaaggtctctggtatcccccaccttgtcattcctttgatgccaaaacttgggtaaatttcccc

SEQ ID NO: 65265 - protein, 90 aa, Zea mays
  misc_feature: Ceres CLONE 1535980
  misc_feature (55)..(55): Xaa is any aa, unknown, or other
MAEAAPAAGGGIGDILATSDRDFLVRNSGEQVKISSVEASPVAIYFSASWCPACXRFTPQLIEVYEKLASQGKSFEVVFASADRNEESFS

SEQ ID NO: 65266 - DNA, 599 bp, Zea mays
  misc_feature: Ceres CLONE 1535981
acccgcggtggcggccgctctagaactagtggatcccccgggctgcaggaattcgtctcacccctagaaaaaccccgcttccctcccagctcagcgacctccttgccgattacgagtgccgtgtgtgccccgctccagtaagccaacagctcattcctcctcaccacgctgctcgttactaaccaagcaatcaatttcctcctctttccattctcccagccacaaatcgatcggaaacgcacgcccctttctcttcgccttttcgcgtcgtccagatctcagtcgttcttcgctccatgagctaggaatccgaggtgtcctctaggctaagcgaagttggccggcggcggctaggatggggttgatatccggggatgatgatgggggtcattggttggcgcccccatcatggccgggtggaaccgcgttattggccggacgcagtaagaaagggatcccccaaagctgcggaatttaaagggtgctggggttttttaagcaggggacaaacctcaggaaaccctgggcgggcgaataacttcccggggagggggaatacccttcccccccattttgaagacggggtaaaatgggtggaa

SEQ ID NO: 65267 - DNA, 659 bp, Zea mays
  misc_feature: Ceres CLONE 1535985
gcggtggcggccgctctagaactagtggatcccccgggctgcaggaattcgtctcacccctagaaaaaatttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaagaaagctccgagttcttcagttctggatcgatagagaggcggttccctttgcgggctctgaggttcagctctcgctcttgatttgtctcatcaacgcatcaattgggctgcaagcttagagcttggaaggaataatttgactagagaaatgggcagtgttgtagcaaagctcccgcccccggactccggaccgggagggcaccaatggttatggcttttccaacccaggaaaaacccaccgcaaaccccttccaatttacaacccttcctcaaaaacccggccaaaggtgaagtaccccccccccgggcaaaaaaaacccttccggtaatccccccccgttggcctgggcccgtggtcccccccaaaaccccccgcggggaaaaaccaatttcttggggaaaaaagag

SEQ ID NO: 65268 - DNA, 645 bp, Zea mays
  misc_feature: Ceres CLONE 1535987
  misc_feature: Encodes the peptide sequence at SEQ ID NO. 65269
ggagctccccgcggtggcggccgctctagaactagtggatcccccgggctgcaggaattcgtctcacccctagaaaaaactactccgtctccaagtcgcgtcgtcgcactcgaatccatccatccatcgatcgccttcctctctttttatatcgcacccccccgcttccgctcgctcgatcgtcggagtaggcgggcggcatgctgcaggccagctcggagaggccggcgggcctgctgtgggtgcccgggacgagcccgtggccgacgatggacgcggggccgtcggcgagggcgcaggagatcgcgcggcggcgggaggagatgctggggatgctgcgcgacctcccggagtccgagtacgagctctcgctcaccgacctcgtcgagaaggccggggccgaagccgaagccgcgcccgcgaccgcccccaccaaggcagaggacgggaaggacccgggcgccgcgcggtcggcggcagctgcggggaggcacgagcggagggcgtcggcgcggcagcggggcagcggcgggagcagcttccgcagcagcagcgacggcgtcctgctcaacttctacatgccgcgctcgctcacccgcagcttcaccgcgccgcgacccgcccgggacgccgtcgttcgcctcc

SEQ ID NO: 65269 - protein, 148 aa, Zea mays
  misc_feature: Ceres CLONE 1535987
MLQASSERPAGLLWVPGTSPWPTMDAGPSARAQEIARRREEMLGMLRDLPESEYELSLTDLVEKAGAEAEAAPATAPTKAEDGKDPGAARSAAAAGRHERRASARQRGSGGSSFRSSSDGVLLNFYMPRSLTRSFTAPRPARDAVVRL

SEQ ID NO: 65270 - DNA, 666 bp, Zea mays
  misc_feature: Ceres CLONE 1535988
  misc_feature: Encodes the peptide sequence at SEQ ID NO. 65271
ctccccgcggtggcggccgctctagaactagtggatcccccgggctgcaggaattcgtctcacccctagaaaaagtgaagaggctgagagctcgccttgcatgcacgcgcacacctctgcttgggagtacgtgcacagcggcagcagcggactaggagctccatgcatctgtctctagggtgtagagatcctgctcattgtacggtagctgccaccgtctcatcgtcaaccatgtctgctgcttccaccgtggatcctcatcctcctcctcatcatcagcagtgcaataaggtgtcgtccatggagatggagatccccgccgaccttatcatccggatcggcgagtccgttttccctctccacaaggcggtgatggtgcccaagtgcggctacatccgccgggccgtcaaggcggccaggcccagcagcaagggcgccgccgacgccgacgccgacccgccggccaccgtcgagctggacctctcggcgctgccgggcggcgccgacgcgttcgacaaggcggcgcgctactgctacggcgccaatttcgagatcacgccgcacaacgcggcggcgctgcgctgcgccgcggcgttcctggacatgcgccacgcctcggctgacctggccgggcgcgtggacgagttcctggcgcgagcggcgctg

SEQ ID NO: 65271 - protein, 145 aa, Zea mays
  misc_feature: Ceres CLONE 1535988
MSAASTVDPHPPPHHQQCNKVSSMEMEIPADLIIRIGESVFPLHKAVMVPKCGYIRRAVKAARPSSKGAADADADPPATVELDLSALPGGADAFDKAARYCYGANFEITPHNAAALRCAAAFLDMRHASADLAGRVDEFLARAAL

SEQ ID NO: 65272 - DNA, 698 bp, Zea mays
  misc_feature: Ceres CLONE 1535994
  misc_feature: Encodes the peptide sequence at SEQ ID NO. 65273
  misc_feature (396)..(396): n is a, c, t, g, unknown, or other
ctccccgcggtggcggccgctctagaactagtggatcccccgggctgcaggaattcgtctcacccctagaaaaaagcactctagctgcttctctcggttctcgcgactcccaaacggcaaaacgccaaaaccctagccgcggccattccggaattggccatggaggcgagggcgtcgccgcgtccgtcggtctccatcggtggcggcggcggcttcggagctgggcggggtgacggcagcgccttctcgtttctctcaaaggggtggcgcgaggtgcgggattccgccaccgccgacctgcgcctcatgcgcgcgagggctgatttccctcgcacgctcgcggaccgtgagttcgaccacctcctcggggcggggggccactggccctaaactccncgccgcccccccccgtttggcggggggggcgcccattagcccagtttcgagtttcgggcccaccccggatccccgccccagatctcccgaactgggggcgcccggttcctggccacaggaaccgggaacctcccccccccggggggcttccagggggggggggcccccccgggggccggggaaaaccccccccccgcactttggcaaccctgttttgggaacccgccccttcccgaaagcgccttcgctttttaaatgtggatgtgggggtggagccctgtagagcccctggtgtttggcag

SEQ ID NO: 65273 - protein, 76 aa, Zea mays
  misc_feature: Ceres CLONE 1535994
  misc_feature: SWISSPROT Homolog: EC 2.4.1.241 Digalactosyldiacylglycerol synthase
MEARASPRPSVSIGGGGGFGAGRGDGSAFSFLSKGWREVRDSATADLRLMRARADFPRTLADREFDHLLGAGGHWP

SEQ ID NO: 65274 - DNA, 690 bp, Zea mays
  misc_feature: Ceres CLONE 1535995
  misc_feature (392)..(392): n is a, c, t, g, unknown, or other
  misc_feature (399)..(399): n is a, c, t, g, unknown, or other
ctccccgcggtggcggccgctctagaactagtggatccctcgggctgcaggaattcgtctcacccctagaaaaaagtctccatgcctccagtgtccagtccagagtccaggctccaggactaccaccacttcgtctcgtcctcacacctcactccaccacctctgccttgcaaagccttccaccgatccgccgcctcgtccgcgcgctcgcaggcagcagtgtggactacccgccccatactccatcccctactcgaaggatacaccgacctcgagttaagttgggcgaggagaggtggttcattccagcagggatccttctcgtgagcccagtccatctgaccgtcccttgttatctgggggggttgtgcgggacgcgctctttaatttgngagcccngacaccccccttaagtggcaattgttaagagttttagttgtaaaggaaaaaaaagattttcttataatggccgttgggggggaccccccaaagggagggggggggaatggtatcccctttggggaattttcctggggggaggggcggtttttcccccaccggccccgtttcagcccggggggggggggcgggtggggcccccccctgggggcatggaaaaagggccgttcccccggtatttcccgcgggaggaagggtacccccgcaatgtacccccccgaaaatggggtt

SEQ ID NO: 65275 - DNA, 631 bp, Zea mays
  misc_feature: Ceres CLONE 1535997
  misc_feature: Encodes the peptide sequence at SEQ ID NO. 65276
aaagctggagctcaccgcggtggcggccgctctagaactagtggatcccccgggctgcaggaattcgtctcacccctagaaaaaaacagcggcatctatagaaaacggtacaacactttcacgctcagatccagcaatggatgcctccaccatggctatctcctccacggcgatggacggcacacccatcaaagtaggatccttcggcaagggccgcatcaccatgcacaagaccgtgggcaagcccaacgtggaggcgtccggcatcccctggtacggcaccaaccgcgtcaagtacctcggccccttctccggcgagcccccgaactacctcaacggcgagttccccggctactacggctggaacaccaccgggctgtccaccgaccccgagaccttcgccaagaaccgccagctggaggtgatacactcccgctgggacatgctcagagcgctcggctgcgtcttacccgagctgctctcccgcaacaacgtcaagttcggcaaggccgtctggttcaaggactgctcccagatcatcagcgagggcggactggactacctcggcaaccccagcctgatccacgcgcagagcatcctcgccatctgggcctgccaggacatgctcatg

SEQ ID NO: 65276 - protein, 165 aa, Zea mays
  misc_feature: Ceres CLONE 1535997
  misc_feature (61)..(165): Pfam Name: Chloroa_b-bind Pfam Description: Chlorophyll A-B binding protein
MDASTMAISSTAMDGTPIKVGSFGKGRITMHKTVGKPNVEASGIPWYGTNRVKYLGPFSGEPPNYLNGEFPGYYGWNTTGLSTDPETFAKNRQLEVIHSRWDMLRALGCVLPELLSRNNVKFGKAVWFKDCSQIISEGGLDYLGNPSLIHAQSILAIWACQDMLM

SEQ ID NO: 65277 - DNA, 706 bp, Zea mays
  misc_feature: Ceres CLONE 1536002
  misc_feature: Encodes the peptide sequence at SEQ ID NO. 65278
ctccccgcggtggcggccgctctagaactagtggatcccccgggctgcaggaattcgtctcacccctagaaaaaacccgcccacaccggcgaccaccagaccacccaaatcagttgcccttgcccacacggccacacgcctctcctctccttttctccttcccccttcaggctccccgatccgacgaccccagcggcggcgatgggcggcaaggacctgacagaggagcagatcgcctcgatgcgggaggccttcacgctgttcgacacggacggggacggccgcatcgctcccacggagctgggcgtcctcatgcgctccctcggcgggaaccaacccaggcgcagctccgggacatcgccgcgcaggagaagctcacggcgcccttcgacttccacgcttcctcgggctcatgcgcgccccactcagggccgagcccttcgaccgcccggctcgggacgcctttcgcgtcctcgaacaggacggtcccggaaccgtcgccttcccgaactcccgcccgtccctaagtccattggaaaaaaccccagggggcccaattccacaaagggatcccgagggtaaattccccccaaaggaccctccgttaaaaaaatttttccccccctttgggcccaaagaaacccctccccccaagagttcctttccgagaaccccctggcggggttttggtgcgaaaaaacccccc

SEQ ID NO: 65278 - protein, 126 aa, Zea mays
  misc_feature: Ceres CLONE 1536002
  misc_feature (13)..(41): Pfam Name: efhand Pfam Description: EF hand
MGGKDLTEEQIASMREAFTLFDTDGDGRIAPTELGVLMRSLGGNQPRRSSGTSPRRRSSRRPSTSTLPRAHARPTQGRALRPPGSGRLSRPRTGRSRNRRLPELPPVPKSIGKNPRGPNSTKGSRG

SEQ ID NO: 65279 - DNA, 529 bp, Zea mays
  misc_feature: Ceres CLONE 1536003
  misc_feature: Encodes the peptide sequence at SEQ ID NO. 65280
tggagctcaccgcggtggcggccgctctagaactagtggatcccccgggctgcaggaattcgtctcacccctagaaaaaagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagataagatagtgccatcgatctcgctgacggccagcgtgtacaggagaaggttatccagaaacaaggtgcttctctagagcacgacaccagtgaaagagagagcttggattttggttagtacattgacagcaacttcaaaggtccatcgttgctcccccaagaatcctggcaaacaacaatttcgctgaagacctgccccggaaacccctgatgcattccaa

SEQ ID NO: 65280 - protein, 60 aa, Zea mays
  misc_feature: Ceres CLONE 1536003
MAAAASASSVKEVLPSPLTSASEPPPLFDGTTRLYVAYLCPFAQRAWIARNYKGLQDKIR

SEQ ID NO: 65281 - DNA, 634 bp, Zea mays
  misc_feature: Ceres CLONE 1536004
ggctcgagtcgtccaggaggcgtccatatctagaactagtggatcccccgggctgcaggaattcgtctcacccctagaaaaatccccgatttctggaggcgtagttccgttacatatatagccccgcgatcccccacctcgacgactggctccgccgatccacctcgtcgacgggctcaggagacccctcaggggccggatcggactcctcgttcacctatttttccctgcactttaggctaaaactgctttggactaaaacctatatgtccttttttccgggcgtccctgcttcagccatcacatacccctgatgaaaatcttccactcaagcttgctccgtctgcatctctcgtgacagatgtgcgcataatgatgcttagacataccttttgcgaagccctacccgaggaatttgttcttctgatgccaccccgtatagtcggacctaattgccaacccgatgcttctgagctattaaggtggaaacggatcttagctccgctgctccatctgtcctgagtactttttggcgcaccctctttgggtggaccaacaatcatatataaggtactgatttgcacggcattgatggctcccggaaccctataaatactctttttttcgcattctg

SEQ ID NO: 65282 - DNA, 688 bp, Zea mays
  misc_feature: Ceres CLONE 1536008
  misc_feature: Encodes the peptide sequence at SEQ ID NO. 65283
  misc_feature (44)..(44): n is a, c, t, g, unknown, or other
tccccgcggtggcggccgctctagaactagtggatcccccgggnctgcaggaattcgtctcacccctagattctttcttcggcgcagtatctcctaggtctgctagaaagcaatcgcccgcggtattatccatccaccacgctgcatctgcttctcacgccgcctcgccttcctcttccacccctcgccgtccgtcgtcctcagcgcttgtacgcttgcctcaaaacccctggcgccgtgctaaaaccctagccctcgaattccttcccctgcccgcgcggagcagacgagcctgagcccgtcctcctcgtccatggcgtcctcaggggccgccgctaacctctgggtactgcttggtctcggcatcgcgggcgttctcctggcggcgcggcaactgaggcgccctgcgcgccccgatcacggcgccttcgtcgcccgcctcgagctcctcccgccgccccagcctccgccgccgcaggcgccccacccgctcaccggactctgcttcgccatcgctgacgcattgcatgtcagtggttatattacaaggttcggcagtcttgaatggggcaaagacacaccatgcagaaagtgctaaccatcttcagtggttttcagctcctgggtgaaggggggtggctatttggtggttgggaaaaacggttattggaagaagagggcattacag

SEQ ID NO: 65283 - protein, 94 aa, Zea mays
  misc_feature: Ceres CLONE 1536008
MASSGAAANLWVLLGLGIAGVLLAARQLRRPARPDHGAFVARLELLPPPQPPPPQAPHPLTGLCFAIADALHVSGYITRFGSLEWGKDTPCRKC

SEQ ID NO: 65284 - DNA, 712 bp, Zea mays
  misc_feature: Ceres CLONE 1536011
  misc_feature: Encodes the peptide sequence at SEQ ID NO. 65285
  misc_feature (405)..(405): n is a, c, t, g, unknown, or other
aagctggagctccccgcggtggcggccgctctagaactagtggatcccccgggctgcaggaattcgtctcacccctagatccgcacttgacagctgataggcaggcgataccgtaccgagagagttgaagctgagaaagaatggcggggctctacgagaagcagtcggagacgtacgccaagaagcgtccgcagtaccccaaggagtggttctccatgctggccagcctcaccgcggggcaccagcgcgcctgggacgccgggtgtggcaccggccaggccgccatctgcatggcggagcactacgagagcgtggtggcaacggacgtgagcgaggggcagctccggcacgccaccgcgcaccctaaggtcccctacctggggggggggggaggggctctctaanaccatcttcttttctttggtcgccgacaagggttccctggaacctggccgtggcggggccacctcaatccactgggttccacttcccggtttttctacccccgtcctggagccgggccctggcgaaacccccgtgcgcatgcccccccgcggggggttaccacttaccagaggcccccctttcgagggaccgcctgccccggctagggccacaccgcggcccttctgtcctgtccggggatcgcccgggggcgaattgcccagcgtccgttcatctgtttctccccgctccccgcgagggagccgcc

SEQ ID NO: 65285 - protein, 87 aa, Zea mays
  misc_feature: Ceres CLONE 1536011
MAGLYEKQSETYAKKRPQYPKEWFSMLASLTAGHQRAWDAGCGTGQAAICMAEHYESVVATDVSEGQLRHATAHPKVPYLGGGGGAL

SEQ ID NO: 65286 - DNA, 638 bp, Zea mays
  misc_feature: Ceres CLONE 1536012
  misc_feature (54)..(54): n is a, c, t, g, unknown, or other
  misc_feature (387)..(387): n is a, c, t, g, unknown, or other
  misc_feature (585)..(585): n is a, c, t, g, unknown, or other
gcgctctagaactagtggatcccccgggctgcaggaattcgtctcacccctagnaaaattttctatcccctgcagttctgcgctcagagcttgcagacgcccggccgccgctccaagtcttcgttccagccaacctcgccggagctcctccctctgctattctcatgtgcccaggaagaaaaatctcgcggctctatccttccagccgtcttcttcccttatccccgccgccgctctgctcaagatttttcttaccgccgttgcctcgttcccatccgctcggccaccctgaataaaaatcccatcgcggtgtccatcttctgctcttagccgagggcctccgccctgctccctaccgagccccatggtgcggtcgcctctcccccntgcctggcccagctctgctcctctcttcccgggcctgggtcggaggggatcctttggttgaaacccccagcgccggaatccctgaaagcttcaacttcctggggggcccagccctctcctttttccagggcccggcccaaattccaagcaagctcgggcccccgggcccccaaacgggttttttttccaagcgccccnccccattgtgtccccttgccccccggtccccgcttaaatccactttaacggta

SEQ ID NO: 65287 - DNA, 693 bp, Zea mays
  misc_feature: Ceres CLONE 1536013
  misc_feature: Encodes the peptide sequence at SEQ ID NO. 65288
  misc_feature (398)..(398): n is a, c, t, g, unknown, or other
gtgctggagctccccgcggtggcggccgctctagaactagtggatccctcgggctgcaggaattcgtctcacccctagaaaaaaccagacccacacgtttctttaccctaaccttttcgctgctccagcgaagaacacagccaccgccgtttcttcgtcttcctcgcagcgccggcgcgccatctcggtacgaaggcgacggcggcggtgacggcggcgttcaggatcgggatctcagcgacgacgtcagaggcttcccatcccgacccccgccagtcgcctcgcgccctcgactccggactccggtcctccgcacaccggccggttaccctgcgtttgaacctgctatagaaattataatatggccgcgcctgatgcgagggggggagggatggatncactgcatgttggacaaaatgatgaaacaaaagagagactggttaaaggagacggggctggcgacagcaatccttctgttgttgcagctcaatccttgccccccgaggacgacgatgattgagaaaccccagcttgagggtccttcttcagatggagcagcccccggtaaagaaaaaaaagaagaaaacccttcccccaaaggaagagggggcccccttcaaccaaaaagatcccccctcaaataaccggtggatggagctttttccctccggggagaattccccggggggggaa

SEQ ID NO: 65288 - protein, 52 aa, Zea mays
  misc_feature: Ceres CLONE 1536013
  misc_feature (13)..(13): Xaa is any aa, unknown, or other
MAAPDARGGGMDXLHVGQNDETKERLVKGDGAGDSNPSVVAAQSLPPEDDDD

SEQ ID NO: 65289 - DNA, 578 bp, Zea mays
  misc_feature: Ceres CLONE 1536027
ctcacccgcggtgggcggccgcatctagaactagtggatcccccgggctgcaggaattcgtctcacccctagaaaaaaccccactccccctctccgtggtttgtccgctcgcatccttccctcccttccgccctttcctcccacttgctcgccgaacccagagccccgcccacctcttttcggttttttctcgccggcggttgtgccaggatcgggctttgggctccgtgcatcgacgcgccgccgcctcctgatcgcaaagggtgtttcccccaggctttcgtgctccggaagtgggcgagatcgccgaagaaagtcagatccggggggcctggttcgagcaacagtgtgttggcgtatcgatctgcatgggatcgtcgggcgattcgtgtgacggaaacgaactcttctggggtgcgtccggtttgctccccagctccagatctggaaggaagggggggaatcgctgccccaaaccactttgaggggcttgggaaaaggaccctcttttccccaaaattgggcaaaaagtaaactgggaaaggggagggcccttggggggttttcccgggaaaaaa

SEQ ID NO: 65290 - DNA, 677 bp, Zea mays
  misc_feature: Ceres CLONE 1536029
  misc_feature: Translation starting site: 119
  misc_feature: SWISSPROT Homolog: EC 1.1.1.95 Phosphoglycerate dehydrogenase
ggagctccccgcggtggcggccgctctagaactagtggatcccccgggctgcaggaattcgtctcacccctagaaaaaaaacccttcgacccaacccgcctccaactcctaagccgtcatggcggcgccgtccccgaccactaccgccgccgccgccacgacccaccaccgcgtgctcctcccgtccgcgcgcccccgcgccgtcgccgccgcgccatcctccctccgcctcccgctgcgcgcgcagccccacgcccacgcccagcgcgcgcgcctcgccgcccccgtcgcggccgcggccccggccccggcggcgtcgacggcctcccccgagtcccccgcgtcgggcgccgtcccggggaagcccacggtgctcgtggccgagaagctcggcgccgcggggctcgcgctgctgcgggagttcgccaacgtcgactgctcctacggcctctcccccgaggacctccgcgccaagatctcgctctgcgacgcgctcatcgtcaggtccgggaccaaggtcggccgcgacgtcttcgaggcgtccgggggcaggctccgcgtcgtcggccgcgccggcgtcggggatcgacaacgtcgacctcgccgccggcaccgagcacggatgcctcgtcgtcaacgcgcccaccgccaacaccgttcccgctgcccgacatggg

SEQ ID NO: 65291 - DNA, 713 bp, Zea mays
  misc_feature: Ceres CLONE 1536031
  misc_feature: Encodes the peptide sequence at SEQ ID NO. 65292
  misc_feature (443)..(443): n is a, c, t, g, unknown, or other
  misc_feature (444)..(444): n is a, c, t, g, unknown, or other
  misc_feature (454)..(454): n is a, c, t, g, unknown, or other
  misc_feature (455)..(455): n is a, c, t, g, unknown, or other
  misc_feature (496)..(496): n is a, c, t, g, unknown, or other
tggagctccccgcggtggcggccgctctagaactagtggatcccccgggctgcaggaattcgtctcacccctagaaaaactagaaaaaataccaacacaaagccaaggcgcggcgcagccagagtaagcagagagttgcactaccgtgcttcttcagttcttcttcctagtatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcacaagcatgcctgcaaggtggatgcgttccaggagcacgacgaatcgtacaagggcgccgtggccgtgcagcagaagcactccctccttcagggagacanngagaggtgcnncgtgctgctgcccccgtcagagctgcccacattttttttcnagggatgaggaagaaggaaaagcccttctcaaacccggattacggtgcgcaatttgggggggggccccgccgcctttaaaaaaccgggtttacaccttccaaacttccaaaggtttccgggaaacccaggggtcgggtatggttaagggcccgggggtgttaaaaaaaaccgggttatttcccccaaaaaggttcccaaaaaaaacacaggcgcccc

SEQ ID NO: 65292 - protein, 110 aa, Zea mays
  misc_feature: Ceres CLONE 1536031
  misc_feature (91)..(91): Xaa is any aa, unknown, or other
  misc_feature (95)..(95): Xaa is any aa, unknown, or other
  misc_feature (109)..(109): Xaa is any aa, unknown, or other
MHSLVRRGNGYGYGYGGYGSSNPHMNYHRQNTESVTTVVTEMNRMAVDDKPCYGGGVHKHACKVDAFQEHDESYKGAVAVQQKHSLLQGDXERCXVLLPPSELPTFFFXG

SEQ ID NO: 65293 - DNA, 653 bp, Zea mays
  misc_feature: Ceres CLONE 1536032
  misc_feature: Encodes the peptide sequence at SEQ ID NO. 65294
  misc_feature (59)..(59): n is a, c, t, g, unknown, or other
  misc_feature (582)..(582): n is a, c, t, g, unknown, or other
ggcggccgctctagaactagtggatcccccgggctgcaggaattcgtctcacccctagngatggccccgtcccaaatcccctgtcccgctagcggctagtccgaccaggcgatccccccccaaaccctcccccaaaaccccagagcggagaagagcgcaagatgttcggcttcgggcaccacggccagaacccgccggctcacggcggcgtgcaccagcccaccttcaagatcttctgcaagtccgacgaggggtactgcctcaccgtccgcgacggcaacgtggtgctggcccccgccaacccgcgcgacgagcaccagcactggtacaaggacatgcgcttcagcacccaggttaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagccgcgacgtgggcaagggcttccgctgcatccgcatggtgaaacacatccgcctcaacttcgacgccttccacggcgacnagggccacggcggcgtgcacgacggcaccaccgtggtgctgtgggagtgggccaagggcgacaaccagagc

SEQ ID NO: 65294 - protein, 164 aa, Zea mays
  misc_feature: Ceres CLONE 1536032
  misc_feature (141)..(141): Xaa is any aa, unknown, or other
MFGFGHHGQNPPAHGGVHQPTFKIFCKSDEGYCLTVRDGNVVLAPANPRDEHQHWYKDMRFSTQVKDEEGNPAFALVNKATGLAIKHSLGQSHPVKLVPFNPEYQDESVLWTESRDVGKGFRCIRMVKHIRLNFDAFHGDXGHGGVHDGTTVVLWEWAKGDNQS

SEQ ID NO: 65295 - DNA, 653 bp, Zea mays
  misc_feature: Ceres CLONE 1536036
  misc_feature (376)..(376): n is a, c, t, g, unknown, or other
  misc_feature (454)..(454): n is a, c, t, g, unknown, or other
tggcggccgctctagaactagtggatcccccgggctgcaggaattcgtctcacccctagaaaaagaaccaaaaacgatagagaaagagagcctgtcagcccaagaaaaggttcctcccctccttccccacctcgccctcagccctcatcatcctctaacatccgattgtgccctgtgctctgcggttctcggatccaagatttcgccggccggccgccggcggcggctccgggagcgggagaaagactggatttttcgggccatggaggcgtggcctgatccgttcaggcccgggcggtggggtggctttctgagcaggtctgattcgtatcggttcaaatgatctcggcggcttgattggtcggttccgcttccngcgggggatcggagctagggcggtggttttctggccgggcgtggatcatcggctcgggtctggtgggatctggttggntgctggttcagcacacgagcggcaggtctgcgtagatccccctcttcgcttccttgggggatttgtaccgctagggttttgggttgggcctgggtggaaaaataattaaaccaatcccttggagaggttcccaaggaaaccgcggaaaggtggggaataaccgggaaacttctcctccgggaatggaaattgacccccc

SEQ ID NO: 65296 - DNA, 682 bp, Zea mays
  misc_feature: Ceres CLONE 1536038
  misc_feature: Encodes the peptide sequence at SEQ ID NO. 65297
  misc_feature (502)..(502): n is a, c, t, g, unknown, or other
  misc_feature (582)..(582): n is a, c, t, g, unknown, or other
  misc_feature (682)..(682): n is a, c, t, g, unknown, or other
ctccccgcggtggcggccgctctagaactagtggatcccccgggctgcaggaattcgtctcacccctagaaaaaacgcactgacaacctgggtggccgccaccgcacaccctcttcgcctctcgctccccgtcgtcggtgagccgcgcccgtccagccgcccaccctctcaccgatggcttcggcggccgcgaggggcgccgcggtgcgctcccctctcctcgtccaccaccgcgtccccctggtacatcccagcgggggaggctcgctccgggtcggctggcccgggattgcgcccggacgggaggggcggcggcgggtggccccggttggggctagggttttcgcgcgctactcccaggcccaggacttctccacacgcctccaagatagagctggtgagctgcctaagttagtcgaggaccttatccagacatcgattagcacagggcctcgaggtgctttcaggatggcccaagggatcccagctgtgctttgggtcngcggggagtggctgaatgacctctcaaagacagccaatacatcagcatcagcaggaattccatctcagatgcagcttggnttgctttcttcactttacccttagaaggctttttgagcggaggggtgcccccttatattcagttagggccagtttgtagcatctgcccccacctttgttn

SEQ ID NO: 65297 - protein, 143 aa, Zea mays
  misc_feature: Ceres CLONE 1536038
  misc_feature (110)..(110): Xaa is any aa, unknown, or other
MASAAARGAAVRSPLLVHHRVPLVHPSGGGSLRVGWPGIAPGREGRRRVAPVGARVFARYSQAQDFSTRLQDRAGELPKLVEDLIQTSISTGPRGAFRMAQGIPAVLWVXGEWLNDLSKTANTSASAGIPSQMQLGLLSSLYP

SEQ ID NO: 65298 - DNA, 685 bp, Zea mays
  misc_feature: Ceres CLONE 1536039
  misc_feature: Encodes the peptide sequence at SEQ ID NO. 65299
  misc_feature (471)..(471): n is a, c, t, g, unknown, or other
ggagctccccgcggtggcggccgctctagaactagtggatcccccgggctgcaggaattcgtctcacccctagaaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagacggagacggagaaggagcaggaggaggcggcggccgccagcgaggagctgcccgtcatgccctgngccacctccgtcgcaagcggttacacccttttgagggatccacaccacaacaaggggtcttgctttcacagaggaggaaaaggatggacactacttgcgtggactgctccctccggcagtactatctcaggaactcaaaataaagaagtcatgaacaccctgcggcagtaccagacccctttgcagcggtatatagctatgaatgacccttcag

SEQ ID NO: 65299 - protein, 161 aa, Zea mays
  misc_feature: Ceres CLONE 1536039
  misc_feature: SWISSPROT Homolog: EC 1.1.1.40 Malate dehydrogenase (oxaloacetate-decarboxylating) (NADP(+))
  misc_feature (90)..(90): Xaa is any aa, unknown, or other
MLSTRTAAVAASASPASPWKLGGRSEGGASCDGCRTYRNTLRRRAAPAKVRALPPRRVDAVAMVSNAETETEKEQEEAAAASEELPVMPXATSVASGYTLLRDPHHNKGSCFHRGGKGWTLLAWTAPSGSTISGTQNKEVMNTLRQYQTPLQRYIAMNDPS

SEQ ID NO: 65300 - DNA, 710 bp, Zea mays
  misc_feature: Ceres CLONE 1536041
  misc_feature: Translation starting site: 173
  misc_feature (533)..(533): n is a, c, t, g, unknown, or other
  misc_feature (554)..(554): n is a, c, t, g, unknown, or other
  misc_feature (555)..(555): n is a, c, t, g, unknown, or other
ggagctccccgcggtggcggccgctctagaactagtggatcccccgggctgcaggaattcgtctcacccctagaaaaacccattatcacggcggcggtggcggagcggaaggcgaaggagtagcagcagcaggcggcgccgaatagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgcccttcacccaatcagggatgaggatgctaangtcagctttgcaggttaggtnnctgtcagttgggcagaagggcatcccgtacctggacacgtatgacggccgcaccatccgctaccctgaaccgctcatcaaggcaacgacacattcagatcgatctggagaccacaaaattgtgactttctcagttggatgttggcacgcgtgtct

SEQ ID NO: 65301 - DNA, 854 bp, Zea mays
  misc_feature: Ceres CLONE 1536042
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tttccccttccccnnnngccngtggcgctctctctaaaacgnnnnaaaannnnnnccccctggggctccccgcggtggcggccgctctagaactagtggatcccccgggctgcaggaagtcgtctcacccctagaaaaaccttcacctcagctcacggcctcacccgtccacccacccacccgcctcgcctccatccacagcgaccacgcccatcttcgctctgtccgctcacccccacctctccgcccccgtctccgtccgcacccgtccgcctccgacttccccgtggtccagccggatccggagccgaactcgaccttgttcaggaaggagagcccgaaccgcggcggggggggagggctcttttttagtttgccccccctgagggccaaccacccccatgggccagtccccctgaagccccccccccatccaggtcattgaaccggcggggaaagggttggtaaccgtcgggtggggaacccccctcccccccccgcaaaagccaattgttagccaaagcgcggggccttggcgggtcaaatttatttccctgggaacaagcaatctctccccttttatgccccctggagaacccctgggggacgtcacaaaaatatccgggtgacaggaagggagggcgcccctcacatcgaaaggcgttggtctccaaaataagcggggaggatggcgcacggttcccgggtcccttaggcgtatgtggagcgggccacctttcgttaaaaatccccacaataccatatggggggtttcgggtgcccgccctagtctggctgcaaccatatcttcttttggaaaaatgggcgccaccctttccgtggatagaatccca

SEQ ID NO: 65302 - DNA, 690 bp, Zea mays
  misc_feature: Ceres CLONE 1536043
  misc_feature: Encodes the peptide sequence at SEQ ID NO. 65303
  misc_feature (387)..(387): n is a, c, t, g, unknown, or other
  misc_feature (634)..(634): n is a, c, t, g, unknown, or other
  misc_feature (642)..(642): n is a, c, t, g, unknown, or other
ctccccgcggtggcggccgctctagaactagtggatcccccgggctgcaggaattcgtctcacccctagaaaaagtctctctccagtcttcttcaccaccctgcttcctccctcttcctcttttgtttcatcagagagaaaaaaaactagatttagcgagggcggaccgacgacgcagtagaagcaaccgagacatggagcggcggaggaaggcaatgtggctgtaccccaaggtggtcggtttcaacccgccggagaggtggggccactccgcctgcttcttcgaaggcttcgtctacgtcttcgggggatgctgcggcggcctgcacttcggcgacgtgctgaagctgaacgtggacaccatggcggtggggtgttgtgcccacnacggggcagtgccccgggcacccgggacagccccggcgcccgcgctggtgggccccccggatgctcgtcttcgggggggaccaaccggcggcggaaaggtgaaccacctcgcacttgctggacctggcccaccggggggggggaacccccccccagggcaagggcgcgccccccccccctcccccgcgggagaagccccacccgtccccccgttgtgggggggggaacccccctcttcctttttttngggggaangggggaaggggccaagggccaattccccctcgggaaagtggccccggg

SEQ ID NO: 65303 - protein, 165 aa, Zea mays
  misc_feature: Ceres CLONE 1536043
  misc_feature (65)..(65): Xaa is any aa, unknown, or other
  misc_feature (147)..(147): Xaa is any aa, unknown, or other
  misc_feature (150)..(150): Xaa is any aa, unknown, or other
MERRRKAMWLYPKVVGFNPPERWGHSACFFEGFVYVFGGCCGGLHFGDVLKLNVDTMAVGCCAHXGAVPRAPGTAPAPALVGPPDARLRGGPTGGGKVNHLALAGPGPPGGGNPPPGQGRAPPPSPAGEAPPVPPLWGGEPPSSFFXGEXGKGPRANSPSGKWPR

SEQ ID NO: 65304 - DNA, 1315 bp, Zea mays
  misc_feature: Ceres CLONE 1536044
  misc_feature: Encodes the peptide sequence at SEQ ID NO. 65305
atatgtgttcgaaaagtagcaacttttctgtccaaactgtctctcccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaacgggaagcgggccaaggaattcatggagaagggtcagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattacgaaaatatcgagtccttgctatcaacatatgagaacattattgtcaaagtgcaaggagatgccacagtggatgctgtctttgctaagatcgacgagctgctgggttctatcctggagaagaaaaatgaaatggtttccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaaagcataggaatttttttcctccmaattattaactgtacgcgaatggaagcgacagatcattcgtaggttgtgagggcttcagagatcatctgctgctgtacatgttttgttgctgtcttgtgaacatacatgtcttgttgtttctcaactggaggaatgctgttaacctgctgtatcatttccttgaatggctta

SEQ ID NO: 65305 - protein, 284 aa, Zea mays
  misc_feature: Ceres CLONE 1536044
  misc_feature (72)..(251): Pfam Name: ADK Pfam Description: Adenylate kinase
  misc_feature: SWISSPROT Homolog: EC 2.7.4.3 Adenylate kinase
MASSMAAAATATALPLPSGTTQRPSAQGRLLFTAAPARSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYENIESLLSTYENIIVKVQGDATVDAVFAKIDELLGSILEKKNEMVSST

SEQ ID NO: 65306 - DNA, 705 bp, Zea mays
  misc_feature: Ceres CLONE 1536047
  misc_feature: Encodes the peptide sequence at SEQ ID NO. 65307
ggagctccccgcggtggcggccgctctagaactagtggatcccccgggctgcaggaattcgtctcacccctagaaaaagtggagtacttcaattggcgttggccgaagaagaggagaagcgaagcaagcagctttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttggggctttgttgctgtggagtgcctcccaggacgtttttgcattcacctcacatgagcattttactttcagtcaatgacctactggcatgctgccgttttatttgccgcaatgggtgttattgaagcctttcttttaaggctggcgcctcttttt

SEQ ID NO: 65307 - protein, 139 aa, Zea mays
  misc_feature: Ceres CLONE 1536047
  misc_feature (33)..(76): Pfam Name: Propeptide_C1 Pfam Description: Peptidase family C1 propeptide
  misc_feature: SWISSPROT Homolog: EC 3.4.22.1 Cathepsin B
MGGELLLALLLVSAAAAPQVLGVGNGDNHMRIIQEDIIETVNNHPSAGWTASRNPYFSNYTIAQFKHILGVKPAPQNALSNVPVKTYSRSLELPKEFDARSAWSRCSTIGNILDQGHCGSCWGFVAVECLPGRFCIHLT

SEQ ID NO: 65308 - DNA, 698 bp, Zea mays
  misc_feature: Ceres CLONE 1536049
  misc_feature: Encodes the peptide sequence at SEQ ID NO. 65309
ccgcggtggcggccgctctagaactagtggatcccccgggctgcaggaattcgtctcacccctagaaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagcatgcccccgcccgcgccgcccttagacagattcggtgctcaaggcgctgaacttgggttcccgaaagagcgcgacgccccgcgggggttccgggagaaacaaggcccttcgaagaagccgacaaattacgcgggcagccccaagaagaggcctcctccggtgatcaccagcctccttaggt

SEQ ID NO: 65309 - protein, 94 aa, Zea mays
  misc_feature: Ceres CLONE 1536049
MSAVAVSSSLNPNAPLFIPAALLQVEDFSPQWWDLITTTAWFRDHWSREHAHLDEIAEQLELVALLAYDEDEDLFYGEHAPARAALRQIRCSRR

SEQ ID NO: 65310 - DNA, 658 bp, Zea mays
  misc_feature: Ceres CLONE 1536050
  misc_feature: Encodes the peptide sequence at SEQ ID NO. 65311
  misc_feature (538)..(538): n is a, c, t, g, unknown, or other
aaagctggagctccccgcggtggcggccgctcctagaactagtggaacccccgggctgcaggaattcgtctcacccctagaaaaagcgaccccaggtcagtcgggactacccgctgagtttaagccaagtttgtgacacaacaggtgggcgagaatgaaccatttgtttctgagcttctgtccaaccttgctacaacaatcgcggatcttgagccacatcagatccatacattttacgaatcagttggccatatgattcaagctgaatctgacaacactaagagagatgaatatctcaagagattgatgagccttcctaatcagaagtgggcagaaataattggacaggcaagccaaagcattgatatcttgaagaaccaagatgttatcagatcagttctcaacatcctacagacaaacacaagtgttgcgagctcccttggaccacacttcttcccacagatttctctaattttcttggacatgctaacagtctacagaatgtacagtgagcttgtatcaagcacgatcgctgaanggagaccctttgccctcaaggaacatcctttgggaaaaaattttgggaatcctttccaaggggaaaacccccaagatttgttccaaaccttttttgtggaaacagggggaaaaaatttcc

SEQ ID NO: 65311 - protein, 135 aa, Zea mays
  misc_feature: Ceres CLONE 1536050
  misc_feature (96)..(96): Xaa is any aa, unknown, or other
MIQAESDNTKRDEYLKRLMSLPNQKWAEIIGQASQSIDILKNQDVIRSVLNILQTNTSVASSLGPHFFPQISLIFLDMLTVYRMYSELVSSTIAEXRPFALKEHPLGKNFGNPFQGENPQDLFQTFFVETGGKNF

SEQ ID NO: 65312 - DNA, 706 bp, Zea mays
  misc_feature: Ceres CLONE 1536053
  misc_feature: Encodes the peptide sequence at SEQ ID NO. 65313
  misc_feature (703)..(703): n is a, c, t, g, unknown, or other
tccccgcggtggcggccgctctattactagtggatcccccgggctgcaggaattcgtctcacccctagaaaaaaagggagcagaagccaaccggctcgtccgcccgttgcctgtcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctgtgttcaacggtggagatggcaaatgcattgctgattctgatgtaatcatccaagtcattgaggagaagttcccgactccttctctggtcacccctccagaatatgcatcagtgggatcaaagattttcccagcctttgtcaagttcttgaagagcaaggatggtagtgatgggtcagagaaagcgcttctggatgagcttgcagcactggatgatcatctcaaagctcatggcccctacataaatgggggagaaacgtgtccaccgactggatctttaaccctgggggcccaaagcttttttccaccctcacagaatcggcacctgggaaccattttccaaaaggcttggataaaaatccccaaaaaaaaacctttacccgaatggtccccattncca

SEQ ID NO: 65313 - protein, 195 aa, Zea mays
  misc_feature: Ceres CLONE 1536053
  misc_feature (16)..(84): Pfam Name: GST_N Pfam Description: Glutathione S-transferase, N-terminal domain
  misc_feature: SWISSPROT Homolog: EC 2.5.1.18 Glutathione transferase
  misc_feature (194)..(194): Xaa is any aa, unknown, or other
MAAVEVCVKAAAGNPDTLGDCPFSQRVLLTLEEKKVPYEVKLVDLGNKPEWFLNISPEGKVPVFNGGDGKCIADSDVIIQVIEEKFPTPSLVTPPEYASVGSKIFPAFVKFLKSKDGSDGSEKALLDELAALDDHLKAHGPYINGGETCPPTGSLTLGAQSFFPPSQNRHLGTIFQKAWIKIPKKKPLPEWSPXP

SEQ ID NO: 65314 - DNA, 715 bp, Zea mays
  misc_feature: Ceres CLONE 1536056
  misc_feature: Encodes the peptide sequence at SEQ ID NO. 65315
aaagctggagctccccgcggtggcggccgctctagaactagtggatcccccgggctgcaggaattcgtctcacccctagaaaaagacttccgctcgcacacctcccctcatgtggctgccctgggtgaagacgcggccttcatccgccacctccacctccaactctccctccaccgcgctcgtagctgccgcctccccgcgcctgtccttctcctcgccctccctcaaggacctccaggcactgctcctgtcggacgccgcgacactctccccgccgcccgccgcgccctgttccccctcctcctccgtccgcgtcttccaccgggtccgcgtcgccgcctctgccctccgtgcgctccgcaccctccaggcgccgccgtactccggcggcggcgccgccttcgaggcggaccgccgcgtcgtgctctacttcacctcgctccacgtggtccggagcacgtacgaggactgccgcgccgtgcgcgccatcctgcgcgggctccgcgtcgccgtcgacgagcgcgacctcgccatggacgcgcgctacctccaggagctcggggcgcttcctccgcgccccgtggccccggcggggcgtcagctggctcaggcttcgtcggaggcgccaacttctgggggcccaaaaaagtccgggccctcccaaagccggggaagtcggggcgtttgtggccggggcctttccccctcccctgcc

SEQ ID NO: 65315 - protein, 202 aa, Zea mays
  misc_feature: Ceres CLONE 1536056
MWLPWVKTRPSSATSTSNSPSTALVAAASPRLSFSSPSLKDLQALLLSDAATLSPPPAAPCSPSSSVRVFHRVRVAASALRALRTLQAPPYSGGGAAFEADRRVVLYFTSLHVVRSTYEDCRAVRAILRGLRVAVDERDLAMDARYLQELGALPPRPVAPAGRQLAQASSEAPTSGGPKKSGPSQSRGSRGVCGRGLSPSPA

SEQ ID NO: 65316 - DNA, 725 bp, Zea mays
  misc_feature: Ceres CLONE 1536060
  misc_feature: Translation starting site: 108
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (202)..(202): n is a, c, t, g, unknown, or other
  misc_feature (204)..(204): n is a, c, t, g, unknown, or other
  misc_feature (205)..(205): n is a, c, t, g, unknown, or other
  misc_feature (215)..(215): n is a, c, t, g, unknown, or other
  misc_feature (223)..(223): n is a, c, t, g, unknown, or other
  misc_feature (224)..(224): n is a, c, t, g, unknown, or other
  misc_feature (230)..(230): n is a, c, t, g, unknown, or other
  misc_feature (232)..(232): n is a, c, t, g, unknown, or other
  misc_feature (233)..(233): n is a, c, t, g, unknown, or other
  misc_feature (243)..(243): n is a, c, t, g, unknown, or other
  misc_feature (244)..(244): n is a, c, t, g, unknown, or other
  misc_feature (252)..(252): n is a, c, t, g, unknown, or other
  misc_feature (254)..(254): n is a, c, t, g, unknown, or other
  misc_feature (284)..(284): n is a, c, t, g, unknown, or other
  misc_feature (287)..(287): n is a, c, t, g, unknown, or other
  misc_feature (303)..(303): n is a, c, t, g, unknown, or other
  misc_feature (348)..(348): n is a, c, t, g, unknown, or other
  misc_feature (636)..(636): n is a, c, t, g, unknown, or other
  misc_feature (637)..(637): n is a, c, t, g, unknown, or other
tggagctccccgcggtggcggccgctctagaactagtggatcccccgggctgcaggaattcgtctcacccctagaaaaaatccccgattccccaaccctaagcagccatggccgcgccgccgcccacgggctgcttcaagtgtggccgccccggccactggtcccgcgactgcccctcctccgccctcacaannncctctgncnngcgcgacgcngccacaanncctagncnnactctcgggnngcgctccngntttcacgccaaagccaggcccccccccgcngcngttgatggccagaacngcaagggaaaaagaaaaaggaaaaggccaccccccccaagtaagnccgaactgctccttttccaagggggatcggtttcgggccccctaatttccccaagggtttaaacccccgcccccccccgggcaaaagggggaaaaaccccctaaaactcaaaaagctttccgggaaggggccccccccgggacccccattaatcctttaaaaaaatttggggcacaacaaaaaaaatggggcccgccacacccccccgaagaaaatttttttttcccacaccagagagagaaaggggggccccaaaaggggggggggatccccccccctttttttttnnacaaaccccccccccaaaaaaaaatactttttttttgggggggggggaaaaattttttataaaaaaaaactatttttgggggagagac

SEQ ID NO: 65317 - DNA, 640 bp, Zea mays
  misc_feature: Ceres CLONE 1536067
tccccgcggtggcggccgctctagaactagtggatcccccgggctgcaggaattcgtctcacccctagaaaaagataaagatctctaactagataggaacggccaaccggcatatttatgtaatcaatggatgagaaataaagtaggcaagaattagaagggagaaaccctcctcttgctcggccgtggatagagcccccctgccggcgttcctgcccatcgatctccctctctaatcccctctacgcatctactgttcattggcgggcactgttcatgtgcgtgccgcctccaccagcagctccaatccctcacctgttcatgtgcatgccgcctccaccagcagctccaatccctcaccgatctagcaaccataacaaataggcataggactagagttggctacttactagtttgctatttttcttgcttctggtgggattaacttcatgtgtctttggatggttacaaggtttaaacaatgccgagaggcagcctatgatgtcgatgcagaaagtgaagggacttaggagagggtgataggcatagggactagagttggctactaagagcatctccactagtttccaaaacaattttctaaaattaatttagggtgttattaactataaattatgct

SEQ ID NO: 65318 - DNA, 715 bp, Zea mays
  misc_feature: Ceres CLONE 1536068
  misc_feature: Encodes the peptide sequence at SEQ ID NO. 65319
aagctggagctccccgcggtggcggccgctctagaactagtggatcccccgggctgcaggaattcgtctcacccctagaaaaaccaccacccgtcctcggccctcctctctctctctattcccccctccccggaggccggagcgctcgtgcggaccacgaggaggaggagagagagaggcagggagccctagccctgccctgcgcgccggcgtcgccagggttagggtctccccggggcccccgccttccttgccaatccctccgccgtcttctcgctctggccgatccccccgcccgacgcgcggggggcgcctagcggcgtgtctgcgttcggcctcgacggcgcggcgcgagccaatgctgtgtgcctgaccgtcgctttgggattgattccactcggaggtggccagctagccacccgagctcgctgtccttgccggtacggcgtttcctgaggaggttccgtgcgagatccgaaggccggcgtgatgcagcacgatcagcgcaagaagggttccgtggaggcagagtttttcacagagtatggggatgcaagtcgatacaagattcaggaagtcattggtaaaggaagctacggggtggtctgctccgctgtagatgtccacactggagagaaagtagcgatcaagaagatacatgacatctttgagcacatatctgatgctgcccggattctccgtgagatcaagcttc

SEQ ID NO: 65319 - protein, 75 aa, Zea mays
  misc_feature: Ceres CLONE 1536068
  misc_feature: SWISSPROT Homolog: EC 2.7.11.24 Mitogen-activated protein kinase
MQHDQRKKGSVEAEFFTEYGDASRYKIQEVIGKGSYGVVCSAVDVHTGEKVAIKKIHDIFEHISDAARILREIKL

SEQ ID NO: 65320 - DNA, 730 bp, Zea mays
  misc_feature: Ceres CLONE 1536070
  misc_feature: Translation starting site: 313
  misc_feature: Pfam Name: Remorin_N Pfam Description: Remorin, N-terminal region
  misc_feature (396)..(396): n is a, c, t, g, unknown, or other
  misc_feature (424)..(424): n is a, c, t, g, unknown, or other
  misc_feature (430)..(430): n is a, c, t, g, unknown, or other
  misc_feature (433)..(433): n is a, c, t, g, unknown, or other
aaagctggagctccccgcggtggcggccgctctagaactagtggatcccccgggctgcaggaattcgtctcacccctagaaaaaaagaatacgaggccgtcttctcctctgtcagaattcggaaacacaccaaagctagcctccgctccctccccttccagcttcgtctagacagagtccagcagacacggccaacagttaaaaccggttgctattagtacgcgcccgccaccacgctcgcacagacacacacacacacacacacacacacactcaacagcaacagctaagcctctcccacaagacagcaacatggctgaggaggaggccaagaaggtggaggtggaggtcaccaaggagcccgaagcggcggcgaaggaggacgtagccgatgancaggccgtcatccccgcgaccgaaccgnctgcgnctngcgcggctggcgaagactccaaggccctgggcatcgtcgagaaagttgcagatgaaccctgctccgagaaagcctgcccctgcgaaagcaagggggctccaatgacaggaatctcgctcctgccaaggtggaaaacagagaaaagggactcctttgatcaaagcttggggaaagaaatgaaaagacaaagctgaaaaccaaggttgctagaaaagtaccgccttttctttctggggaaaaccaaggaaacggaacctttaaccttacctggaaaaaaatggaggaaaccgggaaaaa

SEQ ID NO: 65321 - DNA, 533 bp, Zea mays
  misc_feature: Ceres CLONE 1536074
  misc_feature (230)..(230): n is a, c, t, g, unknown, or other
ctggagctccccgcggtggcggccgctctagaactagtggatccccccgggctgcaggaattcgtctcacccctagaaaaactcaaacaaactcaagcctgccctgccctgccttgttaagcaaagcaacccagctgcgagacacgagagctagctagagagagatggcggccacggtttcgtccttccccgtgtgaacatgagagctgggacccgaagagaggccaccnccatggaggtcatccgcgacggctgcgagactgggcttctcgagctgctaaccacgcatctccaacaactaatggacaaagtggaacggttaaccaaaggcacttaccccccttgcgggagggccaattccagaatttcccggcccaaacccttgaagccgggcaaaaaaggccccccaactcaagagctggacggggaaaccctttttttttcgcaccttcccgggggctcaaatttgggaaatctcccaaatttaaaaaacccctagggggggtgttaaaacccaaaaaaaaaaaatgtgc

SEQ ID NO: 65322 - DNA, 721 bp, Zea mays
  misc_feature: Ceres CLONE 1536076
  misc_feature: Encodes the peptide sequence at SEQ ID NO. 65323
ggagctccccgcggtggcggccgctctagaactagtggatcccccgggctgcaggaattcgtctcacccctagaaaaacaccgcgccctgcttatccagaaacagacaccgcccttcctatgcgagcggtccacgccgccgaaccctagatccaacgaaccatacggctcaagacctcctcccctcgcgttcaccaaacaccgccgcacacttctaaaaaagttccgcaggaaacgcggcccgcagcacgccctttccccacctcgatctcgcgctaggttttcgccacaccgctctcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgtcgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgagacgctcaggctcaacgagggcgtcgacgtcgatgggcccgaggagggcgaggagaacggcgactacaactacatcca

SEQ ID NO: 65323 - protein, 136 aa, Zea mays
  misc_feature: Ceres CLONE 1536076
  misc_feature (30)..(94): Pfam Name: eIF-1a Pfam Description: Translation initiation factor 1A / IF-1
MPKNKGKGGKNRKRGKNEADDDKRELVFKEDGQEYAQVTRMLGNGRCEATCVDGTRRLCHIRGKMHKKVWIAAGDIVLVGLRDYQDDKADVILKYMNDEARLLKAYGELPETLRLNEGVDVDGPEEGEENGDYNYI

SEQ ID NO: 65324 - DNA, 678 bp, Zea mays
  misc_feature: Ceres CLONE 1536077
  misc_feature (678)..(678): n is a, c, t, g, unknown, or other
ctccccgcggtggcggccgctctagaactagtggatcccccgggctgcaggaattcgtctcacccctagaaaaactccctcacctccgcccctttctctctctctctcgctctcgctccgggcgacggctgggcgaccgccgctttatccgtgcggcccttccttttgttctcccgtccccccaaccccccttcgagctctatctgtctcttcctctcgaggcgacgcctgggctaccgcgccgctactgcggcctcccgcgacaggtgcctagtctccatcaggtgccatgtcttcttcgggctcttcaccggcgacgtgcactgccaggtactgctcctcccccctaccccctcacccctcctcttcaattttctgtgcgaaaccgagcagccaaaccctaaactacgctatttgtattcggatctggtctaattacgcgtgcttacatgtattatgtctactaacctcgattggtttttgattatcagctctgcatgtatacacccaggtcctttactgggtccgacgccgcccctatgtacttcgttagggtttagatggtggttaagtttgcaattctaggggccgggagggaaacctagatctccaaaaggggggaaatttggggggaaatttcccgaaattttcagggaaacaagggcctggaagtttgtn

SEQ ID NO: 65325 - DNA, 649 bp, Zea mays
  misc_feature: Ceres CLONE 1536079
  misc_feature: Encodes the peptide sequence at SEQ ID NO. 65326
ctggagctccccgcggtggcggccgctctagaactagtggatcccccgggctgcaggaattcgtctcacccctagaaaaaaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatcccccccggagaccgcgctgccgtgggtcaagacgggcgtcatccccgcccgcgggcaccctacaactactggggccgactccctacaccgcttctttcgtcttcaaaaatggggcctaatgggggtttcccccgagaaaccggcccccctcccgggaaattggtaacaaacccggggggctcccctgggg

SEQ ID NO: 65326 - protein, 183 aa, Zea mays
  misc_feature: Ceres CLONE 1536079
  misc_feature (55)..(183): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPGDRAAVGQDGRHPRPRAPYNYWGRLPTPLLSSSKMGPNGGFPRETGPPPGKLVTNPGGSPG

SEQ ID NO: 65327 - DNA, 709 bp, Zea mays
  misc_feature: Ceres CLONE 1536081
  misc_feature: Encodes the peptide sequence at SEQ ID NO. 65328
ctggagctcaccgcggtggcggccgctctagaactagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaagctgatggtcagatgcccggtgacaagaccattgggggaggtgatgatgctttcaacaccttcttcagtgagactggagctgggaagcacgtcccccgtgctgtttttgttgaccttgagcccactgtcatcgatgaggtgaggactggcacctatcgccagctcttccatcctgagcagctcatcaatggcaaggaggatgcagccaacaacttcgctcgtggtcactacaccattggcaaagagattgttgacctgtgccttgaccgcatcaggaagcttgcagataattgcactggtctccagggcttcctcgtcttcaacgctgttggtggaggaacgggctctgggcttggatctctcctcctggagcgcctgtctgttgactatggcaagaagtccaagctcagt

SEQ ID NO: 65328 - protein, 168 aa, Zea mays
  misc_feature: Ceres CLONE 1536081
  misc_feature (49)..(168): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLINGKEDAANNFARGHYTIGKEIVDLCLDRIRKLADNCTGLQGFLVFNAVGGGTGSGLGSLLLERLSVDYGKKSKLS

SEQ ID NO: 65329 - DNA, 685 bp, Zea mays
  misc_feature: Ceres CLONE 1536085
  misc_feature: Encodes the peptide sequence at SEQ ID NO. 65330
  misc_feature (528)..(528): n is a, c, t, g, unknown, or other
  misc_feature (587)..(587): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (669)..(669): n is a, c, t, g, unknown, or other
  misc_feature (670)..(670): n is a, c, t, g, unknown, or other
ctccccgcggtggcggccgctctagaactagtggatcccccgggctgcaggaattcgtctcacccctagaaaaacccgtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacggggctcttggaacaagaaagaacccgggaaggagctgattcccttttcttagtgaaaacaacgatgatggagacgaggtgctttcttgcaatggctgaagaaatggggtgtgttcccttccgtatgttggtgggtgtgaaacagggtcatggttttgctcccccccttgggaaacatngggaacaggggaagaaaacttgtgtccttaaaaaaacacttgaaatcccttgccccccnttgggcgccaaaaggaaggaaaactggactttggcccccggggtccctttcccannnnnaaaaaaggccccccccctggggnnattggtttttacacc

SEQ ID NO: 65330 - protein, 54 aa, Zea mays
  misc_feature: Ceres CLONE 1536085
MAMIDEPLYPIAVLIDELKNEDIQLRLNSIRRLSTIARGSWNKKEPGKELIPFS

SEQ ID NO: 65331 - DNA, 665 bp, Zea mays
  misc_feature: Ceres CLONE 1536086
  misc_feature: Pfam Name: Beta-lactamase Pfam Description: Beta-lactamase
  misc_feature: SWISSPROT Homolog: EC 3.5.2.6 Beta-lactamase
  misc_feature (665)..(665): n is a, c, t, g, unknown, or other
aagctggagctccccgcggtggcggccgctctagaactagtggatcccccgggctgcaggaattcgtctcacccctagaagaagccaccgccgccgtctagcattttcctacacccaatctgatctgaccaagccctctgaacacccccgaccatcctcctcctcctcctccgccgccgccgcacaagatgggcttccacgctgtgcctcgccccctactaccgcaacgggtgggggccacatgaactcggccgccccccaccctattcccgtagtgactcgtctgatgactccttagctcactactacatcttacacgatggggtgcgcgtcagagacttgtgccggctgccataggctgaggtgatacactgcggcctacttacttctgacaccaatcggaggacctcaaagactcaccgctgttctgtcaacatgcgagatcatgttcctcctcttgatcgttggcaaccggagctgaatgaagccatacggaactacgagcgtgacaccacgatgcctgtagctatggcaacaacgttacgaaaacgttaggctggcgaactacttgctctagattgagcgcaacaactaatacactggatggcagcggatcaacttgcaggaccacttctgcactgcggccgtccggctggctggtttgn

SEQ ID NO: 65332 - DNA, 717 bp, Zea mays
  misc_feature: Ceres CLONE 1536095
  misc_feature: Encodes the peptide sequence at SEQ ID NO. 65333
tggagctccccgcggtggcggccgctctagaactagtggatcccccgggctgcaggaattcgtctcacccctagaaaaactcacctcgacgcgcctccaaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagccttttgggcccttcgatgtctgttagcggtggcatcaatgtcccagtgatgcggaccccgctctgtgctaatgctcctgctgagaaaggaggcaagaacttcatgatcgatttcatgatgggcggtgtttcagctgctgtttcgaagactgctgctgctcccatcgagcgtgtgaagctgcttattcagaaccaagatgagatgattaagtctggtaggctatcagagccgtacaagggtattgttgactgcttccaacgtaccattaaagatgaggggttctcttccttgtggagggggacacggctaaaggtattcgttacttccctactcacggtttgaaattgcatttaaggacacttcaagaaggtggttacttcaaaag

SEQ ID NO: 65333 - protein, 166 aa, Zea mays
  misc_feature: Ceres CLONE 1536095
  misc_feature (86)..(167): Pfam Name: Mito_carr Pfam Description: Mitochondrial carrier protein
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFQRTIKDEGFSSLWRGTRLKVFVTSLLTV

SEQ ID NO: 65334 - DNA, 606 bp, Zea mays
  misc_feature: Ceres CLONE 1536102
ggtggcggccgctctagaactagtggatcccccgggctgcaggaattcgtctcacccctagaaaaagcagccagccaggcccaggagcgcgagttctgtgcctgtgcctctgctccacctcccctgcccctgcgccccaagtccacgtccaccactcagcactcacgctgctcgctcgctcgctcgaaacgcgcccgcttcgcgcagggaaaagacccttgggaggggaagcggacgggacattaatgcaccgcccaaaggcggggaatccgagaccttgaaaagaaacctttaggaggggttttttcccccctctgttccccaaaaggggggggggggggggccccggaaaagggggggaactaatttaaaaacccctccccggggagtccaaaaaaggggggtaaaaatttttttcccaaaaggaccccccgccggggttttaaaaaccccccacagaggtggggttgtgaacccccttttagggggggaaaaaaacccgcctcctccctctatgaagagttttttctcgcgaaaacctcccaagggggcccccccgggggccccccgggggggtacaaaaacaaagggggggccccccacatg

SEQ ID NO: 65335 - DNA, 725 bp, Zea mays
  misc_feature: Ceres CLONE 1536108
  misc_feature (240)..(240): n is a, c, t, g, unknown, or other
  misc_feature (245)..(245): n is a, c, t, g, unknown, or other
  misc_feature (248)..(248): n is a, c, t, g, unknown, or other
  misc_feature (342)..(342): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (590)..(590): n is a, c, t, g, unknown, or other
  misc_feature (591)..(591): n is a, c, t, g, unknown, or other
  misc_feature (698)..(698): n is a, c, t, g, unknown, or other
aagctggagctccccgcggtggcggccgctctagaactagtggatcccccgggctgcaggaattcgtctcacccctagaaaaaagcccgaaacgcgagcgcaatcaacacccaccattacccaccgcagcaggcagcagcggcgttcgcaatggcggctcgtcttgcctgagcagagcttcaaggagcgcgcgcattggcgccgcccgcggcgtgggccccatcgcccgccgaatccgcncgggncgnccccccgtcccgcgttgtgttggcggacagcttagccagcttgctgcgccgcaggaaagcgaaacgcgcttcccgcgggatggcgggccccccntctggggaacaaaaccttaacccctttctgggggggcccccccttttttcctgggcccccccccccccccggaagagaaccacaaggggaacaaaagccctccggggagaaaattttaggacccccttcccccccgggggaaaaaaggggggccccctcttggggaaaaccaaaaaannnnnnnnnnnnnnnntagggtggagggggaggccccccccnnnnntttttttttcgggcgtgtggggggnntgttggtggcccccccccgggccccccccccggaggggggggcgccccccggggtttccacaacaccccgaaggggggggggggggttttagaagggcttaaaaaantgggccgccgcccccccgccgcgcggg

SEQ ID NO: 65336 - DNA, 661 bp, Zea mays
  misc_feature: Ceres CLONE 1536124
  misc_feature: Encodes the peptide sequence at SEQ ID NO. 65337
ctccccgcggtggcggccgctctagaactagtggatcccccgggctgcaggaattcgtctcacccctagaaaaaagttcagcctcgcaactgccaccagatctttcagcactgactgccgtcgttgctgcatcaaatctgtcttggcaggtgtagctaccagctagctataggtggctcgttggagagatgagggccggggggtgcacggtgcagcagtcgctgacggcggaggccgcggcggtggtgaagcaggcggtgagccttgcgcggcggcgcgggaacgcgcaggtgacgccgctgcacgtggcgagcgcgatgctggcggcgcccacggggctgctgcgcgcggcgtgcctccgctcgcactcccacccgctgcagtgcaaggcgctggagctgtgcttcaacgtggcgctgaatcgcctccccgcgtcggccgcggtcacctcgtcgccgctgctcggcgggcacggccaccaccaccaccactactacccgccttccctgtccaacgcgctcgtggcggcgttcaagcgcgcgcaggccacaagcggcggcgggtccgtggaaagcaacaacagccgggtgctcccgtcaaaatcgagctgaaaccacctcgtgggtgtcatccctgaaaaccccagggtaaggccggggga

SEQ ID NO: 65337 - protein, 140 aa, Zea mays
  misc_feature: Ceres CLONE 1536124
MRAGGCTVQQSLTAEAAAVVKQAVSLARRRGNAQVTPLHVASAMLAAPTGLLRAACLRSHSHPLQCKALELCFNVALNRLPASAAVTSSPLLGGHGHHHHHYYPPSLSNALVAAFKRAQATSGGGSVESNNSRVLPSKSS

SEQ ID NO: 65338 - DNA, 631 bp, Zea mays
  misc_feature: Ceres CLONE 1536131
  misc_feature: Encodes the peptide sequence at SEQ ID NO. 65339
tggcggccgctctagaactagtggatcccccgggctgcaggaattcgtctcacccctagaaaaaccgaatccccagaccaaatcgccgtcgccgtcgcatcgcagcagcgggagtcccagggtcccggaccgaatccatttccagacacccaaggccaagatccatcgctcgttccagccagcctttcttcttcttctgcttggtcgtctgatctcgttttccattcgtgtccaatccgatccagccaaccgctgtgaatgatggcgctcaacctgtcccaccagaccggcgcggacgtggcggcggcaccggcggcgccacgcgcggccgtcgtcgcggcggcggccacggcgccacgctcggccgtcgtcgccgcggaggacaccgtggcgccgccgcccgcgtcggcgcccggccccgctccggcgctccagctgcagacgatgacggtggacccggcccccgcgcaggcgcccgactcggtgaagccggacctcgccatggcgtgccatgcgctggtggaggccgcgcccgaagcggagcacgcctacctggcccgcgaagctcgggagcaggggccggggtgccacgtcttcgttattgatgaccgctcgacaccgttgggcaacg

SEQ ID NO: 65339 - protein, 123 aa, Zea mays
  misc_feature: Ceres CLONE 1536131
MALNLSHQTGADVAAAPAAPRAAVVAAAATAPRSAVVAAEDTVAPPPASAPGPAPALQLQTMTVDPAPAQAPDSVKPDLAMACHALVEAAPEAEHAYLAREAREQGPGCHVFVIDDRSTPLGN

SEQ ID NO: 65340 - DNA, 645 bp, Zea mays
  misc_feature: Ceres CLONE 1536133
  misc_feature: Encodes the peptide sequence at SEQ ID NO. 65341
  misc_feature (588)..(588): n is a, c, t, g, unknown, or other
  misc_feature (623)..(623): n is a, c, t, g, unknown, or other
caccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaatgcaccagggacagggaagcgacctccttcgcccgccggatcggtcgcagcgccgaaggcccccgcacgcccaagcccgccggcgtcatccgctccgactccggcgcgggacggggccagcattgctcgccgctgaagggccgtcgttgagcccccgccgatacagacgacaaaaagaaggtggttccactttcggcaagggcaagagcgagggcaaacagaccatgaaaggaactgctggggcggcagggcgcnaaactgggcggagatggcgagcatccgggctgtcngtgcccccggggggttcacggg

SEQ ID NO: 65341 - protein, 160 aa, Zea mays
  misc_feature: Ceres CLONE 1536133
  misc_feature: SWISSPROT Homolog: EC 2.7.9.1 Pyruvate, phosphate dikinase
HRGGGRSRTSGSPGLQEFVSPLEKTRSPLTFSLYSLATHTPSPAPLELRTAAGAGRSRSKQLSAPSPLAPYDRATHRATRVDCLPWVGAGGDRKDGGVGFQGHLRSEAGLKCTRDREATSFARRIGRSAEGPRTPKPAGVIRSDSGAGRGQHCSPLKGRR

SEQ ID NO: 65342 - DNA, 669 bp, Zea mays
  misc_feature: Ceres CLONE 1536136
  misc_feature: Encodes the peptide sequence at SEQ ID NO. 65343
  misc_feature (261)..(261): n is a, c, t, g, unknown, or other
ggagctccccgcggtggcggccgctctagaactagtggatcccccgggctgcaggaattcgtctcacccctagaaaaactttttccccttcacagccccgtactactatccccgctaccgctagccgccgcgctgctcatctggtggcggctcgcctccctcaccccatccgccgccgccggctcctcctctagctccctccttaccccgagctttaagctcgtgctacctgcctacctatccgtagggagagagagaganaggggagaaggttcggtcggtcggtcaggggctctcggatctcgccgctgcctccccgtttcttcgttgggatctcgctcgcttcgcgccatggccgccgtcgcgactccaccggcccccgcgcccgccgcaccggcaccggcaccggcaccgggtgctgctccggctcccgtcaccgtctcccctgcagcggaccaaaccacggatctgctgcagaagttgtcgctggattcgcagcccagggagaggagcgcgacagaacctgctgctgctgccgctgcccccaacgagggtgctagtgacaaacagcgcgctgagtgtgaccatcccgacagatcggtctatcacgccggtgcttcaggactttatggataccaacctgttctatctagcagcgtattactatgg

SEQ ID NO: 65343 - protein, 106 aa, Zea mays
  misc_feature: Ceres CLONE 1536136
MAAVATPPAPAPAAPAPAPAPGAAPAPVTVSPAADQTTDLLQKLSLDSQPRERSATEPAAAAAAPNEGASDKQRAECDHPDRSVYHAGASGLYGYQPVLSSSVLLW

SEQ ID NO: 65344 - DNA, 666 bp, Zea mays
  misc_feature: Ceres CLONE 1536139
  misc_feature: Encodes the peptide sequence at SEQ ID NO. 65345
  misc_feature (391)..(391): n is a, c, t, g, unknown, or other
gcggtggcggccgctctagaactagtggatcccccgggctgcaggaattcgtctcacccctagaaaaactctgttcccactcattaagatcccaccgcctcccgccggccgccgccgacgagcaccgcagcctgacacagagccgcgggcgagccatcgcgtgcggcctcgcccgggatggcgaccatggagagcctgatcgggctggtgaaccggatccagcgcgcgtgcaccgtcctcggcgaccacggcggcggcggcggtgagggctccctctgggaggcgctcccctccgtcgctgtcgttggcgggcagagttccgggaagtcgtcggtgcttgagagcatagtacggagggacttcctgcggcgtggatctggtatcgtcacgnaacggcctttagtgctgcagctccacaagacagatggtgggcacgagtatgctgagtttctccacgccccgcggaagcggttcaccgactttgctgctgtgaggaaagagattgctgatgacacagaccgcattactgggaaaactaaagctatgtcaaatgttcccatccatttgagtatatattcccccacatggtgttaaacttgaccctttttgatcttcccggaacggacaaggtcgcctgtcaggggcaaggcaaatcttttggttcag

SEQ ID NO: 65345 - protein, 138 aa, Zea mays
  misc_feature: Ceres CLONE 1536139
  misc_feature (40)..(138): Pfam Name: Dynamin_N Pfam Description: Dynamin family
  misc_feature: SWISSPROT Homolog: EC 3.6.5.5 Dynamin GTPase
  misc_feature (72)..(72): Xaa is any aa, unknown, or other
MATMESLIGLVNRIQRACTVLGDHGGGGGEGSLWEALPSVAVVGGQSSGKSSVLESIVRRDFLRRGSGIVTXRPLVLQLHKTDGGHEYAEFLHAPRKRFTDFAAVRKEIADDTDRITGKTKAMSNVPIHLSIYSPTWC

SEQ ID NO: 65346 - DNA, 2499 bp, Zea mays
  misc_feature: Ceres CLONE 1536141
  misc_feature: Encodes the peptide sequence at SEQ ID NO. 65347
aaaatcgcaggctacatacaaaatcccacgccggccggacgctagcgaaagcctctcgcgctccgcctccgtcgtccggagcgcccgcgtaaagccaaacaccaaaacctcccttttcccccgttccgttccgtcccgtcccccacccctctcctccaaccccggtctcgcgcgatccgccgatccggtttccccgcgcccggccgcccgtcccgatcccgccgctgtgtcggcggcccggttccgccctccgttccgtcgccttgcggcctgccgttgatgtggcgtggcacggggcccgtgcttcggttttgagagctctcgtgtcggtgcggagaggcccgcggcggtctttcaatgaggcggcggccggtcctgccggcccaccacgacgacgtggacaagggcggcgggaagccggcgtcgtcgcgcctctgcttcctcgccacgctctgcgccatgttctgggtcctcatcttctacttccacttcgccgtcgtctccaacgaccccgccgcctcggcggcgcagggcgccgaggcccgcattgccggcgcccacacccgcattcccgaacgcgacggcgcgtcccgcgtcgacgttcccctcgccttcgcctcggagtcgccgccgccgccgcctcctcctcctcctgtcgcgcggcccaaggaggcggaggacgaggttgccgccggagtccgccgggaggaggcgccgccccaggccgcggcgccgtacccgttcgagcgggcgctcaggacggcggagaaccagagcgacccctgcggcggccggtacatctacgtgcacgacctgccgccgcggttcaacgaggacatgctccgggactgcgagaagctcagcgtctggaccaacatgtgcaggttcatgagcaacgacgggctcggcccgccgctgggcaacgaggagggcgtgttctccgacaccggctggtatggcaccaaccagttctccgtggatgtcatcttcggcaacaggatgaagcagtacgagtgcctgaccaaggactcgtccgttgccgcggcggtgttcgtgccgttctacgctgggttcgatgtggcaaggtatctctggggctataatatcacgacgagggatgcggcgtcgcttgatttggtggagtggctgatgaacaagcccgagtggagcgtgatgggtgggcgggaccatttcctggttgccgggaggatcacctgggatttcaggaggttgacggaggaggaagcagattggggcagcaagctgcttttcttgccggctgccaagaacatgtcgatgctcgtggtggagtcgagcccgtggaattcaaatgattttggaataccatatcctacgtacttccacccggccaaggacgctgaggttttcctttggcaggataggatgaggagcttggaacgcccatggctgttctcgtttgcaggcgctccacgtcctggtgatccaatgtccatcagagggcagctcatcgatcaatgcaggagctcaagcctttgtaaattgttggagtgtgaccttggggagagcaagtgccactccccgagcacaatcatgaagatgttccagagttctatgttctgtttgcagccccagggtgactcctacacaagaagatctgcctttgactcgatgttggctggctgcgtgcctgttttcttccatcccggttcagcgtacgtccagtatacatggcatctcccaaagaactatacaacgtactctgtattcatccctgaagatgacgtccgttctggaaatgccagcattgaggagaggctaaagagtattcacccagatgtggtcaagcaaatgagagaggaggtcatcaatctgataccaaaggtgatatatgctgatccaagatcgaaactggagacattgaaagatgcatttgatgtttccatagaggcgatcattaacaaagtgacaaagttgagaagagatatcatcgcaggccaagaagacaaagattttatcgaagagaatagctggaagtatagtctgttagacgatggacagcggacaattggacctcacaaatgggatccattcttctcgaagcctaaagataaaggtggagattctagtggttcatctgctgaagctgccaagaattcttggaaaagtgaacaaagaggacaggattgaaccatgagttggtcgtctttgggatgagatcaagggagtagagttagctatactctctgaagattgctctgatgcatataggttgcacatagatcaagatccagtagttatggtgatcatgaacatcattgatgatctatgtcaccctgcagttgtatgaagccattccatcaaaaatgctttggggaaatttggaagacagcctttgcgtaccccctatgaatactatttttcacactaattttgctgtttctgctcaataatcctttgtaaacccttacatgatttagaggtatatcaaattttgtttctgaaaaaaaaaaaaaaaaa

SEQ ID NO: 65347 - protein, 603 aa, Zea mays
  misc_feature: Ceres CLONE 1536141
  misc_feature (148)..(496): Pfam Name: Exostosin Pfam Description: Exostosin family
MRRRPVLPAHHDDVDKGGGKPASSRLCFLATLCAMFWVLIFYFHFAVVSNDPAASAAQGAEARIAGAHTRIPERDGASRVDVPLAFASESPPPPPPPPPVARPKEAEDEVAAGVRREEAPPQAAAPYPFERALRTAENQSDPCGGRYIYVHDLPPRFNEDMLRDCEKLSVWTNMCRFMSNDGLGPPLGNEEGVFSDTGWYGTNQFSVDVIFGNRMKQYECLTKDSSVAAAVFVPFYAGFDVARYLWGYNITTRDAASLDLVEWLMNKPEWSVMGGRDHFLVAGRITWDFRRLTEEEADWGSKLLFLPAAKNMSMLVVESSPWNSNDFGIPYPTYFHPAKDAEVFLWQDRMRSLERPWLFSFAGAPRPGDPMSIRGQLIDQCRSSSLCKLLECDLGESKCHSPSTIMKMFQSSMFCLQPQGDSYTRRSAFDSMLAGCVPVFFHPGSAYVQYTWHLPKNYTTYSVFIPEDDVRSGNASIEERLKSIHPDVVKQMREEVINLIPKVIYADPRSKLETLKDAFDVSIEAIINKVTKLRRDIIAGQEDKDFIEENSWKYSLLDDGQRTIGPHKWDPFFSKPKDKGGDSSGSSAEAAKNSWKSEQRGQD

SEQ ID NO: 65348 - DNA, 628 bp, Zea mays
  misc_feature: Ceres CLONE 1536144
  misc_feature: Encodes the peptide sequence at SEQ ID NO. 65349
tggagctccccgcggtggcggccgctctagaactagtggatcccccgggctgcaggaattcgtctcacccctagaaaaaacggggcggggctagccaaccagaccaacccaaaccctagctcaccgctcgttccattccaatccatggaggtggcgctatgagccgccgccgggacggcgggacgtggagctggtgcggccggggaagacgagtcgaggatgacggccagatcggacgatcccggcgtctcccagggaaccgttcggcggcggcgggcggcgagatctggggcacgtgggaggagctcctcctggcgtgtgccgtacggaagcacggtaccgccagctgggactccgtggccatggagatgctgtcccgctgccctcccgccgcggccgacagcctcacgcccgctgggtgccgcctgcggtatcgcctgctccaccgccggttcaccgccaccgccgccgccgccgtaaacggtgacgaggagcccgacgcggcctccgccgactgctgcgtggaggagctccgcaagctgcgcgtcgccgagctccgccgcgaggtcgagagatacgacctctcgatcgggtcattgcaatctagagtggaaaggcttaaagagga

SEQ ID NO: 65349 - protein, 156 aa, Zea mays
  misc_feature: Ceres CLONE 1536144
  misc_feature (41)..(96): Pfam Name: Myb_DNA-binding Pfam Description: Myb-like DNA-binding domain
MSRRRDGGTWSWCGRGRRVEDDGQIGRSRRLPGNRSAAAGGEIWGTWEELLLACAVRKHGTASWDSVAMEMLSRCPPAAADSLTPAGCRLRYRLLHRRFTATAAAAVNGDEEPDAASADCCVEELRKLRVAELRREVERYDLSIGSLQSRVERLKE

SEQ ID NO: 65350 - DNA, 696 bp, Zea mays
  misc_feature: Ceres CLONE 1536152
  misc_feature: Encodes the peptide sequence at SEQ ID NO. 65351
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (332)..(332): n is a, c, t, g, unknown, or other
  misc_feature (408)..(408): n is a, c, t, g, unknown, or other
gcggtggcggccgctctagaactagtggatcccccgggctgcaggaattcgtctcacccctagaaaaagactgctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgccgcgccgtgatcggggctggtgggccactggccatcgnnnnntncggcgggcgccttgtcgcanggcggcgcgccgccaaagaccgttcaagacccatcaagattggagccccgccgccgcccctcgggtggactccccngggactctcaactctgaccagggcgagggacttccaacctccccttgaaggaagggttttaacctgaaaccccctgccccccgggggaagggggcgcaaaggggtaaaaacttcgggccaggaaatttttaaccctaaagccctttttttaaaaaaaaagggggggccctaatcccaaaaaaacccccccccccgggggccccaaatttggcgtaagaacctaaagaagcttttttttttttcacccccaaggggggaaaaaaaaaaaccccccggggggcccccccg

SEQ ID NO: 65351 - protein, 110 aa, Zea mays
  misc_feature: Ceres CLONE 1536152
  misc_feature (55)..(55): Xaa is any aa, unknown, or other
  misc_feature (56)..(56): Xaa is any aa, unknown, or other
  misc_feature (57)..(57): Xaa is any aa, unknown, or other
  misc_feature (64)..(64): Xaa is any aa, unknown, or other
  misc_feature (89)..(89): Xaa is any aa, unknown, or other
MASMTGLSQGVLPSRRADSRTRTAVVIVRASAEGDAVAQAGRRAVIGAGGPLAIXXXGGRLVAXRRAAKDRSRPIKIGAPPPPLGWTPXGLSTLTRARDFQPPLEGRVLT

SEQ ID NO: 65352 - DNA, 661 bp, Zea mays
  misc_feature: Ceres CLONE 1536154
  misc_feature (640)..(640): n is a, c, t, g, unknown, or other
ggagctccccgcggtggcggccgctctagaactagtggatcccccgggctgcaggaattcgtctcacccctagaaaaccccccttttgcgccctttttctttctttccgttgcccttttcccgttccctgccccttcttctccgtctttctccggtcggctttggagaaagaggtgatgtgaggttcccatcactcacgcctggctgggtagctagatgctcccgggccgtctttattacggctgtcgccggtctgggctgcggtcggcggcggaggggagtcttctggcggagatatgagagggttgttttggtgaggtctatgagctggtaccagaactgctcataatattcagggaaaaaaaaaaaggcaacatggcggaatcgaaggtcgcaagtctggatgcccgaacgacgaagatcagaaacgtccccatcgcagtgaccccagaagggttctggtgctgcccgtcgcaagccgtgctccagaagacggcgaagagccaaaacccgcaggcgaagacgaagcccagagggggtgcctcgcctctcgcaccaaaggcggcaccaccaatccagagggcgcccacaatctcgtccgagagaaggacgcactcgactccgacgagggcgaagaccnactcagaggagcagaggtgct

SEQ ID NO: 65353 - DNA, 658 bp, Zea mays
  misc_feature: Ceres CLONE 1536156
  misc_feature: Translation starting site: 175
  misc_feature: SWISSPROT Homolog: EC 5.2.1.8 Peptidylprolyl isomerase
  misc_feature (402)..(402): n is a, c, t, g, unknown, or other
  misc_feature (519)..(519): n is a, c, t, g, unknown, or other
  misc_feature (520)..(520): n is a, c, t, g, unknown, or other
agctccccgcggtggcggccgctctagaactagtggatcccccgggctgcaggaattcgtctcacccctagaaaaatgctttcttagaggtgggttggcttctcctccccctccggttcgggttcgggttcgtgaggttctccggggttcggtttcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggagggatgcgatgcgcgaacgccatcgagggcatgaacggctaggagctggacnggcgcaacatcaccgtcgacgaggcccagtcccgcggcggccgtggaggctgcggctgtgagtaccgtggtggcccgttgagggggctgctacggcgtggcgggccccctgatggcnngccgcggctacggtggttgcggcggcggctacggtggccggcgcggctacggggggtggtggcgggggctaccggggggcgaccctgggggggggctacgggaactcccaccgggaattggaggaactgggggggggt

SEQ ID NO: 65354 - DNA, 683 bp, Zea mays
  misc_feature: Ceres CLONE 1536160
  misc_feature: Encodes the peptide sequence at SEQ ID NO. 65355
tccccgcggtggcggccgctctagaactagtggatcccccgggctgcaggaattcgtctcacccctagaaaaaatgcgtggtaggccattccccattcccacataggagtattttccaatccataacccacgtcgttgaaccagcaaaacgtttccctttcccgttccgactccgatccaaaatccattgaccgcctgccttttcttctcccgtccaccgtgtgcgggctgcggggagcgctctcctgccgctactaggcgaccgccgccgccgtcctacgtgctcgggtccttcctcggctatcaacacctaccagttctaaggcgtacatgtacactcccctgtccttcaccgggtccacccctgagtcttccgatcgcaataatcaacctgcaaaaaagcaaactcgacaatgggcagcgtggacacacctagaggaggagaatttcttctatgcactgctggaagtaggcaaaaacttcgacaagattacacaccgggtgtcagagtataatcaaggaatcgggtcagggattactatgtagcgccttgtaagaccgcttgtaagaaactaattggggacctacggtttctgaaattggattgcaaataactcccgaggggttccccgtttgcctgcctatgccgtttcgcttggacgggaacttcggccttggaagag

SEQ ID NO: 65355 - protein, 71 aa, Zea mays
  misc_feature: Ceres CLONE 1536160
MYTPLSFTGSTPESSDRNNQPAKKQTRQWAAWTHLEEENFFYALLEVGKNFDKITHRVSEYNQGIGSGITM

SEQ ID NO: 65356 - DNA, 665 bp, Zea mays
  misc_feature: Ceres CLONE 1536165
  misc_feature: Encodes the peptide sequence at SEQ ID NO. 65357
ctggagctcaccgcggtggcggccgctctagaactagtggatcccccgggctgcaggaattcgtctcacccctagaaaaactcgtgcggatgaacccaaccatcttggccggagggtgaatggtgatacggtgaaggcagacgccgcaacaaaccgaacggcgaaggcgtagaagaccaaccaaagcttagcctacgggatctccctctcattccagaggactccgcgtcgccaggcccgcttctcgtgcgacgccggcatatagggtttcgccggcgccggctatggatcctccccccgtgagccccgatcgctgggggcccagtctgggcgctggcgtctggccctccggcctccgccgatatggcctcaatttctcctccttcagcatcgtcatggtccccaaccccaccctccttgagtactccggcgtagtccagtccggccctgccctgacggtgctcctcctgtccacggggccctcgtcgccgttgtcctcgtgagatgtagatggtcttctctcctctgacgcccctgggaacgggaaggtttcgattcctgattcagggcggaccctcatgactcggatgcctacgggggagccagaatgctggggacttctttccaaggattttgatcctaagcgaacctccagtttcctaacg

SEQ ID NO: 65357 - protein, 72 aa, Zea mays
  misc_feature: Ceres CLONE 1536165
MDPPPVSPDRWGPSLGAGVWPSGLRRYGLNFSSFSIVMVPNPTLLEYSGVVQSGPALTVLLLSTGPSSPLSS

SEQ ID NO: 65358 - DNA, 665 bp, Zea mays
  misc_feature: Ceres CLONE 1536166
  misc_feature: Encodes the peptide sequence at SEQ ID NO. 65359
  misc_feature (495)..(495): n is a, c, t, g, unknown, or other
  misc_feature (581)..(581): n is a, c, t, g, unknown, or other
ccgcggtggcggccgctctagaactagtggatcccccgggctgcaggaattcgtctcacccctagaaaaaacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtgggagtgcctacattaagtacatccgccctcaggatgctggatgggatgccaanggagtttgatatgagactccatacactattatgtttggtcccagataatgtggggtcaccaacaggttcatttcatccttaagcancagaatcctagactggaaagtatgttgagcatcacctcaaattccaccttctgtcaatacgacagctctctcatgtctacaagc

SEQ ID NO: 65359 - protein, 123 aa, Zea mays
  misc_feature: Ceres CLONE 1536166
  misc_feature (24)..(123): Pfam Name: Calreticulin Pfam Description: Calreticulin family
  misc_feature (121)..(121): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGSAYIKYIRPQDAGWDAXGV

SEQ ID NO: 65360 - DNA, 640 bp, Zea mays
  misc_feature: Ceres CLONE 1536167
  misc_feature: Encodes the peptide sequence at SEQ ID NO. 65361
  misc_feature (269)..(269): n is a, c, t, g, unknown, or other
  misc_feature (270)..(270): n is a, c, t, g, unknown, or other
aagctggagctccccgcggtggcggccgctctagaactagtggatcccccgggctgcaggaattcgtctcacccctagaaaaatccccttcgcccgcccgcccaaccaccatgtctcgacgcggggcaatgccatccaccgccccgcgcgcgcggctctcgccgccggcacccgcctcccaccccgcgcggaaacgtggccgctctcccatcgctcctggaaagcacgcgtcgtggcgcgcgtccgccgagaaacacgtgcccctctanncacgcgccgctgggacaccccggagcgtgcccctgggcgcgtctgggcacgggtccccgggccccacctggcttactttcctcagggtttggatttctcggaggacccctcaccccctcctcggaaagcctgccctacatggcaaaaacttctgggcagataacaagccggaaaaccccccaccttttttggagagcccccgggaacccaaggggggggttccagggggggccctttttttcccgaaaaaagcgccccggggcccccccccgtggggggttcccaaggagggaaagttgtttccaaaactcttccccccaaaaaaaaaaaaaaaagggccccaaaattttttttcccgcgggcccccgga

SEQ ID NO: 65361 - protein, 176 aa, Zea mays
  misc_feature: Ceres CLONE 1536167
  misc_feature (53)..(53): Xaa is any aa, unknown, or other
  misc_feature (54)..(54): Xaa is any aa, unknown, or other
MSRRGAMPSTAPRARLSPPAPASHPARKRGRSPIAPGKHASWRASAEKHVPLXXRAAGTPRSVPLGASGHGSPGPTWLTFLRVWISRRTPHPLLGKPALHGKNFWADNKPENPPPFLESPREPKGGVPGGALFFPKKAPRGPPPWGVPKEGKLFPKLFPPKKKKKGPQNFFSRGPP

SEQ ID NO: 65362 - DNA, 679 bp, Zea mays
  misc_feature: Ceres CLONE 1536168
  misc_feature (399)..(399): n is a, c, t, g, unknown, or other
aagctggagctccccgcggtggcggccgctctagaactagtggatcccccgggctgcaggaattcgtctcacccctagaaaaacttttccgctccagacacagcacgcccctcttgtaccagtaaaccgtgctgctatcccccgctagccgacaagatgctgagactcgactacctcctccccagtgcccacggcccgccgacgtcgccggaacctcctctagctcgctcacttttacccctagcttaagctcgcgcgtacctgcctacctatccgtatgagaggaagaggggacaaggcccggtcggtcggtcagtcggtcaggtggatctcagatctagcatctgcctcgccgttcgttcgttcgttcgtcgggatctcgggccatgggcgctgtcntgccgcccacgaccccgtgcgagcacctgttcctgctctgctgctgcactgtccatgttcgatcaaacaacgatctgctgcatagcagtagctcgattcgcaacccaaccggaggagaaaaattacctgctgatagcaacctaaaaaaggtaccgcgtgaaacaaacctaaacttggggaattcccccagaaccttccttcaagtcggggaagaaaaattttacggatccaaccggtttttaaaaaaaaggtttatacaaggaggccacaaagttcccaa

SEQ ID NO: 65363 - DNA, 2768 bp, Zea mays
  misc_feature: Ceres CLONE 1536169
  misc_feature: Encodes the peptide sequence at SEQ ID NO. 65364
aagcaaagcacctccgactccgagtcgcgagagccttctcattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaaaaaaaaaaaaaaaaaaaaaaaaaaaaaaagaaaaaaaaaaaaaaaaa

SEQ ID NO: 65364 - protein, 720 aa, Zea mays
  misc_feature: Ceres CLONE 1536169
  misc_feature (24)..(69): Pfam Name: Myb_DNA-binding Pfam Description: Myb-like DNA-binding domain
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 65365 - DNA, 514 bp, Zea mays
  misc_feature: Ceres CLONE 1536170
  misc_feature: Encodes the peptide sequence at SEQ ID NO. 65366
  misc_feature (216)..(216): n is a, c, t, g, unknown, or other
ctccccgcggtggcggccgctctagaactagtggatcccccgggctgcaggaattcgtctcacccctagaaaaagcaggcacacaacacaacacagttctccctttccactccagtccaaccaaccgtccatgggtttcttcatcccgccgcccaaggtgtacaagccggcggcagaggtcgacctcgggccggacagcgacgagcactacatcangccccaaaccgtgaaagcgcccccgccgtggcccgggtttcccttgggtgaaaaaagctagcctgggtcttgaaaccccggctggctgatccgctccgcccctcaaaggaaacttcgttaaagttgttctgaacctaaaacggggaaccccgttttccgggccccccccttgggaaagttcccgaaaaaaacgtcccctaaaaaaaaaaagttttccccgggaaacctcaaaaaaagcctcctctttttccccatttggccaacacccttttgggagggggggggggggtttttaccc

SEQ ID NO: 65366 - protein, 48 aa, Zea mays
  misc_feature: Ceres CLONE 1536170
  misc_feature (29)..(29): Xaa is any aa, unknown, or other
MGFFIPPPKVYKPAAEVDLGPDSDEHYIXPQTVKAPPPWPGFPLGEKS

SEQ ID NO: 65367 - DNA, 726 bp, Zea mays
  misc_feature: Ceres CLONE 1536173
  misc_feature: Encodes the peptide sequence at SEQ ID NO. 65368
  misc_feature (726)..(726): n is a, c, t, g, unknown, or other
tggcggccgctctagaactagtggatcccccgggctgcaggaattcgtctcacccctagaaaaaagtgattcagccgccagtcccgctcgtctctgccaagtcccgcgcgctcgagcatcgatcagccgctggcgccgcgacgagcgacgacgccgcgccagtcgcagatgggcgccgtctcgctcctgcgatccgcggcgctcgggctggtggtcctcgcgtcggcgctgccggcggctcggccgtggagcaaagagggtcccgtgctcacatgccaaatcccgcccgtgaaaaccaatcggatcctcgaggctataccgctatgaagtaaaaaggatttttttccccccccccggggggggggggggggcgacttggtcttctttaaccttgtgttgtggaccccccctacgaaaatgtgtcccgggacaacgcccgggggggcacctggtccgcccccttttggccggtggccccgcccgagactatgtctcggtttccccgtgtcctaggtggaacgggtctcctttcccctgccttcaaacccccgccgtacagtggcttgtcgctgtttttatttattcctgggcttgtgggattatttatccgcgctgcggcgggggctgtgtttctctcccgaccaccgtcgcctgcatcctcataagccctgcttctccccccccctctctctccttcctggtggcccccccccccacgtcagctcn

SEQ ID NO: 65368 - protein, 52 aa, Zea mays
  misc_feature: Ceres CLONE 1536173
MGAVSLLRSAALGLVVLASALPAARPWSKEGPVLTCQIPPVKTNRILEAIPL

SEQ ID NO: 65369 - DNA, 753 bp, Zea mays
  misc_feature: Ceres CLONE 1536174
  misc_feature: Translation starting site: 114
  misc_feature (165)..(165): n is a, c, t, g, unknown, or other
  misc_feature (169)..(169): n is a, c, t, g, unknown, or other
  misc_feature (170)..(170): n is a, c, t, g, unknown, or other
  misc_feature (213)..(213): n is a, c, t, g, unknown, or other
  misc_feature (236)..(236): n is a, c, t, g, unknown, or other
tccccgcggtggcggccgctctagaactagtggatcccccgggctgcaggaattcgtctcacccctagaaaaaaactttaattacgattattccagataagcacgatccgatgatggccccaccgatatccgccgatgccttggtggaagctgcctcggccgtcncccnntacccaaccatcccccccaacataatgctttgtaaggaagttncggtggtggtcatctctgtcgtnttgaaagagagagtccggcccgacggaaagtttgatgtggttcccactggagaacccaggctctcagtgtcggacatccctatgctctcccgccaccaaatacaagaagattttttttttcccccccccagggggggggagggaacaccatcttttcttatatccatattttggggggcgcccacccctcacaccccgcgccgcgcccttcccccgggggcgggcgggccggctccttccagctccccccgcaaagagaaccgtctcccgacacccggcgcccctgcccccagacacagccgcccctccgcgtgtgtaccccaccgcgcgcccgccccttaccgtatgcgcccatgacgctcctgctgcgatcacgtgtccctcgcgtaaacgcccccgcccccccgtaccaagtgaatccgcgccgcgctccacgtgtgttctctccttcctgtggacagccccgccctcaacaagaatagataagctatcgtctcaccgcacaccgtcagtgccg

SEQ ID NO: 65370 - DNA, 2354 bp, Zea mays
  misc_feature: Ceres CLONE 1536175
  misc_feature: Encodes the peptide sequence at SEQ ID NO. 65371
aamactacactggagctctccctcaatcagcatgccgcgcgtccacgaccgcccaccgccacccatgacttctctgtcgctccacctccaccacctccttctcgcgctacttgcagcatcagccgcgcaggccaccgaccccagcggctgcggcgggggcgaggaccgctgcggcgacctcgtcctcccgtaccctttccatctcaactcttcctgtgccagcgccggagccaactcctccctcttccgcctctcctgcaacgccagcggcagcgccaccctcaccctcgcgctcggctccgccacattccgggtcctcgccttcctgccctcagggtcgctcctcctcgactacgccccagctgcgtcgaagtccccgtgcgacgcggcctacgccgccttctcgcgcccttcctcgccggcgaccgcgctcgacgccgcgcccttcctctccgtgacgccggccaacgtgctccgcctctacgcctgcgaggactcctccctctgccgcgccgggtgcgacgacgtcgcgacctgcggcggcaggtctgggtgctgctacccgctctcggacggcagcgtctggaagcccgggaacggactgggcgttttcgctgactacgggtgccggggcttctcgagctgggtcaggaaccggtcggcgccggcgggggcggcacgcggggtcgtgaggggggtcgaggtcgagtgggccgtgccgaggggcagcgccatggcgaaatgcgcggatggcgcggcgctcgtgaatgccacggcgctgcacgacggcgtgcggtgcgcgtgcgcggcgggcctcgtcggggacggcttcgcgcagggcactggctgcaccaaaggcacctgtaagtacaaaagtgcacacggttctacagtactcgtgcgatcgatctgtcacgtcgacctatcacctgaaaacacgtacgcatctgttgtgtacatacactacacagcctgcagcaatggtggtggtgagcatgcaagtgacggcagggattgttgccagggacggttctgctccaggaaggcagtcgtccttgctggatttttcgtttcgctcttcttcctggcggcggcggtctcgttctggctcttcctgaggcagccttcaaaggaaagccgccggtgggacctcgacccggcgtgcatccccaagatcctgcggagcgtgtgcgacgcgaggcagttcacgtacgagcagctggaggaagcgacgaggagggtcgacggcgagaaggccgtggacaccgccgacgacggcgcggtccacgccggcgtgctcgacgacgggtccctggtggcggtgcagaggatcggctacgagacgcaggggaggctgaggctggtcctggaccggatggagctcctgtcggagatctcgcacccgagcatcgcgcgcgtcgtgggcttctgcctcgactccagcagcaacgcgctgctgctggtgcacgagcacttcgcggggggcacgctggaggagcacctgcgccaggtgaggcgccgcgtcgtcctcagctggtaccaccgggtcaacatcgccatcgagctcgccagcgcgctcacgtacctgcaggcgcacgaggcggccccgaccttcctgcacgacctcaggtccagcgacatcttcctggacgccggcttcaccgccaagattgccggctacaagctcacgggcccggcgacggcgtgctgctccgccgccgcgtcgtcgtgtgagcaggacgtcgtgtgcaacttcggccacctcttggtcgagctgctgacggggctgaggcagcaggtcccgctcgactcggtggcgcccaaggtgagggaagggcgggtccacgaggtcatcgacccgacgcttctgtcgtcgggtggtgggaatgggaagcagctcccggcctcgcacgacgaggtgaggaaggtgttcgagctcgccgtccgctgcctgtcctgcgccgagaccggcctgtgcatgctcgccgtcgccaaggagctgatgcacattctgagggacaacaacgggagcagcagcaagatcgagatctcccttgaggagacgttctctagctccagcctgctgcagatgatctccatgtcgccggagacactgcaccaccatcttccttaattagccagtccgatccgacgatggtccgcttgttaatatccagagcagagcagttctgctcaatcaaacagctctgctgctagctcccaagtccttgtgctctgcctgcggagacgcgttacgctgcagtcaatgcgataatgtttatgactcccgagaatttccgtctgaattatgtaacatggctccagactccagtacatagtggcgcgcgaaaaat

SEQ ID NO: 65371 - protein, 700 aa, Zea mays
  misc_feature: Ceres CLONE 1536175
  misc_feature (416)..(657): Pfam Name: Pkinase_Tyr Pfam Description: Protein tyrosine kinase
  misc_feature: SWISSPROT Homolog: EC 2.7.11.1 Non-specific serine/threonine protein kinase
MPRVHDRPPPPMTSLSLHLHHLLLALLAASAAQATDPSGCGGGEDRCGDLVLPYPFHLNSSCASAGANSSLFRLSCNASGSATLTLALGSATFRVLAFLPSGSLLLDYAPAASKSPCDAAYAAFSRPSSPATALDAAPFLSVTPANVLRLYACEDSSLCRAGCDDVATCGGRSGCCYPLSDGSVWKPGNGLGVFADYGCRGFSSWVRNRSAPAGAARGVVRGVEVEWAVPRGSAMAKCADGAALVNATALHDGVRCACAAGLVGDGFAQGTGCTKGTCKYKSAHGSTVLVRSICHVDLSPENTYASVVYIHYTACSNGGGEHASDGRDCCQGRFCSRKAVVLAGFFVSLFFLAAAVSFWLFLRQPSKESRRWDLDPACIPKILRSVCDARQFTYEQLEEATRRVDGEKAVDTADDGAVHAGVLDDGSLVAVQRIGYETQGRLRLVLDRMELLSEISHPSIARVVGFCLDSSSNALLLVHEHFAGGTLEEHLRQVRRRVVLSWYHRVNIAIELASALTYLQAHEAAPTFLHDLRSSDIFLDAGFTAKIAGYKLTGPATACCSAAASSCEQDVVCNFGHLLVELLTGLRQQVPLDSVAPKVREGRVHEVIDPTLLSSGGGNGKQLPASHDEVRKVFELAVRCLSCAETGLCMLAVAKELMHILRDNNGSSSKIEISLEETFSSSSLLQMISMSPETLHHHLP

SEQ ID NO: 65372 - DNA, 662 bp, Zea mays
  misc_feature: Ceres CLONE 1536177
  misc_feature: Encodes the peptide sequence at SEQ ID NO. 65373
ctggagctccccgcggtggcggccgctctagaactagtggatcccccgggctgcaggaattcgtctcacccctagaaaaacttatcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcagacagcaaggtccaatcctccttgaggattatcatctaatcgaaaagcttgctcagttcgacagagaacgtatccctgaacgtgttgtgcatgcacggggagccagtgccaatggtttctttgacgtcactcatgatgtatctcaccttacatgtgctgattgtctccgtgctactggggtccagacacgtgttattgtccgtgtcactacagttgtgaatgagcagggaccccctgagaccttgagggatccacgtagttttgctgtcaagttctacaccagagagggtacctttgacctcttggggaacaacatgcctgtgttttcttacgagatgggatgaaattccctgaaatgggtccaagcttgcagcccaatccaaagacg

SEQ ID NO: 65373 - protein, 148 aa, Zea mays
  misc_feature: Ceres CLONE 1536177
  misc_feature (18)..(149): Pfam Name: Catalase Pfam Description: Catalase
  misc_feature: SWISSPROT Homolog: EC 1.11.1.6 Catalase
MDPYKHRPSSGSNSSFWTTNSGAPVWNNNSALTVRQQGPILLEDYHLIEKLAQFDRERIPERVVHARGASANGFFDVTHDVSHLTCADCLRATGVQTRVIVRVTTVVNEQGPPETLRDPRSFAVKFYTREGTFDLLGNNMPVFSYEMG

SEQ ID NO: 65374 - DNA, 671 bp, Zea mays
  misc_feature: Ceres CLONE 1536179
  misc_feature: Encodes the peptide sequence at SEQ ID NO. 65375
ctccccgcggtggcggccgctctagaactagtggatcccccgggctgcaggaattcgtctcacccctagaaaaaaccacgcccaacacgcgtcataaaaaatgggtacgcatcaataaagaggagcttgggaagttgccaaggcctccgatttcgctaatgcgacgataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgcccccggcgtggaggcccaggcgcaggccgtggcataggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatgaaaatttatgtggggggcgctatcctggaacccggggtatcagaaaagtagtggactggatgtccaaaaaaagtgggattcccccctccggagcttagggagcccc

SEQ ID NO: 65375 - protein, 73 aa, Zea mays
  misc_feature: Ceres CLONE 1536179
  misc_feature (10)..(74): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
MKERSTIAVIGLSVHTAPVEMREKLAVAEELWPRAIQELTSLNHIEEAAVLSTCNRMKIYVGGAILEPGVSEK

SEQ ID NO: 65376 - DNA, 733 bp, Zea mays
  misc_feature: Ceres CLONE 1536570
  misc_feature: SWISSPROT Homolog: EC 1.11.1.11 L-ascorbate peroxidase
  misc_feature (404)..(404): n is a, c, t, g, unknown, or other
  misc_feature (733)..(733): n is a, c, t, g, unknown, or other
aagctggagctccccgcggtggcggccgctctagactagtggatcccccgggctgcaggaattcgtctcacccctagaaaaagagtctcatcgtccacttctctgggtaggccgcatgccgcatcccctcctccccccaagagccgccgaggctgctccccctagcaaacccgccatggccgagcgcctcgcagcatccgccgccaccctccgcgcctcggccgccgccaccccgttcgcccgccgcgcggcgccggccaaccgcgccttcttctcgccttcgctagctcgcgcgcgcgtctctctccgcgccgcgccctctccgctcccgcaaaaggcgagggtagtgaggtgcgcggctgtggcgatggcctctgacccggctcaagggaaggccgcacgcnaccacccccgggagcttctcaggacgactcactggcaccccatcctggtccgtctaggatggcttgaggctgggtacctatgaaaggaatattgagggatggtcccaaacgaggtgcaactactggaaatttaagaatttggagcttgagttggaaactgggagcccaagggcgggcctgaataaatggctcttagggctttttccatacccatctcgggaacaaagttcccccagaagatgcaccttagggccacatttaattttaggtagggcaacgcggctttctacacatattggtggaaaagcaggttggaccccacataaatn

SEQ ID NO: 65377 - DNA, 700 bp, Zea mays
  misc_feature: Ceres CLONE 1536582
aaagctggagctccccgcggtggcggccgctctataactagtggatcccccgggctgcaggaattcgtctcacccctagaaaaactactcgtctccacggaatcgatcgatcggtgctttgatctctgagcctgagcaagcggtcgagctcaccaaccgccacgctcaagacaggtcgagtatctatctagctgccgtagtggaaaaggaggccgtgcactgtcatggggaggccgccgtgctgcgacaagatgggagtgaacaaaggcccgtggaccccccgaggaggacctccatgctcgatctcctatgtccaagagcacggccccggcaactggcgcgccgtgactaccaacaccggtgtgtgtatgaatcatccgaggatgcagggcttgatgacgcacccggctccaagcaaactgccctttctagatccaagctccgaacttacttgatttttttgtttggtgggtcggtgaggcccagcaccggtgcatccgagtgccagggacaaaccgcctccagccagaagctcgccacttgcagtttaccaagcaacatcggggctcggaatccaccgccgggctctttttcgcaacacgggagggcaccccctctgtcccctctccaggcttttccttggggaacagggggatcggctgcccccccttggatcccaccccccaaatcttccttggtt

SEQ ID NO: 65378 - DNA, 697 bp, Zea mays
  misc_feature: Ceres CLONE 1536584
  misc_feature: Encodes the peptide sequence at SEQ ID NO. 65379
ggagctccccgcggtggcggccgctctagaactagtggatcccccgggctgcaggaattcgtctcacccctagaaaaagcagaaccatccatcactagttgagtggcctgcaaagacacgtacgcacggcacgcgaccacagcagcagctggtctgaggcagctagcttggaaccacaggacggcgcgatgcagaagcgctggaagccgagagacgccgctgccggtgctttcagcatggcgctggagctggtggacgacgaggacgacgcggcgccgccggcgataccgccgccgcagacgccgctggagcccatggagtacctctctcggacgtggagcgtgtcggcgtcggagatctccaagatcctcgtcgccggaggcaacaagcccagcagcgttgccgccgcggcgtgccgccttccggaggcggctatgtctataccggagcaggcgcctgtgctcgccacgtcctccaccgtccatctcccgtctcctcagcagcatagagatgcgaggaggtactccacgagcggcggccaccaccaatcgatcggcaggtggttccagcaggctcaccacagggaaacgtgccgggcgaagcagagcggcaaggagaagcagcgcgccgagaagggcaccgagctgctagcctcccactgcgtcgaggcggcccagcacgctggcgcgcgccacga

SEQ ID NO: 65379 - protein, 169 aa, Zea mays
  misc_feature: Ceres CLONE 1536584
  misc_feature (36)..(169): Pfam Name: DUF828 Pfam Description: Plant protein of unknown function (DUF828)
MQKRWKPRDAAAGAFSMALELVDDEDDAAPPAIPPPQTPLEPMEYLSRTWSVSASEISKILVAGGNKPSSVAAAACRLPEAAMSIPEQAPVLATSSTVHLPSPQQHRDARRYSTSGGHHQSIGRWFQQAHHRETCRAKQSGKEKQRAEKGTELLASHCVEAAQHAGARH

SEQ ID NO: 65380 - DNA, 647 bp, Zea mays
  misc_feature: Ceres CLONE 1536589
  misc_feature: Encodes the peptide sequence at SEQ ID NO. 65381
  misc_feature (235)..(235): n is a, c, t, g, unknown, or other
  misc_feature (315)..(315): n is a, c, t, g, unknown, or other
cgcggtggcggccgctctagaactagtggatcccccgggctgcaggaattcgtctcacccctagaaaaataaggaactggccacataggaacattcaagttatctgtgttactgatggtgagcgaatcttgggacttggagacttgggttgtcagggaatgggaattcctgtaggcaaacttgctctatacactgctcttggaggagttgacccatcagtttgcttgcctatcancattgatgttggtacaaataacgagaaactgcttaatgatgagttctacattggactccgggcaaaaacgtgcgactggncgaggaagtatgatgagcctaattgaaagaatttccagggctgcctggtaaaccattctatgggggaaaaagtccccattcagtttaaggactttggccaacctaaaggcctttgatttgcttggaaaaaataaccaaaacccctcctggtttttcaggaaaaatccccgggccccacccccggggggccttggggggtttgttaaccccccccccaaagggggtggggggcccctggcaaaaaaaaaaattttttttctcccggggggcggggggaggcgggaaactggttttttcaaaaaattttttctcctctcaagattttcaaaaaa

SEQ ID NO: 65381 - protein, 60 aa, Zea mays
  misc_feature: Ceres CLONE 1536589
  misc_feature: SWISSPROT Homolog: EC 1.1.1.40 Malate dehydrogenase (oxaloacetate-decarboxylating) (NADP(+))
  misc_feature (26)..(26): Xaa is any aa, unknown, or other
  misc_feature (53)..(53): Xaa is any aa, unknown, or other
MGIPVGKLALYTALGGVDPSVCLPIXIDVGTNNEKLLNDEFYIGLRAKTCDWXRKYDEPN

SEQ ID NO: 65382 - DNA, 816 bp, Zea mays
  misc_feature: Ceres CLONE 1536592
  misc_feature: Encodes the peptide sequence at SEQ ID NO. 65383
gcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggtgtctcgccggctcgcgacttcgtaataccgggcttctccgtcccttaacgctgagatccgaaagtctgacgtgacaggatgcaccaacaaaatcccccacgcacgcggacgggggggaccggcatccttcaggccgaatcccgttccccccaccccccaatagcttgcgcatcccatattaggggttcaaattataccaggatagcaaccggcttgggataaaggggctgggcgtcctgctttttcggtcctgctgtccgaggagcagtcttccgttccgcaggaaccggcacggcgtcttagcctctatcgtccggatcctaagcctactttgatgttgggcgaccgtctccctgaaggagtccgtccgctgatacctccccgctatttgttgcgccccttgtgacagaacaaccgcagtcttctgttggtttgtggggagatctctacatatgggcgcgctgtcggctctgtctgttttcccccgccccacccctcgcgtggtaactctgccgcggccccttgtgttgccgcgctcctcgcttgacgcgttcgacgttcct

SEQ ID NO: 65383 - protein, 70 aa, Zea mays
  misc_feature: Ceres CLONE 1536592
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFVIPGFSVP

SEQ ID NO: 65384 - DNA, 574 bp, Zea mays
  misc_feature: Ceres CLONE 1536597
  misc_feature (35)..(35): n is a, c, t, g, unknown, or other
  misc_feature (85)..(85): n is a, c, t, g, unknown, or other
  misc_feature (99)..(99): n is a, c, t, g, unknown, or other
  misc_feature (127)..(127): n is a, c, t, g, unknown, or other
  misc_feature (128)..(128): n is a, c, t, g, unknown, or other
  misc_feature (262)..(262): n is a, c, t, g, unknown, or other
  misc_feature (265)..(265): n is a, c, t, g, unknown, or other
  misc_feature (298)..(298): n is a, c, t, g, unknown, or other
  misc_feature (330)..(330): n is a, c, t, g, unknown, or other
gggtggcggccgctctagaactagtggatcccccngggctgcaggaattcgtctcacccctagaaaaaaaccgccaccaccaaantcgctaccaccaantccgccatggatgctcccgaacggccannccgcgacggggccgtcttcctcaccgcggcgccttcctctttctccacccgccgtcggcgcagccgcgccatcttcgcatccctttcgccgtccttctcctcctcggaggagccgctgctggtgcgcgcggcgncgnggcgaggacggcctccccacgcccggcccgcgntggattgaatgcggccagggcaggggcggggnaacattggcggaatacaggggctgggcaaagggcccccccccgtttcgggaacgctcccaaaaacccgaacccttttcgcaaaaaaccccccctgaaccccgggggggggggcttctctccccccccaaagggggggttttcttcttttttttctcagaaaaaaaaaaccccccccccccccgcgcccccccggggggggcccctataaaattaaaaaaacaagaggggcggggggatatatag

SEQ ID NO: 65385 - DNA, 671 bp, Zea mays
  misc_feature: Ceres CLONE 1536598
  misc_feature: Encodes the peptide sequence at SEQ ID NO. 65386
  misc_feature (438)..(438): n is a, c, t, g, unknown, or other
  misc_feature (651)..(651): n is a, c, t, g, unknown, or other
ggcggccgctctataactagtggatcccccgggctgcaggaattcgtctcacccctagaaaaaatcgaaaacccaccgcacccctgtccactgttggcttggtgacttcctccgctcggctcccctccgctcccgaacggtcgatctttgcatggcagcagcagctggctccaaggggcgggcgatcgctgaaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagcccccgacagtactggagcccccacccccagaccggcgtgttcggcccgggcgcggtggaccccaagctggccgctgttggcgcgcccgacgccggcgccgatgctgncaagagcacggtgctgggaccaaagtggtgttcccgcccgctccaggaaagccaaaagccgccccccgccccgtgaacccgccgggcttcttagccaaccccaatggtggtcgcttctaaaaaggggcgcgggaaaccttggaagggaaggacttttttcctggctcgggggggtgggcccccccggttaattcccccaaaatttcctacccnaaaagggggttgtaaaaaag

SEQ ID NO: 65386 - protein, 120 aa, Zea mays
  misc_feature: Ceres CLONE 1536598
  misc_feature (96)..(96): Xaa is any aa, unknown, or other
MAAAAGSKGRAIAESFVSRVLAGKAASPRRAVHASAYDKNLEDQVRPAFVPDDVIGSAGSPRQYWSPHPQTGVFGPGAVDPKLAAVGAPDAGADAXKSTVLGPKWCSRPLQESQKPPPAP

SEQ ID NO: 65387 - DNA, 707 bp, Zea mays
  misc_feature: Ceres CLONE 1536600
  misc_feature (388)..(388): n is a, c, t, g, unknown, or other
  misc_feature (395)..(395): n is a, c, t, g, unknown, or other
  misc_feature (484)..(484): n is a, c, t, g, unknown, or other
aatcactggagctccccgcggtggcggccgctctagaactagtggatcccccgggctgcaggaattcgtctcacccctagaaaaagcccctctcccggtcgcctctaacgtggctggtgactcacgaagacctccagctacgggggtgaaactggggccgacttcgggagggtttgacttatacctataccgagcccggctctcccatggcgggcgttctctggcacagcgtcttgccgaccccccaccgccgaaaccagatgctgagcttgctcccgttggtggtcaaagacaaacccctccacctctactgtgagctcgagtggcggaacatcctgccctccccatgttactccccccccccccgtgggggaggggggggacatcncatgccncaaataaaatcacccccctcggtggccctacgggatctctagcggccccctcctacatatatgtctccaatacagattagctcaatcanatttctgtccgctacgaagggggtctccctgctgcatacgatcgtggcgacgttaagattgtcactaccattctgacgtgcctggctaagagattaggtggaagccccccccattattttcccgcgccgacgcatttcatttccttcgcagaccttgcaccggccctgactggggggcccttgactcaaaactggcctgcctggtgtattccccccaatgacg

SEQ ID NO: 65388 - DNA, 675 bp, Zea mays
  misc_feature: Ceres CLONE 1536601
  misc_feature: Encodes the peptide sequence at SEQ ID NO. 65389
  misc_feature (377)..(377): n is a, c, t, g, unknown, or other
  misc_feature (508)..(508): n is a, c, t, g, unknown, or other
tggcggccgctctagaactagtggatcccccgggctgcaggaattcgtctcacccctagaaaaatagcagagctgctcttgcaacaagccaaacaacccagtggctgctagccgagacaggggatagattgagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcnactggattcatgttgatgtcatggatgggcgctttgtgccaaacatcacaattggacccttggttgttgatgctctgcgtccagtgactgatcttccgttggatgtacatctgatgattgtggaacctgancagcgagtccctgattttatcagggggagtgctgacactgttagtgtcccctgggaacagacttcgaccctccatttgccccgaacagtacgtctaatttaaagtcttaggagccaaggggggagttgtttttgaatccggcgactccccctcctgggaattgatta

SEQ ID NO: 65389 - protein, 154 aa, Zea mays
  misc_feature: Ceres CLONE 1536601
  misc_feature (52)..(154): Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
  misc_feature (78)..(78): Xaa is any aa, unknown, or other
  misc_feature (121)..(121): Xaa is any aa, unknown, or other
MATPSSSLCSSFASLRTASIGHPRGIASSTPRKAFHVRASARVDKFSKSDIIVSPSILSANFAKLGDQVKAVEVAGCXWIHVDVMDGRFVPNITIGPLVVDALRPVTDLPLDVHLMIVEPXQRVPDFIRGSADTVSVPWEQTSTLHLPRTVRLI

SEQ ID NO: 65390 - DNA, 723 bp, Zea mays
  misc_feature: Ceres CLONE 1536602
  misc_feature: Encodes the peptide sequence at SEQ ID NO. 65391
  misc_feature (723)..(723): n is a, c, t, g, unknown, or other
ggagctccccgcggtggcggccgctctagaactagtggatcccccgggctgcaggaattcgtctcacccctagaaaaacactaacgtttctaatccccctcttggaaccttgcctttccaaaactggacaaatcttggctatcaaaatcctgggttgactctagcagcagcacagaatggtgccaccaaggttaagagactttatatgtatattttttttggcacaataatatccgaataatattttagcatgtgctatatcttcctctgttttactgcctgacaggtttcgaacaacaatcaagacctctcttctggtacctttggttttggcacacctgggtaagctatactgcctgctagttgcagattggcggtcgctggaatttcatgctgcaccaaattggattttagagtaatgaactcagtagttgatcttatgtccattttgctgacatatgctgttgattgcaggatgcacaacattactccagctgtcccagcaaatggtgccacggcagcaggtgctagcaacaacggcactgcatcaactgcctcttccactctcccctcacaatctggcaaagattacgatttttcctcgttaactcaaggatttttcaccaagcgatgagtgcctagtgggcttgaaagccaaacggatcaccgggggagcttgcacatgctttatttcgaggcagattttattctggtggatatatn

SEQ ID NO: 65391 - protein, 71 aa, Zea mays
  misc_feature: Ceres CLONE 1536602
MNSVVDLMSILLTYAVDCRMHNITPAVPANGATAAGASNNGTASTASSTLPSQSGKDYDFSSLTQGFFTKR

SEQ ID NO: 65392 - DNA, 717 bp, Zea mays
  misc_feature: Ceres CLONE 1536604
  misc_feature: Encodes the peptide sequence at SEQ ID NO. 65393
aagctggagctccccgcggtggcggccgctctagaactagtggatcccccgggctgcaggaattcgtctcacccctagaaaaagaccagacccgaacaaagcagagcagcggacagatcaaatcaggacaggcatgctgaactaggcgaggtggactgggcgagcgagcgagatggagtggacgacggtggagacgagggacggcgcgaagctgagcgtgcggctgttcaagccccccgcgtccggaacggggttggagccggagccgagggaggatgtggcggtggtgctggtgcatccctacaccatcctcggcggcgtgcacggcctgctgcgggggatggcggagggcgtcgcgcggaggggttacaccgccgtcaccttcgacatgcgcggcgcgggccgctccacggggcgggcgtcgctcaccggctccaccgaagtcggggacgtcgtcgccgtctgccgatgggtcgcagacaacatcaagccgcgcggcatcctcctcgtcggatcctcagctggggctccaattgccggatctgcagttgataaagtggatgaagtgattggtctcgttagcatcgggcacccctttgggctgatgggctcagccctagtccggaagggataatgatgctatgctccagtctgaaaaaagacagtcttttcattccggcgaccaacgatggagtcccccgtgtgaaaccacctgcg

SEQ ID NO: 65393 - protein, 153 aa, Zea mays
  misc_feature: Ceres CLONE 1536604
MEWTTVETRDGAKLSVRLFKPPASGTGLEPEPREDVAVVLVHPYTILGGVHGLLRGMAEGVARRGYTAVTFDMRGAGRSTGRASLTGSTEVGDVVAVCRWVADNIKPRGILLVGSSAGAPIAGSAVDKVDEVIGLVSIGHPFGLMGSALVRKG

SEQ ID NO: 65394 - DNA, 737 bp, Zea mays
  misc_feature: Ceres CLONE 1536605
  misc_feature: Pfam Name: ATP-synt_A Pfam Description: ATP synthase A chain
  misc_feature: SWISSPROT Homolog: EC 3.6.3.14 H(+)-transporting two-sector ATPase
aagctggagctccccgcggtggcggccgctctagaactagtggatcccccgggctgcaggaattcgtctcacccctagaaaaagattaattcttaacaaattagtctttgcaatttctgagggccgttctctctatctaggagatcgttgattgagaagaatagtgaattcttgagcaactgcgtagatttataggattaattactattcttttttgccttgcctagataaaagaatggaaagattgatatatattagagggtattgatatatattatgatctgatgtgatttcttggtatattaaatataacattaatacttcaagttgatgagttgaaaaagagatgcttgaatcaaaagaattccttttttgaagttcaatttttatcagaggacaatatgaatattacaccaccgcccattaaaacactcaatgggttatatgatatatcgggtgtagaagtagggcaacacttctattggcaaataggaggtttccaaattcatgcccaagtactcatcacttcttgggtcggagctactaatctgctaagttcagtgatcatagctgtctctgaatccacagaccctcccgaccgatggtcagaatttcttcgaatatgtccttgaatttattcgagacttgagcaaaactcagattggagaagaatatgggccctgggttccctattttggaactatgttcccttgttacttgcggagcgaattgctcag

SEQ ID NO: 65395 - DNA, 754 bp, Zea mays
  misc_feature: Ceres CLONE 1536606
  misc_feature: Encodes the peptide sequence at SEQ ID NO. 65396
  misc_feature (391)..(391): n is a, c, t, g, unknown, or other
  misc_feature (396)..(396): n is a, c, t, g, unknown, or other
acgactggagctccccgcggtggcggccgctctagaactagtggatcccccgggctgcaggaattcgtctcacccctagaaaaactcttccaatccgaaccacccggactcccggagcaagcggccgccggctaagcagacacgaacgcaggtccggcggcaatgcaacgcgccgcgctcgtcgggtcccctctcgtacccgcgggtccccttgctcagcttgccgtgcggcgccgctgccgcttccatggtggtgttcgcgtgaggtcctcaaccgggaaggacgggaccgggaccgggggcggaagcgagggcggcgagggcgccggtgccgcagcgtcttggctgagctcggtggttgtggagaaagtggacgagggggggcgccgcnaaaanaaccgggccccgccccccccctttgaggacgcctagtgccgcggttaaacgcgcgcgcgcccgcgctcgcccgacatcgaatgccaggagggccgccgcaggcctcgcccgtgaaggaggtccgcccgcctctagaagcgggcccgaagaaaatggccgagtcccgtcggggaattgccttcacgctacaacaaatgatcggatggaactccgcgactccctgccttctaatctctgcagaagtaaacctctggaaagaaagccccgcggtgatttcttgctagaactcagcgtggggtgtttttctccgctaaaagtgcggaatgtattcctctcgtcgcgagtgtgtatgcgccct

SEQ ID NO: 65396 - protein, 89 aa, Zea mays
  misc_feature: Ceres CLONE 1536606
  misc_feature (77)..(77): Xaa is any aa, unknown, or other
  misc_feature (78)..(78): Xaa is any aa, unknown, or other
MQRAALVGSPLVPAGPLAQLAVRRRCRFHGGVRVRSSTGKDGTGTGGGSEGGEGAGAAASWLSSVVVEKVDEGGRRXXNRAPPPPFEDA

SEQ ID NO: 65397 - DNA, 725 bp, Zea mays
  misc_feature: Ceres CLONE 1536611
  misc_feature: Encodes the peptide sequence at SEQ ID NO. 65398
  misc_feature (724)..(724): n is a, c, t, g, unknown, or other
ggagctccccgcggtggcggccgctctagaactagtggatcccccgggctgcaggaattcgtctcacccctagaaaaaacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacggggccgctccgcagcacgcccgtgcacggccaggccggcgcgctcggcgcccgcggcctcgtcgccatcctcagcgtctgcctcaccatgtacggcgtcgcctccttcacgagggggacccgtccacggggccctcgctcacgctcaccggna

SEQ ID NO: 65398 - protein, 157 aa, Zea mays
  misc_feature: Ceres CLONE 1536611
  misc_feature (44)..(158): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGARGLVAILSVCLTMYGVASFTRGTRPRGPRSRSP

SEQ ID NO: 65399 - DNA, 699 bp, Zea mays
  misc_feature: Ceres CLONE 1536612
  misc_feature (137)..(137): n is a, c, t, g, unknown, or other
cggtggcggccgctctagaactagtggatcccccgggctgcaggaattcgtctcacccctagaaaaagcacgcgcacgcgcatcccggcagtcagtagcgcagctgcctctcctctctttgccccccggagccggancaagagcgccgccaacagctcgctaccggcgccgtggcgtggcgggggctggagacaaggtggactacttcttcagggtggtgctgatccgccactcggcggttggccaatcccagatcctcgcccgcttccccccggaagcgagtcagcctcgactcccaggtctcctttcggggtcaagtttccagacccgtaccccttgtttttttcccccccccccgtgggggggggggggggggggaaccccccccgccctaaaaaacccccccccggtcgtgaaacaagggtttttttttctcaaccgccccccgggggaggcttttgccgggacttaatagtattttacccgagtctccgagagtttctcatctcagtatccccggcgtgggggtgagtgaaaccctccggactcctgtgctgtatcagaggatcttgagagaataaccgtggcttgtgaaaaccaatgtgggatcgctgagggtcgctatgttgctgtggcacgtacaggtgcgtcccgcagttgtgtcgtaatgaatgtccgctctctactcttcgctccacc

SEQ ID NO: 65400 - DNA, 704 bp, Zea mays
  misc_feature: Ceres CLONE 1536614
  misc_feature: Encodes the peptide sequence at SEQ ID NO. 65401
ctccccgcggtggcggccgctctagaactagtggatcccccgggctgcaggaattcgtctcacccctagaaaaaccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgaccc

SEQ ID NO: 65401 - protein, 186 aa, Zea mays
  misc_feature: Ceres CLONE 1536614
  misc_feature (64)..(184): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVD

SEQ ID NO: 65402 - DNA, 630 bp, Zea mays
  misc_feature: Ceres CLONE 1536615
  misc_feature: Encodes the peptide sequence at SEQ ID NO. 65403
  misc_feature (85)..(85): n is a, c, t, g, unknown, or other
  misc_feature (269)..(269): n is a, c, t, g, unknown, or other
  misc_feature (270)..(270): n is a, c, t, g, unknown, or other
  misc_feature (316)..(316): n is a, c, t, g, unknown, or other
  misc_feature (565)..(565): n is a, c, t, g, unknown, or other
  misc_feature (606)..(606): n is a, c, t, g, unknown, or other
tccccgcggtggcggccgctctagaactagtggatcccccgggctgcaggaattcgtctcacccctagaaaaaacgtaagcacgnttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgcccgacagnngcagctgtggtttcgcggtcccaaggcagttccccttcctcctaanccctcgaatggcacgctgccccggggactatggttccaacccgctggggcctcttcggacccggaagggacccgggggctttcatcgaagcccaagggggtggcctaccgggaaggggattaaaggggccccttaccccatgttgggggcgcggggggggccccctccccccccgcaaaaattttttgcgcaaaaaggggggggcttttccccccccccgaaaaaaaacgcgctctccgcgtgtgtgtnataaaagagagagggcgtttttctccccccccccgcgcggnaggggctctcctataaaaaatttt

SEQ ID NO: 65403 - protein, 103 aa, Zea mays
  misc_feature: Ceres CLONE 1536615
  misc_feature (48)..(48): Xaa is any aa, unknown, or other
  misc_feature (63)..(63): Xaa is any aa, unknown, or other
MAAQALLSGRQLLGRPVQSAVSRSSARKAPFVVRASSSPPAKQGARQXQLWFRGPKAVPLPPXPSNGTLPRGLWFQPAGASSDPEGTRGLSSKPKGVAYREGD

SEQ ID NO: 65404 - DNA, 731 bp, Zea mays
  misc_feature: Ceres CLONE 1536617
  misc_feature: Encodes the peptide sequence at SEQ ID NO. 65405
  misc_feature (383)..(383): n is a, c, t, g, unknown, or other
  misc_feature (386)..(386): n is a, c, t, g, unknown, or other
ctccccgcggtggcggccgctctagaactagtggatcccccgggctgcaggaattcgtctcacccctagaaaaaagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacggggggctggacatcncgntgcggctgctccagcccatcaaggaggagttcccaatcctctcttacgccgatttctaccagctcgcgggagttgtggcccgtggaggtcaccggtgggcctgaaattcccttcccccccggtagggaggaacaacctccaccccccaccggaaggccccccttcctggatgcccctaagggtttctgacccccctgaaggcaagttttttggcaaagcaaaatggggcttggaccgaaccaggaacattgtttccccctccctggggggccaccaccttgtggaagaggggccccaaaaaaagggggcttgtgtttccgaaggggggacctggacactacaaag

SEQ ID NO: 65405 - protein, 111 aa, Zea mays
  misc_feature: Ceres CLONE 1536617
  misc_feature: SWISSPROT Homolog: EC 1.11.1.11 L-ascorbate peroxidase
  misc_feature (77)..(77): Xaa is any aa, unknown, or other
  misc_feature (78)..(78): Xaa is any aa, unknown, or other
MAKNYPTVSAEYSEAVDKARRKLRALIAEKSCAPLMLRLAWHSAGTFDVSSRTGGPFGTMKHQSELAHGANGGLDIXXRLLQPIKEEFPILSYADFYQLAGVVARGGHRWA

SEQ ID NO: 65406 - DNA, 545 bp, Zea mays
  misc_feature: Ceres CLONE 1536619
tggcggccgctctagaactagtggatcccccgggctgcaggaattcgtctcacccctagaaaaatcttgtcttgatcctctggtccgtggccatggcgtcgtccatgctctccgctaccaccgtggccactccagcaagggggggcggcctgtccgagtctccggctcagagctcgcgtcctgccatgcgccgaatgccactccgacgactcatgtccgccgtctccttcaggaccccacgcgttcggcaccaaacgggggggcccccggcggggccccccaaacggagggggcaaaactaaaaggggccccccaatggtgttgggcccattgggggaatttctttcttttttttaaggggggggaaaacccccccccccccccaaatttccccccaaaaaaaaaaacccaggggggttgcaaaaaaggggcccccccccccctcaaaaaaaaaacacccccccccgggggtttttttttagaaaaacaaaaaaaaccccccgcggggaaaaaaaaaaccctcttttctttttatcaagagggga

SEQ ID NO: 65407 - DNA, 596 bp, Zea mays
  misc_feature: Ceres CLONE 1536624
  misc_feature (198)..(198): n is a, c, t, g, unknown, or other
ccccgcgggtggcggccgctctagaactagtggatcccccgggctgcaggaattcgtctcacccctagaaaaaactttagctctccccactgctataggcagcccacatgcgcgcacactcccaagtcctaagctagccagctgagctcgctcccagtccaagcgccggccccaccaccgcagctcgatcacaccatngagcaagggagaagcaccaccgcgactggatcctccggtgctgctgcggctccatcgccgcctgcatcctgacgctggccgccgtcgtcggcttcatcgtgctcgtcatcttcctggcgctgcgccccctccagccgtccttctacctgcaagacgtgcagctgcgctccatcgacctcagcgacccgggggttcttccctcgacctccagtgacaatcgcgtccgggaaccccaacgacgggtggggctgtactaaaaaaacttggaacgctttcccccataaccccaaacaaagcgggggaaagaaaccccggggtaaaaaccccggcaaaatattcccgggggccccacaaaaaaaaaacctttctcgtgggggggcccccccccaaatttttgg

SEQ ID NO: 65408 - DNA, 645 bp, Zea mays
  misc_feature: Ceres CLONE 1536630
  misc_feature: Encodes the peptide sequence at SEQ ID NO. 65409
  misc_feature (437)..(437): n is a, c, t, g, unknown, or other
  misc_feature (458)..(458): n is a, c, t, g, unknown, or other
ggagctccccgcggtggcggccgctctagaactagtggatcccccgggctgcaggaattcgtctcacccctagaaaaaaaaaaaaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcactctcgacaagaacctcgctacgaacctgtttaagatgcttnctcagtacccggcccttgaanaaaaaaggggtttcccaaaaaagggggaaagggggttttctttaaaaaggcccccctttaaaaaaaaaaaaaaaatattttttttccaaaaaaacactttttgtgggaaaaaaggccccttccccccgggggggttcctccctcttttaaaaaaaaaaaaggcccccccccttttgttttttccccc

SEQ ID NO: 65409 - protein, 161 aa, Zea mays
  misc_feature: Ceres CLONE 1536630
  misc_feature (93)..(93): Xaa is any aa, unknown, or other
  misc_feature (100)..(100): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLXQYPALEXKRGFPKKGERGFSLKRPPFKKKKKIFFFQKNTFCGKKGPFPPGGFLPLLKKKKAPPLLFFP

SEQ ID NO: 65410 - DNA, 744 bp, Zea mays
  misc_feature: Ceres CLONE 1536644
  misc_feature: Translation starting site: 622
  misc_feature: SWISSPROT Homolog: EC 2.7.1.31 Glycerate kinase
  misc_feature (409)..(409): n is a, c, t, g, unknown, or other
aaagctggagctccccgcggtggcggccgctctagaactagtggatcccccgggctgcaggaattcgtctcacccctagaaaaaccacgtctctctcgacgaaggctccggcctcgtcgggatccggtgctggattgacgcaatggcgccgctccacgccgcgctgccgccgccctcctccgccgccgctcaccaccaggcggcagccccgcctgacttcctcgcccgctcgccgtaccacccccgcagggcggcggcctcctgcccgctcgccgacgctgccgctccctcgtcgagaaaagcgttcttgtcgtgcccgctgctgggccactggaccacggccgcgccgccgcgcgccatcccctcctcggcggcggcgacaaccccggcgctcatcgccccaccccangacctgtatgacttcatctgctgccgcccgctagtggacaggaacggctactccagtgagaagatcacccagcccaacgaccgctggcttctcgccggtgctagggtggcgcgcctcttccctcacaacgagctccacctgtccgaacgccagaaggaccggaaataccacttccaacatccccgccttcctcgggagcccaggaccaggtcatgggggcacaaagaccggggaccaacgacgggggatggacctcccggcctttgggggaccgggggaacaacaactcccccaaggaaaagtgcgaaaaacaaactccttctggtttccacccc

SEQ ID NO: 65411 - DNA, 697 bp, Zea mays
  misc_feature: Ceres CLONE 1536645
  misc_feature: Encodes the peptide sequence at SEQ ID NO. 65412
gcggtggcggccgctctagaactagtggatcccccgggctgcaggaattcgtctcacccctagaaaaaatatttccatcctccattcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccgccggagtgcgcgccctcggaccgcatcgtccgtctctcccccgcgcttcgctgggagcaggcgcgcgagccgctgcacgccggcgtcgacgtgggcaacgttctcggcgtcgggcccggcatgcccttcgcgcacgccgtgctcgccagcgagggcgcagccgcagagccccccgtcgtcgtcgggctcgtgccgtgcgcgcagggcggcacgccgatcgccaactggtcccgggggacggagctgtacgagcggatggtgacgcgcgccagggcggccgtggccgagtgcagcggacgcggtcacctggccgccttgctttggtaccagggggaggcggaaccatgaggcgtcaggatgctgagctctaccagcggcggatggagctctcgtgcgtga

SEQ ID NO: 65412 - protein, 174 aa, Zea mays
  misc_feature: Ceres CLONE 1536645
  misc_feature (96)..(174): Pfam Name: DUF303 Pfam Description: Domain of unknown function (DUF303)
MALLTLQQPAIPFLLLLLLLPAASARLPGGRTLVFILAGQSNMSGRGGATNGTWDGIVPPECAPSDRIVRLSPALRWEQAREPLHAGVDVGNVLGVGPGMPFAHAVLASEGAAAEPPVVVGLVPCAQGGTPIANWSRGTELYERMVTRARAAVAECSGRGHLAALLWYQGEAEP

SEQ ID NO: 65413 - DNA, 684 bp, Zea mays
  misc_feature: Ceres CLONE 1536648
  misc_feature (684)..(684): n is a, c, t, g, unknown, or other
cgcggtggcggccgctctagaactagtggatcccccgggctgcaggaattcgtctcacccctagaaaaacggcccaattctcacgcgctcgccgcctaggagcattcacgttggcggcgggcggcggctcggttcctctcctccaccgcacctccaagaatccacctccacgactgagctgacggctcggtagcgccatggcagttcaccggctccaaccttccccatccggcctacagtgctccaccgcccggtcgccagtgctcctccatgggccacggctgacgggtgcacgcaccggtaggagaggtggatttggtggacctagattcgatgtgcagagagcgacttggaggtggctgacatcttcaagcactgcatcatgcagttacaactactgttggccatacagggaaatgctgggcctattataccaattgttcaaagcatggaccttgtataattacatgtttttatcatagatagattaatttctgaaatgcccatagattggtatatttgtggaaatttattggccaactgtaagcccgtcgtgatgcatagaacatttgtggtataagatttttctgttgatgtttgcaggttatttttccagcacttgacattcgagtgaaaaatgtttcagggacatattctctttgacatgaaggagaaaatgatctn

SEQ ID NO: 65414 - DNA, 802 bp, Zea mays
  misc_feature: Ceres CLONE 1536649
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (802)..(802): n is a, c, t, g, unknown, or other
acccgcggtggcggccgctctagaactagtggatcccccgggctgcaggaattcttctcacccctagaaaaactcctctcccctctccctcgcggcctcgccttatcccctccgtcactcacctcgaccagcgggatggccatggtcttggcctccgggaccgccgccggactcttccgctccagtctgtaagcgccacaaggcgccggacgctgcgtccgggcgcgcgccccgtacccgttcttggctcccctccccgctcccaagggcccctgcctcgcgcccaggaggagtcagaagccggcctcctataatattcacaacgggtccatggccccggaacgttttttttttgccccacaaagagggggagaagggggccgtactactatncnnaccaccccccccccactaggtctgagaaaaacccccttttcgcacgaggttccagccacccccacctgaggctacctctcttggccctatcgaacgtccctggatcacactcagcaagactccactgaggccgctactcccatcttcaggaagtaccctcgcctaaaaactgaaccttcaacaagcacacactctcgacaattagtccctttagctcgggatgtttggcaattggctgagtcactaatatacgaactctggcctaaggagaatgcgtgaatcgccagttataccccgcgaaccacaccttaaaggcaaaggaacaggtcctgataagaaaaatataggaatttgacttctagccccagggtatttagtacccggatctagtgcaacgttttgccan

SEQ ID NO: 65415 - DNA, 910 bp, Zea mays
  misc_feature: Ceres CLONE 1536652
  misc_feature: SWISSPROT Homolog: EC 6.3.1.2 Glutamate--ammonia ligase
  misc_feature (19)..(19): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ccttttttttacccacttnttttttnnncctttaaaannnaaaaaaactgagactccaccgcgtggcggccgctctataactagtggatcccccgggctgcaggaattcctctcacccctagaaaattctatacccccaggctatcttcaaggacccattccgaggtggcaacaacgttttggttatctgtgacacctacacgccacagggggaaccccttccaactaacaaacgccacagggctgcgcaaattttcagtgacccaaaggtcgctgaccaagtgccatggattggcatagagcaagactacactttgctccccaaatgatgttaattgggcctcttgtgtcggactgtttgaaggattccccggtgccccaggggcccttactaattgttgcctttagaatctcaacaacatcttctcgaggcggggaggggggcggattgacccacttccaacgccttcccccccccccctttttatatcctttattctaccctgcaatatattcttcgtacagtccacggatctgttctactcgggttgcacaccctcttttcggcccccttaccttgattgtatcccttaccctcctaggcacacatcacacttcatgtgtagtttcaggagaataatatttccgccctctgtaatcaatctctacacacctctaaccacgggctcgcttcacgaatgtatccgactttgtatccaagaagagcctagaactacggttcaacctcgcttatcctcgcgcctggctccgcccgacgctttttctcaccttacctacaaaacccgtttcaccgcattataagtctactctctacgcaaaccaaacacccacatgcgttgttcttgacttaccaacccgcgcgttcccattacaatcacaaatgctcccc

SEQ ID NO: 65416 - DNA, 714 bp, Zea mays
  misc_feature: Ceres CLONE 1536654
ggagctccccgcggtggcggccgctctagaactagtggatcccccgggctgcaggaattcgtctcacccctagaaaaacggtggtcgcctctcgcacctcttggggcaccgaggtccacactaaattcttctcgaccttggactcccacagatctgtccccttgcttcgaatcgcctgccggcactcaacgtgctgacccaccaacgatcatgctccctccagatctgtcgtctgcttctgcacggcctgcgtcatcccttgcgatcagggcacgatggatatgttcgcgtgtctgatccgctggcccgaattggccggacacctgccactgtacacaggacacgctcgtctcgtggatgcaggatgctaaccattctgatatacgtgtaatattgatggatcttccgacgattaaccctggagacttgtgagaacttctcatcgcatctcacccgtacagcacaggcgtcttctatttccatcgtgaagcgggtacaatgatgaaactgttgaagaggcacctgcaatgtaagctatctaagaatctgtaccgtcattagacttactgcaactgctgaggctctacgattatcagagcaagttgccctaaactcactgcaggtgcacgattccgccctgctcaaggaggatgcgctatcctgctgggcagaccccagccctcggataggatctggctctcgttcccgagacat

SEQ ID NO: 65417 - DNA, 736 bp, Zea mays
  misc_feature: Ceres CLONE 1536655
agctccccgcggtggcggccgctctagaactagtggatcccccgggctgcaggaattcgtctcacccctagaaaaaaacgttctcgtcgctcatcggttcagtcgcgacgtggtgcatggtccccacttgccgtgctctcctgtgctgcttccccggatcctccggtgtccgcactggcttcgtcagcccaagtcctccctcctatcttggagcgcagcggccgctgccttcaccgtctcggaaggcggaaccggattcgtctctggggctaccgcgaccgcgtaggcttccacttcctatcgacttgactttgatggatccgaattgccttacttcgacgacggtgcctcatcccaaaacccctgttatgggatgagcttcttcaatgagtactaccgatcgctctattcgaatgctcatcgctgtagccatgctcgcattgacattgctactcatgtctctggggatgcaagatgagtggtctgcaattttgtcaacacatgtgatagcgtagagattgctatctctctcagtgctagctggagctatgtcatctgtcaccctattgctcggtgactatactagcttgctgacaatgagatgaatgttgttctttcgatttgcccacgtctccttagtgctattagttcctatggtcagatttgcttgcctactaatatctggttgccacctttaaatatatgttggcacttgactcaatgaaacatgctccca

SEQ ID NO: 65418 - DNA, 1562 bp, Zea mays
  misc_feature: Ceres CLONE 1536657
  misc_feature: Encodes the peptide sequence at SEQ ID NO. 65419
aaggtcggcaacccggccggccggccggccgtgtcctccaagacttcgccttccgcaggccggccggccgtgtcctccaagacttcgccttccgcgacccgaccgccgcgaccactatatataaccgcgtacgcccccaccccacgagcggccgtgaaatcgcgctccgatttgtgcttctgcgacttcaatcggccagtccgaaaaatccaaggacattgccgggcggaaccctccctccacccacatcatggcggcgacgactgtggcaagccggaagcgagggacagcggccttccttgatgaccccttctccttccccggcgacctgccgtgcctgcagacgaagcgcggccggtgctcgtcgtcgattgttgccgccgacctcggcctgagcttcccgctggagttcgacccggtcgaggcactccatctcatcttcccgggcgaggatcggcaggttctacaaaacgatttacaagcgtcaggaaatgtcctggatgctgcgatcagagcatacaaagattatttggcagaaagaagcaaagaatctgcttctgccatcaactatgttccatccgacaacgaggaaggagatagcattctatctgaatctgaatctgatgtttacctaaaagaagaaaccattcccaccaattgctctggatgggctgaggtcatcgtcaaggagatgtcctctgcttcggatttgaccgatgccaagaaccgcgccttcaagatactcaaactgtttgagaaatcggctgacaggagcagtagcccagatgaaaagagagaagggaacaaggagcacaagatagtgaagcagatgctaggatccctgctccaccagaacggcgttctgaagcgtgcgttcctcatacagcacaaccgactcaaggagtaccaggagatggtgcaggagcggtctcagttcaaccagattctcgagaagtaccgggagcagatcaaggcgttagaggagaagaacagtgccttgtcatttcatcttcaaaatatgaaccagtgcagaaacacctattggcatcacaatccagatgtcttctaatctatactgttgtcagcaaggacattccgctaatccctacatgctgctacatctgcatgctacaacatgtgtcgagcttgggagaaagatagggagtgcaaaatcctgaaactgcaaaatatccttttctctcctccagctaaggagaaagataatcaaagaaaggactcgtccgtatggtagcaattatttgaaaggactagtttaagctagtctgaattgtctgtagatggcgataatgaaagaaagggcatgttcatatgttgcaattattttgtattagtctggtctctctttagattttagttgctctcaatgtaagtgagcagaatttgacggagttcgaaaatccatgtactatttgttttaaattatcgatcgaattgagactgttccccaccaaagctcactgacaagggaactaataagcaccttttgacagtgggcaacataataaacaatttgaatttttattcaaaaaaaaaaaaaaaaa

SEQ ID NO: 65419 - protein, 272 aa, Zea mays
  misc_feature: Ceres CLONE 1536657
MAATTVASRKRGTAAFLDDPFSFPGDLPCLQTKRGRCSSSIVAADLGLSFPLEFDPVEALHLIFPGEDRQVLQNDLQASGNVLDAAIRAYKDYLAERSKESASAINYVPSDNEEGDSILSESESDVYLKEETIPTNCSGWAEVIVKEMSSASDLTDAKNRAFKILKLFEKSADRSSSPDEKREGNKEHKIVKQMLGSLLHQNGVLKRAFLIQHNRLKEYQEMVQERSQFNQILEKYREQIKALEEKNSALSFHLQNMNQCRNTYWHHNPDVF

SEQ ID NO: 65420 - DNA, 776 bp, Zea mays
  misc_feature: Ceres CLONE 1536658
  misc_feature: Encodes the peptide sequence at SEQ ID NO. 65421
  misc_feature (1)..(1): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (47)..(47): n is a, c, t, g, unknown, or other
ntttttctttcctcactcccccgcaataacaaantnngtactacncncaaaaaactggagctccccgcggtggcggccgctctagaactagtggatcccccgggctgcaggaattcgtctcaccctaaaaaaaacccatcagccatccccttttgctgcaaatctttccctgaattgtgggtctccgacaatggcggcgctcgctccatccaagattctgggcacccagctcaacttcgcggggtcctcccgctactccaccgcagcgcccaccgcgggggctcagaagattgtctcccttttcagcaagaagcctgcccagaagcccaagcccgctgcggtatcgtcctcttctccagacatcagcgacgagctcgccaagtctcttttccagttccagacctgagaaaactccgaccggccggtgggcggtggcggcacggcaggatctgtgccgcgatggcgacgtctaacacggcgcggatggaggacggcggcggcgacctgcggagcaccatcaagaagtggaatatcatctaccctgtctacctcaactccaagaagatggtcgccgagggccgccccatcgccgctgccaaggcctgcccgggacccaccatgatcaagatcgctgactgctgttcgcacctcaagatcccccaccccatcgatttgaaaaagcggacccctccgtattttcttcccggtggggaagggtcagggtgcaccttaaaaaaaaaataacgggctcccccccgtcaaatcctggctatata

SEQ ID NO: 65421 - protein, 94 aa, Zea mays
  misc_feature: Ceres CLONE 1536658
MATSNTARMEDGGGDLRSTIKKWNIIYPVYLNSKKMVAEGRPIAAAKACPGPTMIKIADCCSHLKIPHPIDLKKRTPPYFLPGGEGSGCTLKKK

SEQ ID NO: 65422 - DNA, 714 bp, Zea mays
  misc_feature: Ceres CLONE 1536660
  misc_feature: Translation starting site: 563
tggagctccccgcggtggcggccgctctagaactagtggatcccccgggctgcaggaattcgtctcacccctagaaaaaaacacactttacttgacaagggactataaccaaagtaaacaacttatcaagtccaagcacacctggaatcacgatgaacatggcatgtggataatgaaaattttcaacgtacggttacgttgtcagatggtaccgtttcataaggtactctgagagtttcagaggctgcaatacaaatatctaggtgtcgtgtttctgaatatctgaatttgcatacatgctatgatttaatcccagattctggaaaggttattgccctacacattaatttacctgtgaagcaatcattccatattctccatgaacaggggattcctgtagctcctctctgggactcattcagaggacaatttgttggtctccatagcccattggatttcatactcatagtgccggagctagaaactcatggctcgaacttgacagaagagcagcttgaaacacacactatatctgcatggaaagaggctaagcggcaactacatggaagaaatgattattctctggcgaccgcaacagcatctagtgcatgccaccccttatgagtccttgacggacattgcactagagcttttgcagaatggcatttctacagtgccggttatctgttcatcatcatcagatggatcattccc

SEQ ID NO: 65423 - DNA, 751 bp, Zea mays
  misc_feature: Ceres CLONE 1536668
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
nacaccnnnnnaaccgtggagtccaccgcggtggcggccgctctagaatagtggatcccccgggctgcaggaattcgtctcacccctagaaaaagttgttggctgggtgttggcgagctgggagtagagaccgagaagtggagccggccatgaagatccagtgcgacccctgcgagggcgccggctgccaccggtggtgtgcctgcgccgaccaagccgccgctgtgccgccgccgctgcgacctcgagatcccacccccgccaacaagctccgcgagcaagcaccagcgcctcccgctcgaggcgctcctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgcccgccgcagttcctgccgcagggctggggcgtccacgagctcctgcagttcctcgactacgaatcccgcgaccagctgcacaggagccgacgcctccggtcaaggaactggaatgggtccccgacctcgacctcttccccgagcaggcc

SEQ ID NO: 65424 - DNA, 657 bp, Zea mays
  misc_feature: Ceres CLONE 1536670
  misc_feature (584)..(584): n is a, c, t, g, unknown, or other
  misc_feature (585)..(585): n is a, c, t, g, unknown, or other
  misc_feature (588)..(588): n is a, c, t, g, unknown, or other
cgcggtggcggccgctctagaactagtggatcccccgggctgcaggaattcgtctcacccctagaaaaacctccaatcccctcgcccccacggaccctcgccgccgggggaagcgccgctcgctcaggaggacagccatggcgccggagccggaggatgatttttgaacgagaaaaatccccggccgttcgacgaggaagaattcccggtccttcaaaactatgggtttggggcggaccccaacaagctttaaaaaggtcaaaaagggattcagggaatgggccaaaaaaaaccaggccctttttgggaaaaaaaggatttaaaaaaggggtggggcccccccaccccccggggaatttttttttttaaaaaaaccaaggatggggaggaaaaaaccccctttacaaggggggggggggtaaaaaaaaaataccccccctcttaagggggagggccccattatttttttttgtgggaacaaaaccccccccatttttttttttttgggggggggggaaaaaaaaagcgcccccctccccccctcccttcaggggagagggagagggtggtgtgttgtttgtttnnganctacaaaaaaaaaattctctcctcccccccccccaaaaaaaaaaaaaccggtggttttggggggggggg

SEQ ID NO: 65425 - DNA, 717 bp, Zea mays
  misc_feature: Ceres CLONE 1536672
  misc_feature: Encodes the peptide sequence at SEQ ID NO. 65426
cgcggtggcggccgctctagaactagtggatcccccgggctgcaggaattcgtctcacccctagaaaaaacccatcagccatccccttttgctgcaaatctttccctgaattgtgggtctccgacaatggcagcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcggcggcgccgagtactaccggatcaccaacggactg

SEQ ID NO: 65426 - protein, 197 aa, Zea mays
  misc_feature: Ceres CLONE 1536672
  misc_feature (83)..(197): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIAEVILVGGAEYYRITNGL

SEQ ID NO: 65427 - DNA, 621 bp, Zea mays
  misc_feature: Ceres CLONE 1536678
  misc_feature: Encodes the peptide sequence at SEQ ID NO. 65428
  misc_feature (89)..(89): n is a, c, t, g, unknown, or other
  misc_feature (106)..(106): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (229)..(229): n is a, c, t, g, unknown, or other
tggcggccgctctagaactagtggatcccccgggctgcaggaattcgtctcacccctagaaaaaaagcctgagcactccatccactacntttactcgaaagtctangagctagnnnctttttgctttgctcaccagacaaaccgcagcagatggcgtcgacgatcatggccgccacctcccgcatcgtcgcggccaagacgccgtttcttggccagggtcgcgccgccngccgccgccgcccaatggccagccccccctccggcgaacgtcgccgccgccgctgcttggcggcggatcacatgggccacgacctgtggtacggccggaccgcgcaaagactgggcccctttccgccacaacccctcgtattgaccggagattccccgggaatacggtggaaacccccggtttgcccggaaccgaagggttcccggaacagggcgtggggggacaccccggggggggcaaaactggggccccgggggcccccccccccaggggttgaaaaaggggggcccgggaattttaaagccccgtgggggtttagggggggggccaaaatttttttgggggggggggggggatattggtgggaccccccccctggtgtgggggggcaa

SEQ ID NO: 65428 - protein, 157 aa, Zea mays
  misc_feature: Ceres CLONE 1536678
  misc_feature (27)..(27): Xaa is any aa, unknown, or other
MASTIMAATSRIVAAKTPFLGQGRAAXRRRPMASPPSGERRRRRCLAADHMGHDLWYGRTAQRLGPFPPQPLVLTGDSPGIRWKPPVCPEPKGSRNRAWGDTPGGAKLGPRGPPPPGVEKGGPGNFKAPWGFRGGAKIFLGGGGGYWWDPPPGVGGQ

SEQ ID NO: 65429 - DNA, 618 bp, Zea mays
  misc_feature: Ceres CLONE 1536680
  misc_feature (327)..(327): n is a, c, t, g, unknown, or other
  misc_feature (364)..(364): n is a, c, t, g, unknown, or other
  misc_feature (387)..(387): n is a, c, t, g, unknown, or other
  misc_feature (402)..(402): n is a, c, t, g, unknown, or other
  misc_feature (429)..(429): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (480)..(480): n is a, c, t, g, unknown, or other
aaagctggagctccccgcggtggcggccgctctagaactagtggatcccccgggctgcaggaattcgtctcacccctagaaaaaaatcgcaaagtcgcaagcggatcgcaaactcgcaatcaaggctgctcccctccgtctccgtgttcgccactcggttcaccgcccgccgccgccgagacctcctcctcgccggctactcctgaccccacaaaggcagcgctcggaggtggccctctgtcgggtggagtggtggacacatccgcgcccatggccaacggcggcgctgcggccggcaagctcaccgtcgccgagaccttctccaancctcaggagcaagcaagagtgcattcatcccgttcantactgctggtgatcctgacttgntacccacatcggaangcatttgagaatcctcaattccctgcnggttcggaaggttttaaaaaggttgggggaacccccaaaatcctcnnnnantcccccccgcgggagagggcccttttttaggtttttttccaaaagggggtgttaaaaaaaggcccccccctttttttttctcttaaaaaagagcaaagaggggggggaacccccaaagattttttcgccccccctttt

SEQ ID NO: 65430 - DNA, 746 bp, Zea mays
  misc_feature: Ceres CLONE 1536682
  misc_feature: Encodes the peptide sequence at SEQ ID NO. 65431
gctcttaactagtggatcccccgggctgcaggaattcgtctcacccctagaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtctgcggagtggatgcccggccagccactccctgcccacctcgacggctcctctcccggggatttcggtttccatctgctgggcctcccgccccgagggggagagattcgagcgcttcaggtactcaccccagaacccttgccggctggactcatgcttgcaatccccgggctccagtggcccccaaccttctttccactgacgagctgcggtgctgcctgcagaacgacgggggtggcctctcgggcggtccggggcgcttccctggggtaccccgcgggtgcacggaggtatccgttgtgaacaatccatgcgggcagcaattcgggggggaggctgatttctccaaggtggagatgagatccctgttcagcggagggggggtccagatagttactccccgcgtgtatcattgaggcccttagctcgtcgcccctctggcgtcgcccccctcctggagggcttcaggggcctcggaaaagggagagtgtatgtg

SEQ ID NO: 65431 - protein, 145 aa, Zea mays
  misc_feature: Ceres CLONE 1536682
MVMASSSGLRSCSAVGVPSLLAPSSRSGRLAPFCANATTSGRVTMSAEWMPGQPLPAHLDGSSPGDFGFHLLGLPPRGGEIRALQVLTPEPLPAGLMLAIPGLQWPPTFFPLTSCGAACRTTGVASRAVRGASLGYPAGARRYPL

SEQ ID NO: 65432 - DNA, 698 bp, Zea mays
  misc_feature: Ceres CLONE 1536684
  misc_feature (321)..(321): n is a, c, t, g, unknown, or other
  misc_feature (380)..(380): n is a, c, t, g, unknown, or other
  misc_feature (381)..(381): n is a, c, t, g, unknown, or other
  misc_feature (436)..(436): n is a, c, t, g, unknown, or other
  misc_feature (437)..(437): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
aagctggagctccccgcggtggcggccgctctagaactagtggatcccccgggctgcaggaattcgtctcacccctagaaaaaaccgccgccccgcctcccatcgttacgttagtcgtccgcccgcgctagtgccatccacactcttctcttctccccggccggaccggagtcaggcagccgaagcaagaaaagcaagcggctttggaagttgggatccatggcgtccacctcgtgcttcctccaccagtccaccgcccgcgtggccgcgccgtcgccgcgcctcgccgccccgccgcgcagcgcgcaactgttcgtctgncaggcccagaagcagcaggcccgccgcggcggaaaagcgacgtggtcgcgcccgcgccnngcgctccgcgctcctcgccggcgtcgcggccgtcggcgccaaggcgagcccgccnngcgcgctacgggaaaccagccacgtggtcgggcaagacaaagaggaaacccggacttcctcctccaaaagggggggggagaaggggttttaaaaagggggggtttgaaaccccccccccccccnnnnggggggcccccccccggggggggggggtttctcccccggggggggtgggcgcccccccccaaaaaaaaattttttcccccccccccaaggggtggtttggtttttttttcccccccccccccccaaaagagagc

SEQ ID NO: 65433 - DNA, 679 bp, Zea mays
  misc_feature: Ceres CLONE 1536690
  misc_feature: Encodes the peptide sequence at SEQ ID NO. 65434
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
acccgcggtggcggccgctctataactagtggatcccccgggctgcaggaattcgtctcacccctagaaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtcccttctcgaagaacccccccggaaggaannnnccgaagaacccccgatcggggctccggccccaccattaagttcctccccaaaaaggggcccgggggctcctccccagccccctgggctccccagggggggggcgccccaaaaaaccttgggacccctttttctcccccttgtctgaaaaccccccttgattttaagaccgcgggggggcccaaagttgtgcttgtggtggaagaaacaacagaaaagaggggggcgggccctttttcggaagagggggagatttctctcccccgccaagcagggtgtggccctcccccggggggcgagagaaaaagaaacgcccgtgtggtgtggccctataagaggaccggacgcccggccgggagccctgtaagtgtaaggccctgtgttttcaggggcgaacacccat

SEQ ID NO: 65434 - protein, 172 aa, Zea mays
  misc_feature: Ceres CLONE 1536690
  misc_feature: SWISSPROT Homolog: EC 2.7.2.3 Phosphoglycerate kinase
  misc_feature (38)..(38): Xaa is any aa, unknown, or other
  misc_feature (39)..(39): Xaa is any aa, unknown, or other
MATKRSVGTLGEADLKGKKVFVRADLNVPSRRTPPEGXXRRTPDRGSGPTIKFLPKKGPGGSSPAPWAPQGGGAPKNLGTPFSPPCLKTPLDFKTAGGPKVVLVVEETTEKRGAGPFSEEGEISLPRQAGCGPPPGGERKRNARVVWPYKRTGRPAGSPVSVRPCVFRGEHP

SEQ ID NO: 65435 - DNA, 643 bp, Zea mays
  misc_feature: Ceres CLONE 1536692
  misc_feature: Encodes the peptide sequence at SEQ ID NO. 65436
cgggctgcaggaattcgtctcacccctagaaaaagtttcctgttcccgtgttgtacttgttcgctgccgagttcctcgtattctcgatggtctagatcatctatttctattgtattggattgacgaggtacctagggaggaaatcccgtatattcttctggtgcatcgtgagggcaatgtaatggattcactcggcactcggcaacacaaggaccgtcgtaaatggcgctgccgggggcaaagctgggtaccctaacgctgcggatgctgtccaatcgcatcggcaggcgtctcaagagacacgtcgccctccaccctgagttccgcaagttcatcatcgccatcatccaggcgaacgatctgatcaccactaacataagaaggcacatttctgggcttgccacaaatgtgacgatgaggcctttggatgagcaaaaacctgtgaagctgctcatatctcatcggggaagccattatcttctctgtcgcggttgctgatctggttattgggccccgacaaacccattgtcgaagcctagtatggaagaagctcgtacacgggatcttgagcaattcaaactaacggaagagagtataggctaaacattttgaaggacttcaatttgaggcttaatgaaattga

SEQ ID NO: 65436 - protein, 91 aa, Zea mays
  misc_feature: Ceres CLONE 1536692
MALPGAKLGTLTLRMLSNRIGRRLKRHVALHPEFRKFIIAIIQANDLITTNIRRHISGLATNVTMRPLDEQKPVKLLISHRGSHYLLCRGC

SEQ ID NO: 65437 - DNA, 715 bp, Zea mays
  misc_feature: Ceres CLONE 1536698
  misc_feature: Translation starting site: 253
  misc_feature (292)..(292): n is a, c, t, g, unknown, or other
  misc_feature (378)..(378): n is a, c, t, g, unknown, or other
  misc_feature (384)..(384): n is a, c, t, g, unknown, or other
tccccgcggtggcggccgctctagaactagtggatcccccgggctgcaggaattcgtctcacccctagaaaaaacctccgaatttactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcgacgatgcggcggccgtgcgctgtgccancgctgctggtggcggcggcgacggccacgctagtgcttctgctgctgctgtcaccgccgagcgcgcagcgggtgcggagcccggcngcagcncccggcccctccggcgagacctggatcgactcggcgtgcctgaactccctgctcaactgtccgactgcctacccgacgtgagcaggggaagaacggggcgctgccctcacccgccctgatgccccgagctggcggccctcgtcgggtccaaccccggtggctttggcaacacctctcgggggcggcgattctaagggatcctcttctactacggccgcggcgttgggcccccggggaatggctgggttcccaccggccgtattaatatggaaaagtccgcgaaatcttctccgcggggcacatgtaaggacgccaatctaggggatccccc

SEQ ID NO: 65438 - DNA, 768 bp, Zea mays
  misc_feature: Ceres CLONE 1536701
  misc_feature: Encodes the peptide sequence at SEQ ID NO. 65439
  misc_feature (479)..(479): n is a, c, t, g, unknown, or other
  misc_feature (519)..(519): n is a, c, t, g, unknown, or other
  misc_feature (520)..(520): n is a, c, t, g, unknown, or other
  misc_feature (579)..(579): n is a, c, t, g, unknown, or other
  misc_feature (581)..(581): n is a, c, t, g, unknown, or other
  misc_feature (612)..(612): n is a, c, t, g, unknown, or other
  misc_feature (614)..(614): n is a, c, t, g, unknown, or other
  misc_feature (676)..(676): n is a, c, t, g, unknown, or other
  misc_feature (677)..(677): n is a, c, t, g, unknown, or other
  misc_feature (689)..(689): n is a, c, t, g, unknown, or other
  misc_feature (690)..(690): n is a, c, t, g, unknown, or other
  misc_feature (727)..(727): n is a, c, t, g, unknown, or other
  misc_feature (729)..(729): n is a, c, t, g, unknown, or other
  misc_feature (732)..(732): n is a, c, t, g, unknown, or other
  misc_feature (768)..(768): n is a, c, t, g, unknown, or other
acggtggcggccgctctagaactagtggatcccccgggctgcaggaattcgtctcacccctagaaaaaaaactaaaaaaaatctcaattctcaaagtcgtcgatccagcggtagcagcgcacaaaccgatcgatctccgacagggacagaaccaaccaatttcctcgccgatcaaacaaggaaaaaagatcccggccatggtgacgcggtcgctggagctgacgctgatctcgggcaaggacctcaaggacgtgaacctgatgtccaggatggaggtctacgccgtggtgtcgctctccggcgacccccggtcgcggcaccgggttcaggccgaacgcattgcccgtcgcaacccgaactggaacgccgcgctccacatctccgtcccggccacaggcccccgggtccgtcacgtccctcttccccgcctgagggccacctccgcgaacccccacggcagaagaggtctcaagtaacgncaacagcatcttctacctaagggggcccccgagatggacnnagacctccgcaaattaccggtcccatagcaaagcaactgacaatatcctacctccaaananctcgccgaaggcaatcccagtaccccggctntntaagtccccggcgccaggaatgccctcccccccacccccctccgggttccccgcgggcccannagtggatggagnnccccaaccgcctcgccgcgcattcggagaaatcaccntntanattgtggccctggcaccccaaggcatacagattccn

SEQ ID NO: 65439 - protein, 92 aa, Zea mays
  misc_feature: Ceres CLONE 1536701
MVTRSLELTLISGKDLKDVNLMSRMEVYAVVSLSGDPRSRHRVQAERIARRNPNWNAALHISVPATGPRVRHVPLPRLRATSANPHGRRGLK

SEQ ID NO: 65440 - DNA, 761 bp, Zea mays
  misc_feature: Ceres CLONE 1536711
  misc_feature: Encodes the peptide sequence at SEQ ID NO. 65441
  misc_feature (1)..(1): n is a, c, t, g, unknown, or other
  misc_feature (19)..(19): n is a, c, t, g, unknown, or other
naaataatccatttttctnctctatcatattttttatttatattcttcaatactggtgctccccgcggtggcggccgctctagaactagtggatcccccgggctgcatgaattcgtctcacccctagaaaaaacgtttctttcttcctccacacgcctgcttgttcacctccatggctgatggctccatctcctcctgtccctaaccccctccggccctcccctcctccaaagccctaaaccccacgtagctcggtgtgtcagtccactcgcccgcccggtcggcgccgcacccatctttcggattctaccctaaaggcatgaccttggtcttccaatctggaaattgagtatcaatcaagtatggctgcaagagcaatcacgaggagaaggaagtatcttttcgaccatgttaaaacacctaacctctcatcttcatcctctactttccaacatggaagaattggttctgaagatgagccaaaaataacactactggttctggagcaaagcctctaaggattcaagatctgagaagggagcaatactgtgtgaatttgactaatatgaatttggcaggtattgctaatagatttctgcgacgtccagctcattggtatatctctttcatattatggaattgtaaaagaatgacttagggttgctacagtagaacaaatctttgtctcatgtcatttagtgcatcatttatctccaacagcagggtaacctaaagttagattaatagatgaccaaaaacag

SEQ ID NO: 65441 - protein, 51 aa, Zea mays
  misc_feature: Ceres CLONE 1536711
MAARAITRRRKYLFDHVKTPNLSSSSSTFQHGRIGSEDEPKITLLVLEQSL

SEQ ID NO: 65442 - DNA, 724 bp, Zea mays
  misc_feature: Ceres CLONE 1536713
  misc_feature: Encodes the peptide sequence at SEQ ID NO. 65443
  misc_feature (562)..(562): n is a, c, t, g, unknown, or other
ggagctccccgcggtggcggccgctctagaactagtggatcccccgggctgcaggaattcgtctcacccctagaaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgtcctggacgccaagggtgactacgacggcgcccttgagcacctcgtgcttgcctccatgaccatggttgccaatggccgtgacattgaggttgccaccattgacgtcgccataggcaacacgtacctcgccctcgcccgcttcgacgaggccgtcttctcctaccagaaggcactgactgttctncaatcggcccgtggcgacgaccatccgacggttgcgtcggtctacgtccgccttgctgaccttttacaccggacaggcaggctccgtgagtctaaatcctactgcggagacgccctgcgtgtctatgccaacccgcgccaggtgctgcccctgatgaaaacg

SEQ ID NO: 65443 - protein, 177 aa, Zea mays
  misc_feature: Ceres CLONE 1536713
MPGLAASDNSPPAPAPPPRRLSSPLPRRAPSSPSPSASSRAKPRKPSPSPAAFPTDADDSLVLDAKGDYDGALEHLVLASMTMVANGRDIEVATIDVAIGNTYLALARFDEAVFSYQKALTVLQSARGDDHPTVASVYVRLADLLHRTGRLRESKSYCGDALRVYANPRQVLPLMKT

SEQ ID NO: 65444 - DNA, 700 bp, Zea mays
  misc_feature: Ceres CLONE 1536716
  misc_feature: Encodes the peptide sequence at SEQ ID NO. 65445
gggctgcaggaattcgtctcacccctagaaaaaatgtaattgaatttaaatccatccttcggcaattgtataaggcaccactgtcccagccactcctgttagccccgggagggttctttgatcaacagtggtattctcagctacttgagacttcaggtcatggtgttgttaatgccttatctcaccatgtatataatcttggtggagggaatgatgttcatcttataaggaagatcttagacccaaagtacttggatcgtgctgaagatacttacagagacatgcaacttaccatccaaaggcatggaacatgggcttctgcttgggtcagtgaaagtggcggtgtattcaacaatgcccctcaactggtgtcaaatacattcatcaacagtatctggtatctagatcagcttgggatggcatctaagtacaacacaaaagtgttctgcagacagactctcatcggtggcaactatggactgctcgacacgcaaacttttctgcccaaatcctgattactacagcgcttctactatgggatcggcttaagggcaaatggagttctttcagtttgatataaacgcaccgcgttcaaaaacccgctttatgctccattgtaaggaaacaacaatcaaggcattccgaatcctggtgatcaacctggaaccaccctacctggaaaacaacgttcctctctccg

SEQ ID NO: 65445 - protein, 170 aa, Zea mays
  misc_feature: Ceres CLONE 1536716
  misc_feature (1)..(138): Pfam Name: Glyco_hydro_79n Pfam Description: Glycosyl hydrolase family 79, N-terminal domain
AAGIRLTPRKNVIEFKSILRQLYKAPLSQPLLLAPGGFFDQQWYSQLLETSGHGVVNALSHHVYNLGGGNDVHLIRKILDPKYLDRAEDTYRDMQLTIQRHGTWASAWVSESGGVFNNAPQLVSNTFINSIWYLDQLGMASKYNTKVFCRQTLIGGNYGLLDTQTFLPKS

SEQ ID NO: 65446 - DNA, 682 bp, Zea mays
  misc_feature: Ceres CLONE 1536720
  misc_feature: Encodes the peptide sequence at SEQ ID NO. 65447
ccgggctgcaggaattcgtctcacccctagaaaaaatcatcttaatcttttgctgggaaagttcaagtcggagtcccaaacctcgcaccgcatttccccgcatccgcagctcacatcgctcccccgaacccaaacccaaatcccaagcaaccacttcgtcgaccatggggcagggcactccgggagggatgggcaagcagggcggcgccggcgaccgcaagccgggggacgccggcgaaaagaaggacaagaagttcgagccgccggccgcgccctcccgcgtcggcaggaagcagcgcaagcagaagggcgccgaggccgccgcgcgcctccccaacgtcgcgccgctctccaagtgccgactccgcctcctcaagctcgaccgggtcaaggactacctcctcatggaggaggagttcgtcgccgctcaggagcgcctccgcccccaggaggacaaggccgaggaggaccgatccaaggtcgacgacctccgaggcacccccatgagcgtcggatccctcgaggagatcatcgacgagagccacgccatcgtctcctcatccgtcggacccgaatactatgtcggcatcctctcctttctcgacaaggaccagctcgagcccggggtgctccatcctcatgcacaaaaaggttccctcttgtggttggtatattgcaagaa

SEQ ID NO: 65447 - protein, 172 aa, Zea mays
  misc_feature: Ceres CLONE 1536720
MGQGTPGGMGKQGGAGDRKPGDAGEKKDKKFEPPAAPSRVGRKQRKQKGAEAAARLPNVAPLSKCRLRLLKLDRVKDYLLMEEEFVAAQERLRPQEDKAEEDRSKVDDLRGTPMSVGSLEEIIDESHAIVSSSVGPEYYVGILSFLDKDQLEPGVLHPHAQKGSLLWLVYCK

SEQ ID NO: 65448 - DNA, 850 bp, Zea mays
  misc_feature: Ceres CLONE 1536723
  misc_feature: Encodes the peptide sequence at SEQ ID NO. 65449
  misc_feature (15)..(15): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (63)..(63): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (74)..(74): n is a, c, t, g, unknown, or other
  misc_feature (99)..(99): n is a, c, t, g, unknown, or other
  misc_feature (850)..(850): n is a, c, t, g, unknown, or other
ctctactgacatcanggcgctcacgttgggatataaanannnaaaaaaaggactccccgcggnggcggnnggnnctccatccccccacccccgggctgnaggattcccccctcaccccgagaaaaatcaggaaaagggagagggcttttatagatagtgaaggacctaatgatgacttgctaggcttattggttgagtcaaacatgagggaatcaaatgggaatgcaaaactcggaatgactaccgaagatataatcgaggaatgcaagttattttactttgcaggtatggagacaacatcagtcctgcttacatggacgttaattctgccaaccatgcaccctgaatggcaagagcaggcaatataagaagttttaaaccactttggaatggggacaccctaacccccacaaccgtggagcgggcgggaagatggtaacccatgtattttattttgaccccccttgaggcacgtccgcccccggaaggtctccccattgacaaaaaacccaccagggaaacgcgagctccggtcggctggcaagtaatcctccagagcggtgggccctcgcacttcgcccaccctcctcctataccgctctgtccgcccttcatccgtgttgaatatgactcccgccctatgttcttttctcctcactttacgatgcaagccccttactcgtgtagcaagactggtcatcgagccccgcctgccgtcaccaattagaatgtggctgcctctcccctgtctgtccctatccccactagcgtctccctcgtcaggcaggaaagccaaacacgaggacctgaaaacaaactcacgttaccaagattctccataccgcttcgn

SEQ ID NO: 65449 - protein, 121 aa, Zea mays
  misc_feature: Ceres CLONE 1536723
  misc_feature: SWISSPROT Homolog: EC 1.3.3.9 Secologanin synthase
  misc_feature (5)..(5): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
  misc_feature (21)..(21): Xaa is any aa, unknown, or other
  misc_feature (23)..(23): Xaa is any aa, unknown, or other
  misc_feature (24)..(24): Xaa is any aa, unknown, or other
  misc_feature (33)..(33): Xaa is any aa, unknown, or other
LLTSXRSRWDIXXXKKDSPRXRXXLHPPTPGLXDSPLTPRKIRKRERAFIDSEGPNDDLLGLLVESNMRESNGNAKLGMTTEDIIEECKLFYFAGMETTSVLLTWTLILPTMHPEWQEQAI

SEQ ID NO: 65450 - DNA, 716 bp, Zea mays
  misc_feature: Ceres CLONE 1536729
  misc_feature: Encodes the peptide sequence at SEQ ID NO. 65451
atagctggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagaccttcgccaagaaccgggagctggaggtcatccactcccgctgggccatgctgggcgcgttgggctgcgtgttcccggagctgctcgcccgcaacggcgtcaagttccgcgaggccgtgtggttcaaggccgggtcgcagatcttcagcgagggtgggctggactacctcggcaacccaagcctgatccacgcgcagagcatcctcggcattctggccctgccagggccgtgctcatggggcgccatcgaggggtactgcgtttcccggcggcccgctcggaaagggcgtccaacctcttctacc

SEQ ID NO: 65451 - protein, 191 aa, Zea mays
  misc_feature: Ceres CLONE 1536729
  misc_feature (64)..(186): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFREAVWFKAGSQIFSEGGLDYLGNPSLIHAQSILGILALPGPCSWGAIEGYCVSRRPARKGRPTSST

SEQ ID NO: 65452 - DNA, 812 bp, Zea mays
  misc_feature: Ceres CLONE 1536730
  misc_feature: Encodes the peptide sequence at SEQ ID NO. 65453
  misc_feature (17)..(17): n is a, c, t, g, unknown, or other
cttatatgttttacgtnctcgttttgtataaaaaaaacatacaaatacaagaactcaccccagcgggaaacgatacaaactaatgactcccccgggctgcaggaattcgtctcacccctagaaaaaacagcggcatactatatcaaccggtccagcactttcacgctcagctccagcaatggctgcctccaccatggcgatctcctccacggcgatggccggcacccccatcaaggtgggctccttcggcgaaggccgcatcaccatgcgcaagaccgtgggcaagcccaaggtggcggcgtccggcagcccctggtacggcccctaccgcgtcaagtaccacggccccttctccggcgagccccctagctacctcaccggcgagttccccggcgactacagctgggacaccaccgggctgtccaccgaccccgaaaacttcgccaagaaccgcgagcatggaagtgatccactcccgctgtggccatgctccgcgcgcatcggatgcatcttcccccaactggtctcccgcaacggggtcaagttagagtgaggcccgtctgggtttaagggccggagtccaaaattttccacgagagtcgggcctgaataacctacggcaacccccggcctggattcaacgcacaaaaacaaccctcccccatctggggccctgccatagaggggctaattgggggtgccgtccagagggcatacccggaagtgactcgcggaggctctcttctggagaagggccatagaaactcggcttgtaatcctgggataggcatgctttagaacccccatcggcg

SEQ ID NO: 65453 - protein, 124 aa, Zea mays
  misc_feature: Ceres CLONE 1536730
MAASTMAISSTAMAGTPIKVGSFGEGRITMRKTVGKPKVAASGSPWYGPYRVKYHGPFSGEPPSYLTGEFPGDYSWDTTGLSTDPENFAKNREHGSDPLPLWPCSARIGCIFPQLVSRNGVKLE

SEQ ID NO: 65454 - DNA, 777 bp, Zea mays
  misc_feature: Ceres CLONE 1536739
  misc_feature: Translation starting site: 229
  misc_feature (1)..(1): n is a, c, t, g, unknown, or other
  misc_feature (17)..(17): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nccttactgtacctaangcttcagatgcacnnccnnnnntttnnnnnnccaaaactggagctccccgcggtggcggccgctctataatagtggatcccccgggctgcaggaattcgtctcacccctagaaaaaaaaactccgtttcgaattctagggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagataagtttggtggcctcccggatggatactatatccatggccacgtgtgcgatcatcatgtttgatgtaacttcaaggcttaacttaccagaatgttcctacgtcgcatagggacctgtgccgggtctgtgaaaaactccccattgtcctctgctggaaaaaggctgatgagaagaacaggcaggtcaaagacacactgggttccttttcctcaggaagaaaaattctcccgtacctggcaaattttctggccaggaaccaacttccagcttttgaaaaaaccctttccctggtaccctttccaagggaaactctggtagggtgaatccaaa

SEQ ID NO: 65455 - DNA, 792 bp, Zea mays
  misc_feature: Ceres CLONE 1536740
  misc_feature: Encodes the peptide sequence at SEQ ID NO. 65456
  misc_feature (44)..(44): n is a, c, t, g, unknown, or other
  misc_feature (792)..(792): n is a, c, t, g, unknown, or other
gatttctcctttatgcagatttttgaatacaacatgaaatgaangtcatactgggactccccgcggtggcggccgctctttactagtggatcccccgggctgcaggaattcgtctcacccctagaaaaaacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgacgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaacccccacgagatcccgtggggttcggttggtgctgaatatgttgttgagtctactggtgttttcactgaccaggagaaggctgcagctcactttgaagggtggtgccaaagaatgttgtcatctctgctccaagcaaggatgcctccatgtttgtcgttggtgctatccataaaggattacagttctggaatttaacattggcttccaattgctatcctgtacaagcgaactggcccttgtcaccctcttggctagtggtcaatcaaatgtacaaagtttagagtaatacctacgaaggggtcctagaatgaacgcgcttggagcgagtggccattn

SEQ ID NO: 65456 - protein, 147 aa, Zea mays
  misc_feature: Ceres CLONE 1536740
  misc_feature (4)..(146): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDDELVAVNDPFISTDYMTYMFKYDTVHGQWKHHEVKVKDSKTLLFGEKEVAVFGCRNPHEIPWGSVGAEYVVESTGVFTDQEKAAAHFEGWCQRMLSSLLQARMPPCLSLVLSIKDYSSGI

SEQ ID NO: 65457 - DNA, 836 bp, Zea mays
  misc_feature: Ceres CLONE 1536747
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (836)..(836): n is a, c, t, g, unknown, or other
gtcttatgtgtgtgggntgcttcaatttctttnnnnttnnnnnnntaatgctggagctccccgcggtggcggccgctctagaactagtggatcccccgggctgcaggaattcgtctcacccctagaaaaaaactacaaccggagtaccataacctatggacaacaccaacatggtcgtggtgaacgacgcgggattccggaatcctggcacggttcctcatcaagcccgcggcattccacccgtggcgcgaccgcgccaccacgcagcccacgcgccaacgccgccctaataaatcccctgcgctccgcgcccgccggctcgcaaccctaaccttcctcccctgctccgccgccgctgccacggtcgcctctactgccatggtgagcgccgaggtcggcatccattaccctgctgtggacggaggacgaggtgtccacccccgtggggcgaggtccccccccgagctccgcggcccgacctgaggccgtgtgccgggagccccaccgtcttatgtcgggtgttctcaacgaggcccggttccgctttcccgctgatgaacctcaggccggagttggtctaaagatgggggttttggaggtccagacttcgaagtgcgttttcagtccactattgcgatggggtttgcggagaactcgggggagatgtctctgggattcaagggcgtgagcctctgagagtacacactgagacccgggaacggcaggcagggtcgggggctaatcttatcctgtgcttcaccactgagggaggaacatctgactcccattaatcctacgtgttctcgttggaaccatgcatcggttgcccatccccn

SEQ ID NO: 65458 - DNA, 930 bp, Zea mays
  misc_feature: Ceres CLONE 1536748
  misc_feature: Encodes the peptide sequence at SEQ ID NO. 65459
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
tcttttgtcccttattcttnntntnnnnnnnnnnngaatcnnnnttagaagctggactccccgcggtggcggccgctctagaactagtggatcccccgggctgcaggaattcgtctcacccctagaaaaactcgagagatagagcgaggcaccaagaagggaaaaaaaagagggacaggaaaaaaatcattctcgtttcgctctccgctagaccccgcccaaatcaatggagattagggctccgccgacgagcctgaggctcgcgccgccgcccgcctccgccagcttccgccgaaccccgcttaggacctccttccttcgcggcagcgtgtcacttaaagttgtgcaagtacggcagtcaagtgtcaacagatttaagtgcaatagcatacgaacgcgaacctctttgacacggcaacagggggtgggggggtcctaccgcaaatgcagttcctaattcccctttgaagatccctgcaagaaattcttggtacgaggggcgttttttggggaaatgacttgtatgacctttgacttatagacggcgtgacgaggctctctagcagcgaagggttttttgggacatcgcgtatacggcgcggccttgggcggaaactagggagtgtttacacgcctgctagagaagaagaccatgtgcttagtcccgcacttcggggtttgcacacgcggtggctccaccccttatcgtctgtctcactacacggcgtccgactcgatggaactcccttgcccctgcccgcaatcacctcctgcgaggcgtgtgctcaaatcttcatacagcgtttgctaccatcgtccaagaacgtcttcgattgacattgcctcctatcatttggtacgtgggctccatagagggctgagtgtgtggtataagtctgataaagcaccacgactggcagagcggtactg

SEQ ID NO: 65459 - protein, 76 aa, Zea mays
  misc_feature: Ceres CLONE 1536748
MEIRAPPTSLRLAPPPASASFRRTPLRTSFLRGSVSLKVVQVRQSSVNRFKCNSIRTRTSLTRQQGVGGSYRKCSS

SEQ ID NO: 65460 - DNA, 829 bp, Zea mays
  misc_feature: Ceres CLONE 1536750
  misc_feature: Encodes the peptide sequence at SEQ ID NO. 65461
  misc_feature (829)..(829): n is a, c, t, g, unknown, or other
acaacattaataccacattgtgtatttttttataacactcaataaaagctggagctccccgcggtggcggccgctctttactagtggatcccccgggctgcaggtattcgtctcacccctagaaaaattccacggagccttccggataggatttgtctcccctccactgcgcctctccgtttccgccatggctccggccgccgccttcctgtcggcgtgcgccgctggttccattccccgtgcgcccttcctgatcccgaggcctcttcttctcccaattccgctctcccctgcacgctgggaccgctcccgcagctgcagcctctttggcgtatgcgccaacactcgccgcgcgcttacccttcgacggaacgcctccacagaaacggtggttccctacgcgccgggctctggcaagtacatagcgccggactacctcatgaagaatgtgtcatcccgatgatgtgtctcgagctggtggaagggtcataggaaagtgcctctcatcgattgacttctacgctacctgttgcagtgccctggtgttcagaatgcccttgaactcctagatgccttgcatattaagtatgaagaacaatgccctggtaggtgaaagtgggacacagatgtagaaatatgaacttttccaaattacatttccaggttaagaaggtcttcactacccctttaatttctttcgatgtctcgtaacaattactaaaaaatgtccattcagtcaccaaaggggggcctaaatgtccctatgggaatcttgctatttcgaactacactcctctttatgccaaactgtaattttattgtccatgcn

SEQ ID NO: 65461 - protein, 91 aa, Zea mays
  misc_feature: Ceres CLONE 1536750
MAPAAAFLSACAAGSIPRAPFLIPRPLLLPIPLSPARWDRSRSCSLFGVCANTRRALTLRRNASTETVVPYAPGSGKYIAPDYLMKNVSSR

SEQ ID NO: 65462 - DNA, 856 bp, Zea mays
  misc_feature: Ceres CLONE 1536751
  misc_feature: Encodes the peptide sequence at SEQ ID NO. 65463
  misc_feature (19)..(19): n is a, c, t, g, unknown, or other
  misc_feature (23)..(23): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (856)..(856): n is a, c, t, g, unknown, or other
tgtgtgtgttttttcttcnccancaccnccgcgcgnnnnnaaaccaaggaaatccaccccgagccggccgctctggactagtggatcccccgggctgcaggaattcgtctcacccctagaaaaatgcgccgcttgccaccttccgcctcgcctttccatgaccacgccgctcctgctgtgatcctaggacgacgcgcctcccgactgccttcgcacgctaggagtggggtggggaggggaggctgagcacgagcgccgcccaacgccaacgccaagacgagctcgcgaaggagtgaccatgccgagatccaggggcaacgagccgccgccgcggggcgtcgcagcgcgcgccgctgcacctcaagacgacggcctgctccaaggcgaatgggtcgcaccaccgcccccgccgccgagcgggagagcccctaggtcggcgaccggtacccccccccccagcccctctgcccgaaaaaaacccccccggccctgggacccctgcggcggaacctggatggccaagcttggggatagtggcacgcacgagcctcaagaaagctgcccggaagcaagcttccccgtcccgtttgtggggcgcccaaagtagagaaccctcccaggtctccgtctcctccggaacctccaaaaaagccgcgctcggggccgcatcgggacagcccggggccctctttcattcttgctagctgacctcctgtcgtgagacttgttgctttcgcgtttcccccggcgagtatggtgggttccaagacctcgtataaaattcccaagggtacccgtaagtctgtccctgaccgcgggctgtgtcgcacagactggaaataccgcggaaacgccn

SEQ ID NO: 65463 - protein, 34 aa, Zea mays
  misc_feature: Ceres CLONE 1536751
MVGSKTSYKIPKGTRKSVPDRGLCRTDWKYRGNA

SEQ ID NO: 65464 - DNA, 883 bp, Zea mays
  misc_feature: Ceres CLONE 1536754
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (223)..(223): n is a, c, t, g, unknown, or other
nctgctgtctctcctnnnngggggnnnnnnnnnnaacannnnngagattagtactcaccgccgtggcggccgctctagaactagtggatcccccgggctgcaggaattcttctccccctaaaaaaaatctcgtcccccggagcctctccttcccggtctcctccgcccgttgccttcgtcccctcccatctccggctgcgttgccggcgaggccggcaccttnaaatcgatccgccgacaaggtgagatggaacacatgggtctcacgcttctcccctctgtttcgccggctgttctcctatatgtgcatctcgatcttgctggtgttttcttccggggtggggaggaactcctttccgtttttttcttatgttgacgtctatttgcctagatctcccgcctttttttttccccccttccggggggggggagggggggcatctctcctctcccctcctcctttgtccccccccctggtcgtgcttcgtctttattttctggtggccggggctcgggtctttccctctccctctcgtccgttcactgccctcttgccttgagcttctttgcccttgttcgggtctcgttcccccgtcccctcccccatccttccgttcccccctctcctcttctcttcgcacggttcttgatttctcacattctcatcccttcctcgctactgttcaccctcctatgctctgcgatgtgtcgcttgctttggtttcttcttgtgaagctcatggagttcgtgttattgttcgcgctttccgtgtcgtctccccttgctgccctatattcacgttcgttttgaccctttcgttttgttgttctggttcgcctttgtcttgcgtgatgctgctctgatgttatagaccgtgcgtct

SEQ ID NO: 65465 - DNA, 787 bp, Zea mays
  misc_feature: Ceres CLONE 1536760
  misc_feature: Encodes the peptide sequence at SEQ ID NO. 65466
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (25)..(25): n is a, c, t, g, unknown, or other
nnnnnggggggnnggnnggtgctcnttggtcgtgggtggggggtcttcatttttcctttactccccccctgtccgcctctcttctctactggatcccccgggctgcatgaattcgtctcacccctagaaaaatccttccctccgcctccgcccccgcccactcctggcttccaccactcctgtcacctcttcccgcgccgacgcagccgccatggaccccgtctccacatgggggctaaccccgctcgcgggcgcctacccggagatctacgacctcctggagcgcgagaagcggcgccagcgtctcggcatctagctcatctcctccgagaaccttcacctccttccccgtcatgtaggccggctcggctccgctctcactaaaacaagtaactccttagggcatgccccgttggccctcttactacagcggccaactaacgtcattctaccaaaatccgataaacctcctgccggggtccaagcgtggctctatctggcccttttccaacccttgagacgcccgcccgttcctggggggccgcctcaacagggggataacccccacaactttgtagaattccacccgcacaaattttaatgcagcccataaaaccaggccattgcacaaacccgacacaaacaacagatatatacggggtatcttaaaacttttccccccagagggggaaaacccccccactcacagggggatatataaaagaggacggggaggagaaaaaaaaatttttcccccccgccgccgaaacataattttggggaaacg

SEQ ID NO: 65466 - protein, 34 aa, Zea mays
  misc_feature: Ceres CLONE 1536760
MDPVSTWGLTPLAGAYPEIYDLLEREKRRQRLGI

SEQ ID NO: 65467 - DNA, 663 bp, Zea mays
  misc_feature: Ceres CLONE 1536761
  misc_feature: Encodes the peptide sequence at SEQ ID NO. 65468
agtggatcccccgggctgcaggaattcgtctcacccctagaaaaagtctctgaacagcactcataccttgctagccatggacgcggccatcgccgggcagcaggcgaggcgccggatccagccgccggaaccactcgtgatggccgggacgccgccaacgcccgcagcgttccggtgtccgatctcgcttgaggtgatgcggtcgccagtcagcctccccaccggcgccacgtacgaccgcgcgtccatacagcgttggctggactccggccaccgcacctgcccggccacgcggctgccgctggcgtccaccgacctggttcccaacctgctgctgcgccgcctcatccacctgcacgcggccacgctgccgccttccccgtcgcccgaggaggtgctgtcgcagctggccgccgcagacggggagcccgcggccgcggagaaggccgtgcggtcgctggcggccaagatcgcgccggagaaagggaagcgggcctcggtcgcgtccgcggtgtccgccgatctcgactccgcggtgccggcgctcctctcgttcgccaagggcggggcgggcgccgacgcgcgcgtggacgcggtgagggtccttgctaccgtggccccggagctggtcccttacctgacgggggatggcacggagaatcc

SEQ ID NO: 65468 - protein, 195 aa, Zea mays
  misc_feature: Ceres CLONE 1536761
  misc_feature (29)..(101): Pfam Name: U-box Pfam Description: U-box domain
  misc_feature: SWISSPROT Homolog: EC 5.2.1.8 Peptidylprolyl isomerase
MDAAIAGQQARRRIQPPEPLVMAGTPPTPAAFRCPISLEVMRSPVSLPTGATYDRASIQRWLDSGHRTCPATRLPLASTDLVPNLLLRRLIHLHAATLPPSPSPEEVLSQLAAADGEPAAAEKAVRSLAAKIAPEKGKRASVASAVSADLDSAVPALLSFAKGGAGADARVDAVRVLATVAPELVPYLTGDGTEN

SEQ ID NO: 65469 - DNA, 771 bp, Zea mays
  misc_feature: Ceres CLONE 1536767
  misc_feature: Encodes the peptide sequence at SEQ ID NO. 65470
cccccccccccccccccccgcccgcacgccgccccccccccccccgcgccgctcctggaacaccctgcggtgagggccgctctttatctagtgcatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcatgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagaccttcgccaagaaccgggagctggaggtgatccactcccgctgggccatgctgggcgcgctcggctgcgtcttccccgagctgctcgcccgcaacggcgtcaagttcggcgaagccgtgtggtttcatggccggctcccaaatcttcatcgagggcggggctggactaccctcgggaacccgaagccctcatccacgcggcagaacatcccttgctaatccgggccctgcccaggttcgtggcctccactgggccgcccgttccaaggggactaacgacaattcaacaggtagggcccg

SEQ ID NO: 65470 - protein, 162 aa, Zea mays
  misc_feature: Ceres CLONE 1536767
  misc_feature (65)..(160): Pfam Name: Chloroa_b-bind Pfam Description: Chlorophyll A-B binding protein
MASSTMALSSTAFAGKAVNVPSSSAFGEARMTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFHGRLPNLHRGRGWTTLGNPKPSSTRQNIPC

SEQ ID NO: 65471 - DNA, 776 bp, Zea mays
  misc_feature: Ceres CLONE 1536768
  misc_feature: Encodes the peptide sequence at SEQ ID NO. 65472
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (776)..(776): n is a, c, t, g, unknown, or other
nnnnnnnnnnnnnnnnnnnnnggaaaanggggggggggngggggnnnaaaaatgggactccccgaggtggcggccgctctagaactagtggatcccccgggctgcaggaattcgtctcacccctagaaaaaattccacggaatctctcccagctgtcctgtttttccttccatggatccccctcgctagctgagcccgctggtgctcgcggtcgcgggtggtgagcgcggcctcgccggcggcgcagcggcgatggacctcccgtggctggatctgcccttcaccttcctgacgctgctccttgccacccgcctcgcctacgactactatggcgacgtcgccgccgccttcgccggcggcttctcgatccaggtcttcctcttctactgcttcgcgcgctggtaccgctacgccatcgccggccgcgccgccgccgccgctggggcccgcgacgacccgtcgccgtcggcgcggccgccgccgcagcaggaggaggacgcggacgccccgcccgtcctgacaccgctgctggggtcgccggacagcgcgcggccgtcgacgctggccaaccgttgcttcgccgtcgtgttcatgggcttcgaggccctgatcatcttcttttttctagcgggatccaggccgacgtcttgggcctacttctctctgcctccccaaaatcattcatcatggttcgttctggtctctcgcccgacaaccgagtcaaacggtctctggacgcacaattcacatcctggccttctcaatcgaacaaaaan

SEQ ID NO: 65472 - protein, 174 aa, Zea mays
  misc_feature: Ceres CLONE 1536768
MDLPWLDLPFTFLTLLLATRLAYDYYGDVAAAFAGGFSIQVFLFYCFARWYRYAIAGRAAAAAGARDDPSPSARPPPQQEEDADAPPVLTPLLGSPDSARPSTLANRCFAVVFMGFEALIIFFFLAGSRPTSWAYFSLPPQNHSSWFVLVSRPTTESNGLWTHNSHPGLLNRTK

SEQ ID NO: 65473 - DNA, 698 bp, Zea mays
  misc_feature: Ceres CLONE 1536773
  misc_feature: Encodes the peptide sequence at SEQ ID NO. 65474
  misc_feature (698)..(698): n is a, c, t, g, unknown, or other
ccgcggtggcggccgctctagaactagtggatcccccgggctgcaggaattcgtctcacccctagaaaaaatccgccgtcgagcacacaacacatcctcctccaagactcgcttcgcttctcccccagctcggacggagctcctcgcagtcgcagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgn

SEQ ID NO: 65474 - protein, 150 aa, Zea mays
  misc_feature: Ceres CLONE 1536773
  misc_feature (20)..(150): Pfam Name: Pkinase Pfam Description: Protein kinase domain
  misc_feature: SWISSPROT Homolog: EC 2.7.11.1 Non-specific serine/threonine protein kinase
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLL

SEQ ID NO: 65475 - DNA, 776 bp, Zea mays
  misc_feature: Ceres CLONE 1536776
  misc_feature: Encodes the peptide sequence at SEQ ID NO. 65476
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
nnnnnnnnnnnnnnnnnnnnnggggtttccccnnccctatttngtcacactggagctccccgcggtggcggccgctctagaactagtggatcccccgggctgcaggaattcgtctcacccctagaaaaacatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttcgcctagtaccaggcctacgagctgatccatgccagatgggccatgctcggtgccgctggcgctgtcatcccagaggcctgcaacaagttcggcgctaactgtggccctgaggctgtctggttaaagaccggcgcgctgctcctggaacgcaacacccctcaacaacttcggcaaacagaataccccatccaaccttgtgggtgggccataaactcccggaggttcaacccccttcggggaggaccacaataacaacctgggat

SEQ ID NO: 65476 - protein, 111 aa, Zea mays
  misc_feature: Ceres CLONE 1536776
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFA

SEQ ID NO: 65477 - DNA, 868 bp, Zea mays
  misc_feature: Ceres CLONE 1536784
  misc_feature: Encodes the peptide sequence at SEQ ID NO. 65478
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (82)..(82): n is a, c, t, g, unknown, or other
nnnnnnnnnnnngggggggnnaacccccnnnnnnnnggaaannnnaccaaagtaggactccccgcggtggcggccgctctanactagtggatcccccgggctgcaggaattcgtctcacccctagaaaaaatccacacctgagtcccctccgccgcctgccgcactctcccgcgacgccaccaccacacgttcacggtagcgagagcttatcgtcgtcggcggcgaagatggtgtctctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcataaggttcactctaggtcccgtggcaagaagggcccatggaggccgggcgggaggggaacgcacttctggatatgggaaagcccacgggtacccagggaaggctagggctcccccaccaagatttctggtgggatgaaggaggaattgcttgtttcccgaacgcgcctctggttcttgcaacgttacccgtggaagggccaaaaaaaaacccaacatagccaccttgttatccctgaaacctggacaccaggatgcgttccagggggctattattgtttgtaaaaatacacgggggcgcgttctctcttgggagaagttgattacaataagtgtccgagggcgtttgaaaaagggcccaaacgaggaaagaaaccttacgccggaatcaaagttcataacgcacttgaggagatgtaaaaaaacaaaacacccgaccccaccccaaacaataataaaaactccgctggcacacgcg

SEQ ID NO: 65478 - protein, 89 aa, Zea mays
  misc_feature: Ceres CLONE 1536784
  misc_feature (2)..(89): Pfam Name: Ribosomal_L19e Pfam Description: Ribosomal protein L19e
MVSLKLQKRLAASVLKCGKGKVWLDPNEVSEISMANSRQNIRKLVKDGFIIRKPHKVHSRSRGKKGPWRPGGRGTHFWIWESPRVPREG

SEQ ID NO: 65479 - DNA, 779 bp, Zea mays
  misc_feature: Ceres CLONE 1536789
  misc_feature: Encodes the peptide sequence at SEQ ID NO. 65480
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (43)..(43): n is a, c, t, g, unknown, or other
  misc_feature (44)..(44): n is a, c, t, g, unknown, or other
nnnnnnnnnnnnnnnnnnnggccgggnnnnnnngggggggttnnacaaactggagctccccgcggtggcggccgctctagaactagtggatcccccgggctgcaggaattcgtctcacccctagaaaaaaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggaggcgccaccaacggcacctgggacggcatcgtcccgccggagtgcgcgccctcggaccgcatcgtccgactctcccccgcgcttcgctgggagcaggcgcgcgagccgctgcacgccggtgtccacttgggcaacgttctcggcgtcgggcccggcatgcccttcgcgcacgccgtgctcaccagcaagggcgcagccgcagagccccccgtcgtcgtcgggctcgtgccgtgcgcgccagtcggcacgccgatcgcccaactggtcccgggggaccgaactgtactaacggatggtgacctcccgccagggcggcccggggcccactgcaacggaagccagtccccttgacctacttggattgggggccccgggcgaaggccgaaaccccggaggggggcaggaatgcctgaaacttctcacccaacggcccggacgcgaaaccccccagaggcgaagatagactctacaaaccaccctcctg

SEQ ID NO: 65480 - protein, 163 aa, Zea mays
  misc_feature: Ceres CLONE 1536789
MALLTLQQPAIPFLLLLLLLPAASARLPGGRTLVFILAGQSNMSGRGGATNGTWDGIVPPECAPSDRIVRLSPALRWEQAREPLHAGVHLGNVLGVGPGMPFAHAVLTSKGAAAEPPVVVGLVPCAPVGTPIAQLVPGDRTVLTDGDLPPGRPGAHCNGSQSP

SEQ ID NO: 65481 - DNA, 645 bp, Zea mays
  misc_feature: Ceres CLONE 1536792
  misc_feature: Encodes the peptide sequence at SEQ ID NO. 65482
  misc_feature (46)..(46): n is a, c, t, g, unknown, or other
ggagctccccgcggtggcggccgctctagaactagtggatcccccngggctgcaggaattcgtctcacccctagaaaaacccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtgggtgggtggcgctgcccaacgagcaggtcgcggcggcggcgtcgcgcgcgtcctacgcgctgctgtgggtgcgccggaacgtggcggcgtaccacccgggcacccaggatccagggcatcgccggggggcaacgaaggggttcccgtcggccaaaaacgtggacggggccaccttggtcccggccatggaccaacaggggccccccccgggttgggccagggttcgggccctcaaagggggggccccccaagggggtccctcccccccccttcg

SEQ ID NO: 65482 - protein, 169 aa, Zea mays
  misc_feature: Ceres CLONE 1536792
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVGGWRCPTSRSRRRRRARPTRCCGCAGTWRRTTRAPRIQGIAGGQRRGSRRPKTWTGPPWSRPWTNRGPPRVGPGFGPSKGGPPKGVPPPPF

SEQ ID NO: 65483 - DNA, 761 bp, Zea mays
  misc_feature: Ceres CLONE 1536799
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
nnnnnnnnnnnnnnnnnnnnnnccggggnnnnnntttttttacgaaaaactggagctccccgcggtggcggccgctctagaactagtggatcccccgggctgcaggaattcgtctcacccctagaaaaacaatcgagttgagttttttcattccaagtcattcttgcatagagatatcaagcctgacaattttctcatgggtctgcgggaaaagagcaaaccaggtttatgttatcgattttggacttgcatagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgcgaggaaggttgtttactgtaacatgattcgccgtttcacctctcattttctgatgtctgggttaatacatggtttgcctactgtcagccttccatggcagggcctgaaagctgggaacaaaaaacaaaagtatgaaaagatcagcgaaaggaaaattgctacttcaactgaggctctctgccgtggatatcctaccgaatttgcttcttacttccattactgtcgctcactgcgtttcgaagatgccccggactatcagtacctgaagagattgttcaaaaacctttttattccgggacggttttcaagtttgagaatgatttttgaatggaccactccacaaacac

SEQ ID NO: 65484 - DNA, 653 bp, Zea mays
  misc_feature: Ceres CLONE 1536802
  misc_feature: Encodes the peptide sequence at SEQ ID NO. 65485
  misc_feature (488)..(488): n is a, c, t, g, unknown, or other
  misc_feature (501)..(501): n is a, c, t, g, unknown, or other
  misc_feature (533)..(533): n is a, c, t, g, unknown, or other
  misc_feature (561)..(561): n is a, c, t, g, unknown, or other
ccgcggtggcggccgctctagaactagtggatcccccgggctgcaggaattcgtctcacccctagaaaaaagcaagagaaacacaaggtcgaggtggtgaggcatggagctcgccttgggggccatgaccagcttggcccctaagcttggcgacctgctcatggagaagtatgtcgtgcagaagggcctcaagcccgacatcgagtctctctccagggagcttgtgatgatgaacgccgctctcgtcgacgcgtcccgggttccacctgaccagctcaccgaggtggaaaagctctgggcacgcaaggtccgggacttgtcgtatgacatggaggacgccgtcgacgatttcatcctgcgtgtggctggtggtgacgactctgccgccgactccaaattcttcaagaagacccttgccatggtcaaggacgtgatgtcgatgaagaagttcaggatcggcgccagatctcccgacaggtcaagacatncagaaactctccnacgagttagctgaacttcgtgccaagtacacngtaagggggtgtgggtgctgatcttgcngcgagcaccggcatcgaaccccgtgtcatcaatctgtacaagaaagagacagatctcgttggtatcgaggaagtcagggacaaagtcattag

SEQ ID NO: 65485 - protein, 136 aa, Zea mays
  misc_feature: Ceres CLONE 1536802
  misc_feature (129)..(129): Xaa is any aa, unknown, or other
  misc_feature (133)..(133): Xaa is any aa, unknown, or other
MELALGAMTSLAPKLGDLLMEKYVVQKGLKPDIESLSRELVMMNAALVDASRVPPDQLTEVEKLWARKVRDLSYDMEDAVDDFILRVAGGDDSAADSKFFKKTLAMVKDVMSMKKFRIGARSPDRSRHXETLXRVS

SEQ ID NO: 65486 - DNA, 672 bp, Zea mays
  misc_feature: Ceres CLONE 1536807
  misc_feature: Encodes the peptide sequence at SEQ ID NO. 65487
  misc_feature (430)..(430): n is a, c, t, g, unknown, or other
  misc_feature (438)..(438): n is a, c, t, g, unknown, or other
  misc_feature (458)..(458): n is a, c, t, g, unknown, or other
  misc_feature (463)..(463): n is a, c, t, g, unknown, or other
  misc_feature (501)..(501): n is a, c, t, g, unknown, or other
  misc_feature (503)..(503): n is a, c, t, g, unknown, or other
  misc_feature (516)..(516): n is a, c, t, g, unknown, or other
ctccccgcggtggcggccgctctagaactagtggatcccccgggctgcaggaattcgtctcacccctagaaaaaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccngggatcanggtggacaggggcttgtccngctcngcggctccacaacgagtcgtgggtgcagggcctggacngnctgggcgtccgcnaggcccctactaccacaagggccggcggttcgccaatggggcacgtcgtcaggatcccttaagggccctccgagattcccttcaagggaggccccgggggggctttcaaacttaacccccctttttcaaggaaaaacgggtttgggcccatccggg

SEQ ID NO: 65487 - protein, 166 aa, Zea mays
  misc_feature: Ceres CLONE 1536807
  misc_feature (11)..(166): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (103)..(103): Xaa is any aa, unknown, or other
  misc_feature (110)..(110): Xaa is any aa, unknown, or other
  misc_feature (124)..(124): Xaa is any aa, unknown, or other
  misc_feature (125)..(125): Xaa is any aa, unknown, or other
  misc_feature (129)..(129): Xaa is any aa, unknown, or other
MVVRASAYADELVKTAKTIASPGRGILAMDESNATCGKRLASIGLENTEANRQAYRTLLVTAPGLGQYISGAILFEETLYQSAVDGRKIVDILVEQGIVPGIXVDRGLSXSAAPQRVVGAGPGXXGRPXGPYYHKGRRFANGARRQDPLRALRDSLQGRPRGGFQT

SEQ ID NO: 65488 - DNA, 784 bp, Zea mays
  misc_feature: Ceres CLONE 1536808
  misc_feature: Encodes the peptide sequence at SEQ ID NO. 65489
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (26)..(26): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnnnggggggggncccnnnnntttttttnnnnngaacactggggctccccgcggtggcggccgctctagaatagtggatcccccgggctgcaggaattcgtctcacccctagaaaaaatggccgccccagcgtcgccgatactgttcccagatctcttgctaggagtagcctgccccgtgtgcgcgctcgcacggacatgcttgtttccgcgtcttgaaaggcgagaaaaagtggagatgggtgcttgcgcttcggtacacaaggacccggggcaccccaagaagcagtttcttgactcgcccaccaaggcgaaagccgccaacggaaacggtggcggaggcggcggtgttgctccggttggtgatggcttcggcgatctcaagtccacgggcaacgctgaggctgagcaactgcgggcagagtgtagccccaagaacccggattctggtaacaaggatgatatgttcttcgaacctcgagcctggttagatttcgactgccatgatgacttctaacgcttgaatggaagatttcctccgtcccggggcagcacccccggttttacccccccagatccccgaccgggatgagccccctcctttcccgcttgcccggggcggtttccaaatagggggagacccttcttccaactgggacggcaaaaaggctctgtggaactggctgcggggaatctaggtgaaggccggtctccccaacagaggccccccactggcccgggcggaggccatgggagctagtcgccccccccg

SEQ ID NO: 65489 - protein, 132 aa, Zea mays
  misc_feature: Ceres CLONE 1536808
MAAPASPILFPDLLLGVACPVCALARTCLFPRLERREKVEMGACASVHKDPGHPKKQFLDSPTKAKAANGNGGGGGGVAPVGDGFGDLKSTGNAEAEQLRAECSPKNPDSGNKDDMFFEPRAWLDFDCHDDF

SEQ ID NO: 65490 - DNA, 683 bp, Zea mays
  misc_feature: Ceres CLONE 1536810
  misc_feature: Encodes the peptide sequence at SEQ ID NO. 65491
  misc_feature (651)..(651): n is a, c, t, g, unknown, or other
ccgcggtggcggccgctctagaactagtggatcccccgggctgcaggaattcgtctcacccctagaaaaagagccccacccccacgccacacaccaccaccggacgctagctcaccaccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcangacgctggcaaggtggagctggtggatgggtc

SEQ ID NO: 65491 - protein, 176 aa, Zea mays
  misc_feature: Ceres CLONE 1536810
  misc_feature (63)..(176): Pfam Name: Chloroa_b-bind Pfam Description: Chlorophyll A-B binding protein
  misc_feature (166)..(166): Xaa is any aa, unknown, or other
MASSVAAAASTFLGTRLADPVPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALTVEWLTGVTWXDAGKVELVDG

SEQ ID NO: 65492 - DNA, 743 bp, Zea mays
  misc_feature: Ceres CLONE 1536814
  misc_feature: Encodes the peptide sequence at SEQ ID NO. 65493
  misc_feature (743)..(743): n is a, c, t, g, unknown, or other
aaaagctggagctccccgcggtggcggccgctctagaactagtggatcccccgggctgcaggaattcgtctcacccctagaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggaatcatctacgccatctacgccatcaccaagaacaactagctagtcatccttggcgattactatccccccctcggggaggggggggggtcatatgcctgatgcccacttgtgctgtatgtagttgcctgaattcagtcccggtttgctaccgtaccccccccatgtatcatctgtttccgcgacggaatatttcttgggtgatagccaggtttcagaaattgattccaataaaaaaagaaaaaaagccggcggggccgggggggcccccgtcccgccccgggagtggggcgccgtttacccccccccctccccttgccgcaacgttatttaaactctctgcgtcgggggtacaacccccgcgcccccaccccccccgtcattttccccctgtgagtcgcaatctctctgctttctccaccccgggggttan

SEQ ID NO: 65493 - protein, 58 aa, Zea mays; identical to SEQ ID NO: 46528
  misc_feature: Ceres CLONE 1536814
  misc_feature (6)..(56): Pfam Name: UPF0057 Pfam Description: Uncharacterized protein family UPF0057

SEQ ID NO: 65494 - DNA, 948 bp, Zea mays
  misc_feature: Ceres CLONE 1536817
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (598)..(598): n is a, c, t, g, unknown, or other
  misc_feature (599)..(599): n is a, c, t, g, unknown, or other
  misc_feature (932)..(932): n is a, c, t, g, unknown, or other
nnnnnnnnnnnnnnnnnnnnnnnnnnnnnnnnnnnggggnnnnaaaaccaannnnnnnaaaactgggactcaccgcggtggcggccgctctagaactagtggatcccccgggctgcaggaattcgtctcacccctagaaaaacttcctcctcagcatcgtgtccggtggggtcgtgctcgttggtattgtcggcgccatcttctccgtctccaacttcgaccccgtcaagagggcctgatcggaatccctcttatccatcgtttcgcctgtgtcctgttctgtgcctgtggtgtttttatcggcttggcgtgctttttccccttgggcggtaattgatatttgactatgtttttcccttctctctgggtggcagaaatgcccgcacaattttttttcttcttcgggccaaaatatacgggggataaaagtttttttttttctttcccccccgggggaggggggggggtggccttttacttcccccctccccccccataagtgggcccgggcggaggggggaaataattatttcttttcttattccccctcgccttcctttcaccttttgttttgggttctcttgggaaataaagctcnnccttctcccctctcccccccttccaaccctcccattgcgtctctatttcgcacccctccctccttctcacccccggcgttgcgccctcggcgatcaataggagtggggtgcggttgttattttcatcaactttattcttcctatgcgcatcccccaccaccccccttacactatttctttttctgcgactttttattatgttctcttccctctccctccttgtcttggtttactctcctactctatcgctctctccccccccacatcatttatagcgttgtatctattaatcccaccaacccccctctttgtttgtccaccccccccgcacantctcacaccatccccc

SEQ ID NO: 65495 - DNA, 930 bp, Zea mays
  misc_feature: Ceres CLONE 1536819
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnggggggaaaggggggngggaanggnnnnnnnncccctctnnnncaaagctggactcaccgcggtggcggccgctctagaactagtggatcccccgggctgcaagaattcgtctcacccctagaaaaaaagcctgaactcgtacagatcaatcatcctggtgcttccagcgacgtctataggtatactgtggcctgatgatgagctctggtttctatcgagttctttgactgtgttgccttgtctcctccaccccctctccctgtgactgtgagtactatcttcgaggtacttgcggcgaagacggatatggcttctttcctcctaggcggtagcttctccctgttatggggtgagtacttggttccctttacccgtcttggcggggctagttcctatgttgtcatcgggcgcctttttttttgttcccgccccccctgggggggggagggggggaccctcttccgggttattaaccacaacggttggatacggggggggaccgcggggaaatgggaagcggggggcgcaattggggccccatattgtcaaatgggtgtttgttgaaattcttccattgtgttggggggcatttcggcgtctttccgggtccgccccaaaattgtgggggaacaaaaaccctaatggggaactgcccgcgggcgcgggtgaattagcgttacgggcgggctgtaaaacgggcacacaaaagggcctggaaccatacaaaggggggtgtttctctatattgacctatcgaatggtgcgtataaaacctagaaaacaaggtgtggaacaagatagggggggggtgggggggaaatggaataaaaaagtgtgcaaaacaattggggtggggggcgctccgcaacggtggtgcctgggaaaaaagggagggcggcggcacaggggaccaccggcgttagtcg

SEQ ID NO: 65496 - DNA, 930 bp, Zea mays
  misc_feature: Ceres CLONE 1536820
  misc_feature: Encodes the peptide sequence at SEQ ID NO. 65497
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (436)..(436): n is a, c, t, g, unknown, or other
ggggggggggnnnnnnnnnnnnttttnnnncnnnnnnaaaannnnnaaaaactggggctccccgcggtggcggccgctctagactagtggatcccccgggctgcaggaattcgtctcacccctagaaaataagtttgagagatatctgatgggtgagattctatcgatcggtgctgaagtcagtgaagttgaggctgggaagaaggttctcttctcagacatcaatgcttatgaggtggagcttggtactgatgaagagaagcactgcttctgccgtgagtcagacttgttagcctgtattgaatgaattttaccatgaaaatttcggacttacctggggatgctccaactgggtggaactgttctttgccccccacttttgttctactgccattttaaacgttcggtgaaggcccgttttttttttccccccccntactcgggggggggggggggggagggacttcttgatctttcctttccttcgcgccccccccccctccgcgatggcctccgggcgtgccctgtggtgtgttttactcaccatttgtcgctctccccttcttctcgggttcggtttctgggtttacctacccgcctgcccatattgtgcgcagtccccctccccccgcgcgggtcgccggcggcagcctagggggtggtgttgttctctcccctccccgtctcccggtgcgctgcttcctcgcgtacccgcccgcccctctcctccccgcagcgttcccccaccggacgcggcccctccctctccctcctcttccccccctccacccccctcgtccctccctctcccccctctcccccctcccttccccctctccccctctccctcctccgctgcgcgcgccccacgcgccgcacgaggggcgacgcctggcggtgcgcttaacacgcagacggccgccgcgtggc

SEQ ID NO: 65497 - protein, 52 aa, Zea mays
  misc_feature: Ceres CLONE 1536820
MGEILSIGAEVSEVEAGKKVLFSDINAYEVELGTDEEKHCFCRESDLLACIE

SEQ ID NO: 65498 - DNA, 895 bp, Zea mays
  misc_feature: Ceres CLONE 1536826
  misc_feature: Encodes the peptide sequence at SEQ ID NO. 65499
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnggggggnnnnnnnncccccnnnnaagggaaannnnncaaagcatggactccccgcggtggcggccgctctagaatagtggatcccccgggctgcaggaattcgtctcacccctagaaaaaatcaggcatccaagcttaaagcaagcagatctaagctccaggcagcgtcgcgacagagtgagtgagtaccacgacaactacaatggcttccctgaaggccgcgaagcccaccggagttgcggcgcaaggcaaggagcccgcccccaaactcatcgagaccgctactaatcctgcggccgcgaagagtggctgcctttagaaggttgagctgatgcccggggagaggagacggaccccccccacttcgtgtcgcgcgggcggcgggcggcaaagtaggcgcccccgctttttttttttctcccccccccccggggggggggggggggggggttttttattccctccccccctcccttcgatcctcagttcccctaaaagaaaaaaaaaaaaaccatctcccccctgcgtcggcgcgggcgcgcggggctctccccgccccctctcccccagcggtcgcgcgcccgaggtcgcggagctcgcggcctcccgcagagcaactctcttgcccgacctcttatgatagtgggagaggcggagaggaagcgccagtgcggggggtgggcggtgccgtggggttcgtcccctgcgctccgcagtgccgcgctctaccgcgcattgccccctagtcctggcgcattgagccagtatgctggaatgccctaccacgcggcggggaagggaacgccagggggtggggggccggcaaggcgggcctggacctggggctgcgtcgtcgccgcccgcggcgagccgacgccgggcg

SEQ ID NO: 65499 - protein, 38 aa, Zea mays
  misc_feature: Ceres CLONE 1536826
MASLKAAKPTGVAAQGKEPAPKLIETATNPAAAKSGCL

SEQ ID NO: 65500 - DNA, 599 bp, Zea mays
  misc_feature: Ceres CLONE 1536828
  misc_feature: Translation starting site: 190
  misc_feature (326)..(326): n is a, c, t, g, unknown, or other
aagctggagctccccgcggtggcggccgctctagaactagtggatcccccgggctgcaggaattcgtctcacccctagaaaaagagcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccgggggctgtggaaggacatcaccaccaagatccaccacaagggtcaccgagaacttggatctccgncacgcttcctcttcacccccgtcgtcggcacctaccaatacgccatgtgggacaaggagccagaatagctttccccccggatattaaattgcccttgcccttgaagaacagcactccgaagttttcctgaaggggtttcaaaaaccccccccggaagatttaacctttggtttgaacaaatttccggttcaaccccttttttcctcgtttccctatgcatttttgggtatcccggggtcggggaaaattttttttttgggggctgggctaaaa

SEQ ID NO: 65501 - DNA, 939 bp, Zea mays
  misc_feature: Ceres CLONE 1536829
  misc_feature: Encodes the peptide sequence at SEQ ID NO. 65502
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (103)..(103): n is a, c, t, g, unknown, or other
nnnnnnnnggggggggggngggggggnnnnggggggcggcttnnnnnacaaactggagctccccgcggtggggggcgctctatttcatagagatcccccgggntgcaggattttcctcacccctagaaaaaaaggcaaaacgcggtgaggaggtcctgaaggccgaggagatggctgccaagtaccgggccaccggccacgcttctaagaagctcatcggttgcttcggagcctaagaagccttccaagtcacaccgagcagaaagtgacaacgtcctcctgtgattgcttggtcctctccctccatcactgtgtaatgtgtcttccaaaatttgtaaaccctacttctgctgctgcctatgaccgaattccttccacgccaagaccttagggcccgctactcggcgtaatgctttgttttggcgacccccctcggggggggggggggggggggcttcctctcttttctctttttcatttcttagcccctcctggggaaaaaacaccccacaggccaaagagccgcggccgtgtagttttgtcatgggataagttagtgacacgtttgtgtgggggtcctctaccccgacatattttgttttctcactctctcctcttactttattaatacttggcccaaaccacttaggccagtctgccaaacaagccgccgtagataagaaacagaaaatcgcaaacggtcgttggcttgtgtggcgggttcaccgaagacgagcgagcgtagggatgcccgttgccttttcctctccgtctctccgtccctcttacttccgcttttctctttccctatcttccccacaccgtcttccctgcccgacggttgctaccacgccatttcctttacccctccccttccctccttatattatctctatctctgcgtctgcaccgttgtctttgtcttctcttcgtacaaat

SEQ ID NO: 65502 - protein, 75 aa, Zea mays
  misc_feature: Ceres CLONE 1536829
  misc_feature (4)..(4): Xaa is any aa, unknown, or other
  misc_feature (7)..(7): Xaa is any aa, unknown, or other
  misc_feature (8)..(8): Xaa is any aa, unknown, or other
  misc_feature (12)..(12): Xaa is any aa, unknown, or other
  misc_feature (13)..(13): Xaa is any aa, unknown, or other
  misc_feature (32)..(32): Xaa is any aa, unknown, or other
GGGXGGXXGAAXXTNWSSPRWGALYFIEIPRXAGFSSPLEKKAKRGEEVLKAEEMAAKYRATGHASKKLIGCFGA

SEQ ID NO: 65503 - DNA, 850 bp, Zea mays
  misc_feature: Ceres CLONE 1536832
  misc_feature: Encodes the peptide sequence at SEQ ID NO. 65504
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
nnnnnnnnnnnnnnnnnnnnnnnnnnnnnnnnnnnnnnttttttttttttaaatacttataaaattnnnntttttttaaaactggtactccccgcggtggcggccgctctagaactagtggatcccccgggctgcaggaattcgtctcacccctagaaaaaacgtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccgggctaggctcagggagcgacttacaatgggaagtagtgcgataccttttgagagcaagggaatagcgagggaatctttgggcctttgggaaaaagaaatggttaatggaccattttttttttcccgggttggggtttcccgggagcaaaaactcgttggaaaatcgtcggcactcccggggcttgtgtacccacatcttcttttctcccccatcgcacacaacaaccaccccacatcataacagctgtctcgagaataaaaaaataataaaaaaaaataccaccgggggagattcttaacccattcttcccccccgcgccgccccgaggggggcccccccatttccccccccactttgtgtgggggcgcggttattacgcgcccccccccaagaggggggggccttttttttttcccacccccctcgccgtctgggagaaacaccctggggggggttccccccccctatattatac

SEQ ID NO: 65504 - protein, 89 aa, Zea mays
  misc_feature: Ceres CLONE 1536832
  misc_feature (10)..(66): Pfam Name: SecE Pfam Description: SecE/Sec61-gamma subunits of protein translocation complex
MDAVDSVVDPLRDFAKDSVRLVKRCHKPDRKEFTKVAARTAIGFVVMGFVGFFVKLIFIPINNIIVGSGLGSGSDLQWEVVRYLLRARE

SEQ ID NO: 65505 - DNA, 620 bp, Zea mays
  misc_feature: Ceres CLONE 1536835
  misc_feature: Pfam Name: RuBisCO_large Pfam Description: Ribulose bisphosphate carboxylase large chain, catalytic domain
  misc_feature: SWISSPROT Homolog: EC 4.1.1.39 Ribulose-bisphosphate carboxylase
cccgcggtggcggccgctctagactagtggatcccccgggctgcaggaattcgtctcacccctagaaaaatttggtggaggaactttaggacatccttggggaaatgcacctggtgcagcagctaatcgtgtggctttagaagcctgtgtacaagctcgtaacgaagggcgcgatcttgctcgtgaggttatgaattatcaaagcgcttgcaaatgagtgcttgactagcgcagcttgtgaatatgggaggagatcaaattttgatggttccaagcgatggatccctttttaattaaaaaaaaaagcccattgcaagagaaaaattggtttaaaaaaggcgaattcccctctttccccccaaatagtttggaattaaaatccgcgcaaattttttttaaaaaaaaaaatatataaaaaaaaattactaccgtgggaaaataaataatagttaaaaaacccctgggggccccccctcccccccaatgggggggctatttaaaccccccccccccgcgccccctttttttacaccccctgtgggagaaaaacccccggtggtcccacccaatatatacctctggagaaaaaccccccccttctcccgccgggggaaaaaaaa

SEQ ID NO: 65506 - DNA, 845 bp, Zea mays
  misc_feature: Ceres CLONE 1536837
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (82)..(82): n is a, c, t, g, unknown, or other
nnnggggnggggggggggnntttttttnnnnnnnnnnnnnnnnnnaaaaactggagctccaccgcggtggcggccgctctanaactagtggatcccccgggctgcaggaattcgtctcacccctagaaaaagcttgctatattgggaaccttggaattgagaacagcgtccctagctgtgattcgctcctttctcgttaaattatcatatgaataggccaagtccctacgttgaccggggggcgctctgtgctaaaaaaaaaaataagcagacgcgttaggtgccccattcccccctaattgaatgtgatgagaccgggatgacgggcccgtcccttccccccgacgtgactgtgtaggccctggcgcgtgcccacgtgtaccgcccttcgtcacctcccccctttcgggctccggtttccccctccttcaagggcgggggggggggggcacgtttcccctcccttacattcgcctcccccccccatacatacggccgcgttcgtgttctcatacattcttcccccttccccagaccgtgaatagtaattctgtcaagggggcctcgcattcattataccccctatcaagcccgaagtctcgaattcatactcagcttgtgcttgctgtggtaggtgggccggttgtgtcaggttggcaggcatccgcggggactcttcttgcgtcctttcctgtccccccaagtccccgtaacgcccgcctccggctccccccgcacccctcccacatacccccgccccacccatgccacgccggggtcgtgggaggcgcggatattaaaaaaagaatcaatggctactatttacaacctaccggggaaaccac

SEQ ID NO: 65507 - DNA, 890 bp, Zea mays
  misc_feature: Ceres CLONE 1536841
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (435)..(435): n is a, c, t, g, unknown, or other
nnnnnnnnnnnnnnggggnnaaaacccccccntntggataannnnngcaaactgagactcaccgcggtggcggccgctctagaactagtggatcccccgggctgcaggaattcgtctcacccctagaaaaaacatttattaacgatgttcgcattgctgcagttacaattcatagagacaacagagtatgaatagtagaagccgtttcggattaaagccaaactagcatgctctatcttttataaggacaaaattgcgccgaatgctctatcttttataagaaaaaaaattggggggaaaaaaaaaaaaaaaagcgaggggctcgagggtccccattcgtcctatcagcaagccggataaaccctccccgccttggttcttcgttttagtaaggtgaggtattgggaaaaaactagaaagtttttccttgccccngcccccaaggggggggggggggggtggtttctacaaatgggagaaaataggcgaaaaacggacggaagagggggagaaaactaatccctgacgcgtgcccggccgaccagagaagggaaggataggtgtagtattttatagtcacgtttattattctgtctaggatggaggcttgttccgcgcgttggggtgtaccactaagagaaaaacagtctttgtatttttaaaacataaatttgtctcatatagtagatgtaactaacactcgccaatatcatcgtgacaatgagcgatggtataaaatgcggcgagaggccgcgttcccgtgcgtgctccccgacatcccggagaacgctcccgaccaccccccgcgttgtcacgagaatctagcatacgagatatggtggtttttgtgggagacccaaacccttaacgccttaccatacaccgctacc

SEQ ID NO: 65508 - DNA, 661 bp, Zea mays
  misc_feature: Ceres CLONE 1536850
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaactgttaaattatgaataatcttcctttcttttctctcactgttatatgcatctgctgctgttgttagtgatactggtctgatgatgttattgtctgctgtatttatgtgatatgtggtgttagtttctttaagacattattggtatgacataaaaggatagatcaaaacgtgaatgtttataaattcaatttgccatggcttaacttctaaccccaggttattaggtgcatcccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccga

SEQ ID NO: 65509 - DNA, 703 bp, Zea mays
  misc_feature: Ceres CLONE 1536853
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaatgcctccgggaccacgaacaagaagggggacatgtgaggctggctatcgatgactgttgcaacctgagaggcagtaggcccttgggaaaactccaatatgacatcaaccttcccaggccttcattgtcctcgagcattctctgagatagctcgcagaccaagtgatcaatggtctgttgtgggcagatccgagcaagatataggctaacacgcttcgaaacagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacg

SEQ ID NO: 65510 - DNA, 611 bp, Zea mays
  misc_feature: Ceres CLONE 1536859
  misc_feature: Encodes the peptide sequence at SEQ ID NO. 65511
tggagctccccgcggtggcggccgctctagaactagtggatcccccgggctgcaggaattcgtctcacccctagaaaaaatcgcctccaccgttcgctcttcctctgctcttctctgcctgcatgagctcaccgcacctcgcctcctcaccgcgtttcctccgttaatccggtaaaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcataaggacgcctacgtcggtgactaggcgcaggccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgt

SEQ ID NO: 65511 - protein, 58 aa, Zea mays
  misc_feature: Ceres CLONE 1536859
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGHKDAYVGD

SEQ ID NO: 65512 - DNA, 661 bp, Zea mays
  misc_feature: Ceres CLONE 1536863
  misc_feature: Encodes the peptide sequence at SEQ ID NO. 65513
aagctggagctccccgcggtggcggccgctctagaatagtggatcccccgggctgcaggaattcgtctcacccctataaaaaagcagccacaagcccacaaccattattcttattccactgcatcaggtaacaagtccaactctccaagcggcaagcgccatgccttcttccgcgcaggttctgctctgcctcgccgccgtgctggcagcggcggcggccaccaccgccgaggcgcactcgcagtgcctgaacaacccacaggaccggtccatccacggccgcaagctggccgaggccggcgaggttctccacgaccaccccggtggcctcaaggcctacctcagcggcgccgcgagctcgagacgcgccgtcttcctcgactccgacgtcttcgagtacgatgcgcctttgctcagacagataggagacattgttgcaaaggcagggtacttcatactcgtgcccgatttcttgaacgtagactacttagacgacaagaaaaactcttcaaatcggctcgaggctcactctccagcgaaagctgctgaagagactatagcactgcttcgccatctttgaagaaggaaggaaagtcccgtcgcaggtggggaagctactggctggggtaaggcatgctaaagcgtgctaagtgggggaaag

SEQ ID NO: 65513 - protein, 139 aa, Zea mays
  misc_feature: Ceres CLONE 1536863
MPSSAQVLLCLAAVLAAAAATTAEAHSQCLNNPQDRSIHGRKLAEAGEVLHDHPGGLKAYLSGAASSRRAVFLDSDVFEYDAPLLRQIGDIVAKAGYFILVPDFLNVDYLDDKKNSSNRLEAHSPAKAAEETIALLRHL

SEQ ID NO: 65514 - DNA, 424 bp, Zea mays
  misc_feature: Ceres CLONE 1536865
ccgctctaaacttgatcccccgggctgcggattctctcacccctagaaaaaatgtgttaatcttttcgaccccaagcctctgggaggctgtgaaccatacctcatgaaatatgcctgttgttcattcatgttgtgtttttccgttgtcattattgtgcactcgctttaaatgctcggctatggaccgacagaaaagatgttacccaaaaaaaaaaaaaaaacaaaacgctcgaggtaccccaatccccctaaagggagtccgaattacccgccgccccctgggccgtcctttttcaaacccccttgaccagggggaaaaaaaacccccttgggggggtttttacccccccaacacctttttatttatgccccccttttgggagaaaaaaaaatacccccccccctttttttttccccccaccat

SEQ ID NO: 65515 - DNA, 748 bp, Zea mays
  misc_feature: Ceres CLONE 1536866
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
nnnnnnnnnnnnnnnnnnnnntttggtttnnttttntgctgttttttttcgtgttttttcaagctggagctccccgcggtggcggccgctctagaactagtggatcccccgggctgcaggaattcgtctcacccctagaaaaagtgaccccatgtctgtcaggactacccgctgagattgatgcatataattaaccggaggagaataaacgtacgaggattcccctaggagcggctagcgaaccgggagcaggccagcttgataatcgggcggtctcgccgcccgaattgtagtctggataggggtcctcctcgacggaccgggcccaagttctctggaaagggacgcctgggagggtgagagccccgtccggcccggaccctgtcgcaccacgatgcgccgtccacgggtcggggttgtttgggaatgcagcccatatcgggcggtaaactccgtccaaggctaaatacaggggagagaccgatagcgaacaagtaccgatagggatagatgacaaggactttgacaaaaagaaaaaataacgatacgctccaggtacccatttcgccccattagcggagtcatatttggtcgggcctcactgggctttttttttattaaaaacgtcccgggaaatggggaaaaaacccccttgtgggttaaccccaaaattttaatttccgcccttttgaaaataacattttccccccctcttttttttccccccccggtttggtgggggaataat

SEQ ID NO: 65516 - DNA, 684 bp, Zea mays
  misc_feature: Ceres CLONE 1536869
  misc_feature: Encodes the peptide sequence at SEQ ID NO. 65517
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (684)..(684): n is a, c, t, g, unknown, or other
aaagctggagctccccgcggtggcggccgctctagaactagtggatcccccgggctgcaggaattcgtctcacccctagaaaaaacagccatcacacgcatactgcatacacaacacagagcatcagaaggagctacgatctgatcgacatggctgccgccaccatggctatcacctcccgcgcgcccgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggttagttcccccccgacgagggggggggagagcncnnnnctgtctccggaacccgaaaaccttcgccaagaaccgcgagctgggaggtgacccctggccgctgggccatgctcgcgcccgctcgggtgcctgttcccggaacctgctcgtccgcaaacggcgatcaagttcttgcaaagggggcgttgatactaatgccgggtttccccagatacttctgggtaagggggcggcgatagatttacctctcgcgaaaccccagagcccaggacccaaccccgcacgaacccttcctctggcccatttctggaggaagatccaagaaan

SEQ ID NO: 65517 - protein, 65 aa, Zea mays
  misc_feature: Ceres CLONE 1536869
MAITSRAPVGKPAAGTRDVFGEGRITMRKTAAKPKPAASGSPWYGADRVLYLGPLSGSPPSYLTG

SEQ ID NO: 65518 - DNA, 697 bp, Zea mays
  misc_feature: Ceres CLONE 1536871
  misc_feature: Translation starting site: 163
  misc_feature: SWISSPROT Homolog: EC 3.2.1.23 Beta-galactosidase
  misc_feature (697)..(697): n is a, c, t, g, unknown, or other
aagctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagn

SEQ ID NO: 65519 - DNA, 678 bp, Zea mays
  misc_feature: Ceres CLONE 1536875
  misc_feature: Encodes the peptide sequence at SEQ ID NO. 65520
  misc_feature (678)..(678): n is a, c, t, g, unknown, or other
tccccgcggtggcggccgctcttttctattctatcccccgggctgcaggaattcctctcacccctagaaaaagcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtcaccccggccttcgtgggccaattcccgggcgtcaacgggcttggcatctctgcagccaggctcgacatcaaaggggggcggggtcgtgccgctgcacacccacccgggggggctcaaaactcctcttcctgaccccaaggcaacgtcgccctccgggcttcttcaatttccgggttctaaaaacagtctaaacccataaacgctttaacgcccagccaaaattcatggggagttccctgcaaagagcccaattttctcattaatcagtaaaaaacccccagcaaacagggggcctgactcttgtggggccacctttaggacctttaan

SEQ ID NO: 65520 - protein, 114 aa, Zea mays
  misc_feature: Ceres CLONE 1536875
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAARLDIKGGRGRAAAHPPGGAQNSSS

SEQ ID NO: 65521 - DNA, 632 bp, Zea mays
  misc_feature: Ceres CLONE 1536877
  misc_feature (632)..(632): n is a, c, t, g, unknown, or other
ctggagctccccgcggtggcggccgctctagaactagtggatcccccgggctgcaggaattcgtctcacccctataaaaagatcgcctcgctgtgttgcactgctatgtatccagctcgtttcctcccccaacccaaatgggcgactccaccgccaccaacccctcctcgacgaccgcagccatggatcccgactccgaggtcgtcttctacttcgcgccctacctctgccagtacaagagcggccgcatccaccgcccggcggcgcccccaccgtcccagctggcacggacccagccaccggcggcgtgtccaatgacatccgcgccggccccgactccgagcgagtctacctccctcccggcgcatccggcaagatcccggaggtcgtctacttccacggcggcgggttcgtggtcggctcaacggcgcggccgggcacgcacaactacctcaacgacctgttcgcccgctcaggcgccatcagcgtgtccggctactaccgcctcgcgccggatcacaagctgcccgcggcgtacgacgacacgtgtgcggcgctacggtgggcggcgactctcagcggccgcgaagacccgtggctgctggatcacgccgacctgtcgcgcgtgttcn

SEQ ID NO: 65522 - DNA, 809 bp, Zea mays
  misc_feature: Ceres CLONE 1536878
  misc_feature: Encodes the peptide sequence at SEQ ID NO. 65523
  misc_feature (9)..(9): n is a, c, t, g, unknown, or other
  misc_feature (13)..(13): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (241)..(241): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (462)..(462): n is a, c, t, g, unknown, or other
  misc_feature (809)..(809): n is a, c, t, g, unknown, or other
ttttatttnggtntttattttaaantnnnnnnnnnnnnnnnnnnnaaaaaannnnaaaactggcactccaccgcggtggcggccgctctagaatagtggatcccccgggctgcaggaattcgtctcacccctagaaaaatcccgtctggccacccatccgatcccacccggcaggggcgctgcgcaatggccacccacgcagctctcgccgcctcccggatcgccgggggggcccggttgnacatcagggcgcccgtttccttcaggcacggcgtgcaaaggctagcattctccgacttctccgggctccggcgggggtcttgttccctgaaccgcggtccttcggcaggagtgcttcttcaaagtccttggccccgagctcttctgccaaggccaccgggaaaaaaaggcctcgttttttttccccccccccccggggggggaagaaaggggggannnccncctttctccctcttcccccttggaaaaatccccacacagaaaaaaaaagagtgtgtacgggggatgtgggggtgccggggggccgcccatgatttacaccaatctgcggaaggcgggtcaggaggggctcggagaaccgtcggtcgtcggcgccgtcgtcgttagtcttttcgcttccgttcggggcgggcccccggctgccgcattgcgcgggtccccaacacgataggagaagcagagtctcaagatggtgagatggaagtaacaaggtaagatactcctgtctcccccactccactttgaatttttttggtttggcggcccgtactcccggcggagtcgcccan

SEQ ID NO: 65523 - protein, 46 aa, Zea mays
  misc_feature: Ceres CLONE 1536878
MIYTNLRKAGQEGLGEPSVVGAVVVSLFASVRGGPPAAALRGSPTR

SEQ ID NO: 65524 - DNA, 621 bp, Zea mays
  misc_feature: Ceres CLONE 1536881
  misc_feature: Encodes the peptide sequence at SEQ ID NO. 65525
  misc_feature (621)..(621): n is a, c, t, g, unknown, or other
ggagctccccgcggtggcggccgctctagaactagtggatcccccgggctgcaggaattcgtctcacccctagaaaaaattcggcgactatggcggcggcaccggcaggcggcggccctcgggcattgtcgcagcgggagcaggacatccagatgatgctcgccgccgatgtccacctcggcgccaagaactgcgacttccaggtggagcgctccgtgtacatgcgccacactgatggaatctacattattaaccttggaaagacctgcgacaagcttcaattggccgtcacgggtatcgttgcgattgacaatccgcaagacactatggtgcattctgctatgacctatggccacagggctgccctcaagtttgcgcagtacactggtgcccatgccattgctggcaagctgactcctggtacagtcgacaaccagttgctaacctccttcagtgagccacgccttcttatgctgactgacccgaggactgatcctcaggccgttaaggagtctgcgcttggaaacattccctccatcgccttctgtgatactgattcccctatgcggtacgtggatatcggacttcccaccaataacctggggctacagagcatgggtn

SEQ ID NO: 65525 - protein, 177 aa, Zea mays
  misc_feature: Ceres CLONE 1536881
  misc_feature (23)..(177): Pfam Name: Ribosomal_S2 Pfam Description: Ribosomal protein S2
MAAAPAGGGPRALSQREQDIQMMLAADVHLGAKNCDFQVERSVYMRHTDGIYIINLGKTCDKLQLAVTGIVAIDNPQDTMVHSAMTYGHRAALKFAQYTGAHAIAGKLTPGTVDNQLLTSFSEPRLLMLTDPRTDPQAVKESALGNIPSIAFCDTDSPMRYVDIGLPTNNLGLQSMG

SEQ ID NO: 65526 - DNA, 638 bp, Zea mays
  misc_feature: Ceres CLONE 1536886
  misc_feature: Encodes the peptide sequence at SEQ ID NO. 65527
  misc_feature (638)..(638): n is a, c, t, g, unknown, or other
agctccccgcggtggcggccgctctatactagtggatcccccgggctgcaggaattcgtctcacccctagaaaaagaatcgaccccaccgggccaccgttccttgccaactgccaagcatcaccgcgaaatctaataactcgttgctcttcgtcttcgctccgcgatcgatccaggagggggaagcagaaggagggatggcggagaacccgcagctgtttgggaatgggatgccggtgccgttctacagtgagatgttcgtcctcgcccgggatggcgtcgagttccacgtcgacgagatcccatcagctcctggtggtcatgtgaaaacaaaaggcacaatttacctgtctaatataaggatggtgtttgttgccaacaagcatgttggcaacttctttgcttttgatatgccactggtgcttgtgcacgggcagaagttcaatcagccaatatttcactgcaacaacgtctctggattccttgagccagttgttccagacaaccagaacagggccctggactcaactcacaccttcaagggcttgctcaaggacggcggctgtgggactttcgttcctccggtccctccaactggactggcatctgtgcgggccctacaacccagttttgaaaacn

SEQ ID NO: 65527 - protein, 147 aa, Zea mays
  misc_feature: Ceres CLONE 1536886
MAENPQLFGNGMPVPFYSEMFVLARDGVEFHVDEIPSAPGGHVKTKGTIYLSNIRMVFVANKHVGNFFAFDMPLVLVHGQKFNQPIFHCNNVSGFLEPVVPDNQNRALDSTHTFKGLLKDGGCGTFVPPVPPTGLASVRALQPSFEN

SEQ ID NO: 65528 - DNA, 714 bp, Zea mays
  misc_feature: Ceres CLONE 1536890
  misc_feature: Encodes the peptide sequence at SEQ ID NO. 65529
  misc_feature (14)..(14): n is a, c, t, g, unknown, or other
  misc_feature (54)..(54): n is a, c, t, g, unknown, or other
taaaaaagaaaggncgtttttcaaaatttacatttgaaaaaaccccccctcttntttaaaactggagctccacgcggtggcggccgctctataatagtggatcccccgggctgcaggaattcgtctcacccctagaaaaaaccgcagcatccgttcacgtgtcttcaccccgagtgctgtctctctccttcctctctgctacggctgggtgaggcggggggctactgccgccgcctaacgccaggttccgaggccttcgtcggtctatttgccggcgatgaacatccaccagggatggttgcaacaatttgggcatagcgttggtatcagtggttcgaagatggttctccatatgacccacaatgtattcagttttcgatgctttgctgacaatgagcgtggattcagtgcggattctaccaataagagaaaaattaaaagcaagaagaggcgaaaggatgttgcactggaatcaagtgaggtaatatctggaaatccaaggaacatggaccaatgggtgccagaattaagaactgaaagtgaaaacaaatctggtaaaaaagtcatggataagaaattttttggaaaaagtggaagcggtttcgaaagtctgctctttgagaaaaaagaaagctgaagagaaacaaagaattatccaagctattgaattatgaatgcttccaattggagtcaaaataaaaagtacctatctgg

SEQ ID NO: 65529 - protein, 119 aa, Zea mays
  misc_feature: Ceres CLONE 1536890
MNIHQGWLQQFGHSVGISGSKMVLHMTHNVFSFRCFADNERGFSADSTNKRKIKSKKRRKDVALESSEVISGNPRNMDQWVPELRTESENKSGKKVMDKKFFGKSGSGFESLLFEKKES

SEQ ID NO: 65530 - DNA, 640 bp, Zea mays
  misc_feature: Ceres CLONE 1536897
  misc_feature: Encodes the peptide sequence at SEQ ID NO. 65531
ggagctccccgcggtggcggccgctctaaatagtggatcccccgggctgcaggaattcgtctcacccctagaaaaaacctcgtgttcgttcggatcgcacacacgctctaccagatctccctcaattcagccgtcggtacctccgcttcaatatgcccgatctttgtgaacaccctgaccggcaagactatcacccatctacgtggagctcgtctgacaccattgacaacgtcaaggactacatcctccacaaggagggcatccccccataccagcaccagctcatcttcgctggccaacaggttgatgacgggcgcacgcttgctgactacgacatcccgaaggagagcaccctcctccttgtgctccgcctcatgtgagggatgcagatctttgtgaaaaccctgaccggcatgactatcaccctctaggtggagtcctctgacgccattgactacgtgctggaccagatcacatactaggagggcatccctccacaccatcagcgagctcatctttgctgggaagcagcttgaagacagacgcacgcttaccaactactccatccacaaagagagcaccctccacttggtgctgcgcctcatgagtagaatgctcatcttcgtgaagagcctgatcg

SEQ ID NO: 65531 - protein, 75 aa, Zea mays
  misc_feature: Ceres CLONE 1536897
  misc_feature (8)..(75): Pfam Name: ubiquitin Pfam Description: Ubiquitin family
MPDLCEHPDRQDYHPSTWSSSDTIDNVKDYILHKEGIPPYQHQLIFAGQQVDDGRTLADYDIPKESTLLLVLRLM

SEQ ID NO: 65532 - DNA, 632 bp, Zea mays
  misc_feature: Ceres CLONE 1536898
  misc_feature: Encodes the peptide sequence at SEQ ID NO. 65533
ccccgcggtggcggccgctctagaactagtggatcccccgggctgcaggaattcgtctcacacctttaaaaagctcctcctgcattccccctttccccttccgtccgctgcattcctgctctcttgctctcctcgctctcagaccacagttgccgccgccgccgccctaagccagggtgctgaggctttcgttgggctcttactgggcagcgagcacccaccagttatgtagaaatgggtgatggtgatgacatccatgctcttgatctgcgaacaatgggacccgaatggtcaaggctggatttgccggcgacgatacaccttgggctgtattccctagcatccttggtcgtcatctccactcctgcgtcgtgtgagggatggtccatacagatgcctatgtcggtgatgatgcacaatccaagaaaggtattctcacgctcaactacccgattgagcacggtattgtgagcaactgggatgacatggagaagatctggcatctcactttctacaatgatctccgtgttgccccggatgagcaccctgtgttgcttactgaggctcctttgaacccaactgcctacctggagaagatgacccagattatgttccagactttcactgttcct

SEQ ID NO: 65533 - protein, 84 aa, Zea mays
  misc_feature: Ceres CLONE 1536898
  misc_feature: SWISSPROT Homolog: EC 2.7.10.2 Non-specific protein-tyrosine kinase
MVHTDAYVGDDAQSKKGILTLNYPIEHGIVSNWDDMEKIWHLTFYNDLRVAPDEHPVLLTEAPLNPTAYLEKMTQIMFQTFTVP

SEQ ID NO: 65534 - DNA, 1551 bp, Zea mays
  misc_feature: Ceres CLONE 1536900
  misc_feature: Encodes the peptide sequence at SEQ ID NO. 65535
acaccgaaaccacagcaccatcgtcttccttgtctctgcaccgcttcccgctcggttcttgctgtgctagcctctgttcatccacacccgcgcgcgtcaatgggggagtacaacgacggagtgagcacatcgtggaccattcgggcggcgcaccgggggataccgccacccacgcggcccaaaataaagatcatccacatcatcgcgccggagatcatcaagaccgacgtcgcgcacttccgggacctcgtgcagcggctcaccggcaagcctgcttcctgtgccgccagcagcacgggcgacgacgacgtcgcgtcgatgctgccgccggtagaagacgaggacatggagacgacgaccaagaagaggccgaggccgaggccggcaccgcctccggcggccggtgagaggagcgacttcaccaaggcacaagaggagccggtcaagaagaggaagatcaagtgcgaggtgaaggtggaggagcaaggagctggcttcggcgattacgacctcggccacggcgacctgtggatggatctcaacccgggagggttcctgagcttcttggaggaggagggcgtgttccagggcctggctgctgctgctgaccacgacttcttgcagccctttggctcgtccaggatggatttggttggtgaaatgcacgcgtcttgagaatggagaagcaagtagaagcaagtgtgcttatatttcagacagtggagactggagaagcaagtgtaagcaacaccaatataagggaagaaatcggaatctgcatgccaacaattcaattatatgtttgtaaggaacactggtgaaatcatagaaggaactgaaaatcagtttggggaggtgcagtggtccaacttgtaaggaactgaaaatcagtttgtgtaaaatatctgccgagctttgtgagctggaagggatcagaacggtgtgaccctcgcggcgatcggatgatatcagcatggttaacctgttgctcgcgcaatgcagctacgccccctggtcgtcactccaccgtcgagcgtaattaattaaaagcaggccagccctggcaaggccggcggcctccatggtggttccaccaatcggatcaccagttcgcagcgcagcgcagatgccttctctgtcatgagcagcgatctagatacatgtcgttttcagtgggcatgcagccagcaaacacacactctagttaactgtttgttttcagaagccccacctatcgcaattcgcaaacggtacgaagaaacaaggtggtgcagagcaaggcgacgatggtttctctgatgggaatagccaagatttgccatggcgttccctctatgctgctcctctggatgggctgttgtgtgcttaacaaatacgcacagcggtggtgtgtgagttggctggcggaaaacgactcttgcataagataatgggcctctaggcactaggtttgcctgtttgatagggtatagtttatatatattccatgttctgctgtcctaaagaagatccagtggtgttcttttattgagtccgaaaaaaaaaaaaaaa

SEQ ID NO: 65535 - protein, 191 aa, Zea mays
  misc_feature: Ceres CLONE 1536900
  misc_feature (33)..(63): Pfam Name: VQ Pfam Description: VQ motif
MGEYNDGVSTSWTIRAAHRGIPPPTRPKIKIIHIIAPEIIKTDVAHFRDLVQRLTGKPASCAASSTGDDDVASMLPPVEDEDMETTTKKRPRPRPAPPPAAGERSDFTKAQEEPVKKRKIKCEVKVEEQGAGFGDYDLGHGDLWMDLNPGGFLSFLEEEGVFQGLAAAADHDFLQPFGSSRMDLVGEMHAS

SEQ ID NO: 65536 - DNA, 597 bp, Zea mays
  misc_feature: Ceres CLONE 1536901
  misc_feature (597)..(597): n is a, c, t, g, unknown, or other
gggctgcaggaattcgtctcacccctagaaaaaccttgccccgcttccgtcaatcacgcgccttgcacaaccgccccatactcagccctcccacccccatgaccccgtccgccaagatctggatcccgcccccgtcatcggcgcctcctcccccgcgcgtccgagacccggatccgctgcttccccgtcaagctccccagtctccccctccctgctcggtccgtatagcggcttgacggcgaatcggatcttcctcggcctcctctccctgcgcccctctggtcgccatggagctcgcctagaggttttctcaaactcctcgccgccggttttctcaaattgtcaatttgaagaaacccccagacccggatccgccgcttccttgaactcctcgccggcggctctcctcagctctgccgattcgctttcggtctcctcgccccaggcccccgcctcctcttgatcccatattcccctccgccggcccccggacgctcggcctcgatcggcccgccaagactatacccgttccattccctggaagaacgactatttgagagttagcttcccgaagaatctttcccggccggcattaan

SEQ ID NO: 65537 - DNA, 638 bp, Zea mays
  misc_feature: Ceres CLONE 1536905
  misc_feature: Encodes the peptide sequence at SEQ ID NO. 65538
ggagctccccgcggtggcggccgctctagaactagtggatcccccgggctgcaggaattcgtctcacccctagaaaaagtccgccccagtctagtccgattcagacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctgggcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcttgtggaggttgaccagatctatcaccttgcttgccctgcttcaccaatcttctacaagcacaatcctgttaagaccatcaagacaaatgttattggtaccctgaacatgctgggacttgcaaagagagttggagctaggattttgttgacatcaacatctga

SEQ ID NO: 65538 - protein, 150 aa, Zea mays
  misc_feature: Ceres CLONE 1536905
  misc_feature: SWISSPROT Homolog: EC 4.1.1.35 UDP-glucuronate decarboxylase
MAQKETNGSNGEHISTRPPPTPSPLRFSKFFQANLRILGTGGAGFIGSHLVDRLMENEKHEVIVADNFFTGSKDNLKKWIGHPRFELIRHDVTEPLLVEVDQIYHLACPASPIFYKHNPVKTIKTNVIGTLNMLGLAKRVGARILLTSTS

SEQ ID NO: 65539 - DNA, 647 bp, Zea mays
  misc_feature: Ceres CLONE 1536906
  misc_feature: Encodes the peptide sequence at SEQ ID NO. 65540
acactggagctccccgcggtggcggccgctctagaactagtggatcccccgggctgcaggaattcgtctcacccctagaaaaagtcgccgccaccactctcccagcctctcttactctccgccgtcgccctgctcgcccgaagcagctgccggcaaaatggccccgaagagaggcggtagggcgccggtccccgccaagaagaaggcggtggtgacgaacccgctcttcgagaagaggccgaagcagtttgggatcggcggcgcccttccgcccaagaaggacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaggctcttgaagagggcccagggctgaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccc

SEQ ID NO: 65540 - protein, 112 aa, Zea mays
  misc_feature: Ceres CLONE 1536906
MAPKRGGRAPVPAKKKAVVTNPLFEKRPKQFGIGGALPPKKDLHRFVKWPKVVRIQRQRRILKQRLKVPPALNQFTRTLDKNLATNLFKMLLKYRPEDKAAKKERLLKRAQG

SEQ ID NO: 65541 - DNA, 624 bp, Zea mays
  misc_feature: Ceres CLONE 1536910
  misc_feature: Encodes the peptide sequence at SEQ ID NO. 65542
  misc_feature (26)..(26): n is a, c, t, g, unknown, or other
  misc_feature (520)..(520): n is a, c, t, g, unknown, or other
  misc_feature (521)..(521): n is a, c, t, g, unknown, or other
  misc_feature (524)..(524): n is a, c, t, g, unknown, or other
  misc_feature (528)..(528): n is a, c, t, g, unknown, or other
ccgctctagaactagtggatcccccngggctgcaggaattcgtctcacccctagaaaaagaaattctaaagaaacataagggtaacatatctataaaggaactcagcgacatgacggcaataaaagccgatgacatcttgagcacgctgcagagcctggacctaatccagtatcgcaaagggcagcacgtcatctgcgcggacccgaaggtcctcgaccgccacctgaaggcggcgggtcagggaggcctggacgtggacgttagcaagctgatctggactccctacaaggagcaaggctaaaagcgcagctgctcccagccccagattagagtccctgtacataacgtttggtactatgatctcccctcagctctcacttcactcgtgtaccgtgaaaactgttcacttgtaacaacccacatttgctgggtttgggcctggcccccccccaatttttcttccccaaaaaccccaaaagaaaaaacattttcccccccacatttttttttttttttttnnggnaagnaaaaaaaaaaaaaaaagggggcgcgggggcccccccccccccccaaaaagggggtgttttcttcccccccccccccccccccccttttaaaaaaaa

SEQ ID NO: 65542 - protein, 99 aa, Zea mays
  misc_feature: Ceres CLONE 1536910
  misc_feature: SWISSPROT Homolog: EC 2.3.1.48 Histone acetyltransferase
ALELVDPPGLQEFVSPLEKEILKKHKGNISIKELSDMTAIKADDILSTLQSLDLIQYRKGQHVICADPKVLDRHLKAAGQGGLDVDVSKLIWTPYKEQG

SEQ ID NO: 65543 - DNA, 685 bp, Zea mays
  misc_feature: Ceres CLONE 1536914
  misc_feature: SWISSPROT Homolog: EC 3.2.1.23 Beta-galactosidase
tcccccgggctgcaggaattcgtctcacccctagaaaaaaaactactacggtctaccgtatgagctgatgcgctgcatgcccaccgccgcaccagtacctcctgttacttgttcttggagttaggatttttttaaaaaaaaatctttaggagatggatttggtggtatgtactgtagcatactagcatgagctgtggagcttcttctcttggtgagtgatctcgtgtcttgtgagggaaggagggagttcatgctgtgggtgtcctactcctctgtacagaacagaaatctggactcagtctggtctatgtaaatataggtgctgcgtatgtatatgtgtgtatagaataagatttctgtaaattatcaccactactacaggccaaaaaaaaaaaaaaaaacgagacgctcgaggtacccaattcgccctatagtgagtcgtattacgcgcgctcactggccgtcgttttacaacgtcgtgactgggaaaaccctggcgtttacccaacttaatcgccttgcagcacatccccctttcgccagctggcgtaatagcgaagaggcccgcaccgatcgccctttccaacagttgcgcagcctgaatggcgaatggaaattgtaagcgttaatattttgttaaaattcgcgtttaatttttgttaaatcagctcaattttttaaccaa

SEQ ID NO: 65544 - DNA, 744 bp, Zea mays
  misc_feature: Ceres CLONE 1536915
  misc_feature (163)..(163): n is a, c, t, g, unknown, or other
  misc_feature (435)..(435): n is a, c, t, g, unknown, or other
  misc_feature (436)..(436): n is a, c, t, g, unknown, or other
  misc_feature (649)..(649): n is a, c, t, g, unknown, or other
  misc_feature (654)..(654): n is a, c, t, g, unknown, or other
  misc_feature (703)..(703): n is a, c, t, g, unknown, or other
cggcgggacttgttgttctgaggcagcgtgttggtgttactaggggggggagtaatacttgagctcacgcgggggcggccgctctagaactagtggatcccccgggctgcaggaattcgtctcacccctagaaaaattgttcattctgtagctgtttattccntctgctgttgtatattggtgtaccattagtgacaaggttacttgggatctgctcggtccagctgtcctgctgaaagaaaggacggcctgtcagatacgagtcacggagaagagcttcgccctggccagctacatttttgcaagattttttggttgccaatagtaaagatccacacttgggcaattttgttgtaccatttcaaactgatacaaaactctcaaaaggaatatttttgtttttgtgcttcgttgccagaaaagcatttgtttttnnccccaaagagaggcaaaatagaaaaaaaaacgggaaataaaaaattttgggaagaacacccggagaacccctcccaaggggaacccccccaaatttttccccccccaaaaaaaaggaggggggccccgctaaattttattagcgggggcggctttttaattaatggggggcgccccccgattttattttttttatataaaaaccaaccaaccntatcntctcccttccctcggggggggcgagaaaaaaaaacccccctcccgcccnccagatggggcgttgagctatccccaaacaaccccacacaa

SEQ ID NO: 65545 - DNA, 955 bp, Zea mays
  misc_feature: Ceres CLONE 1536918
  misc_feature (28)..(28): n is a, c, t, g, unknown, or other
  misc_feature (916)..(916): n is a, c, t, g, unknown, or other
tttctcattctcccccccctgttgatcnctcccttcgggtagtaatctctttacttccctctgatgctgtcgctctaatatagtgcatcccccgggctgcaggaattcgtctcacccctagaaaattttacatgcagctaccttgtaattcggttggcttccagaaaaaaaaaagtgagcctgggacacgtcaagtgaccacctcagttttgttgtaaatttgttactagtttgataggattattagtatgtaccttatcacgaaaagaattctcagtatgtgttttggctgcccattcaatgatatgtcagctgattaacaccgtagcattgtgctctcctaacgatgcctgctgtaggtcttaaatatattgacagtactgatatcaatgcttttaaatgttaattttttgctcctccttccccctgtccctttagaaaaacattatataatacatcttagacgccccccaggtgcccctatttcacccctataactggaagtcgtaatttaatgttgtctctcctactagctctcgtctcttttttacaaaacgccccgtctactctcgtcataaaacccctaggatggttatcccccaataatcttattcgcccctttcgaactccaccccactccccacatttatagctctctgcgtaggtcggctaatgtcgatcttatgaaaacctccctcacacctctaattcttcgccctatcctcacaacaccatttcccactcccccccagataatggctcttaaattgagaacattcttgtaccaccccgctcaattaattatttaagtgactaattctccaccgattaccttctgtctctgagtaaaaacactccccttctcttctctttatccactccctctattaccaccctataaacgcgctgtccacgnccccccctcattaatacgactcctcaatttagtatagcc

SEQ ID NO: 65546 - DNA, 579 bp, Zea mays
  misc_feature: Ceres CLONE 1536925
  misc_feature: Encodes the peptide sequence at SEQ ID NO. 65547
tggcggccgctctagaactagtggatcccccgggctgcaggaattcgtctcacccctagaaaaatttttattttccatttatttagttagtttttcttaatgaaattgaaattattaactaacagagcaaacacaaataaagaaacaactttgctgaccatgatagatttttatctagttggaagagtcctcttaatattcatctaagtccttataataaagttggggttttggaatccaccgaaaggaggatggggaaggctccttctaaaaaaaaatggaaatgccttttccttaaaaaaaaaaaaagggagctcgggggcccattcccctaaggggggggaaaaccccgcccccggggcccggtttaaaaaaccggggggggggaaaaaacccgggggttccccacccaatatttaaccccctgggggggagaaaaaaccccccctttttccccccgggggggaaaaaaaaaaaaagaggcccccccaaatccctcccttccaacaaaaggcgccccccccgggggtggggggggagaaaaatttttttttccccccccccttttttttttttttt

SEQ ID NO: 65547 - protein, 35 aa, Zea mays
  misc_feature: Ceres CLONE 1536925
MKLKLLTNRANTNKETTLLTMIDFYLVGRVLLIFI

SEQ ID NO: 65548 - DNA, 779 bp, Zea mays
  misc_feature: Ceres CLONE 1536926
  misc_feature: Encodes the peptide sequence at SEQ ID NO. 65549
  misc_feature (779)..(779): n is a, c, t, g, unknown, or other
atataaatataaagtatactttattctctaaacgtggggtgttattttaaaactatgggctccccgctgtggcggtcgctctagactagtggatcccccgggctgcaggaattcgtctcacccctagaaaaaactggcgaatcgagagggaagcagatcgactactcagctagctcgaggttgaaggcatggctgcatccaaattctacgtcgccagctgcgccctcctcctaatcggcgtggtgctgctggggcagcagggtatagttggcgccgtcgcctgcccccagttctgcctcgacgtggactacgtgacctgcccgtcctccggctccgagaaactcccggcgagctgcaactgctgcatgacgcccaaaggctgcacgctccatctctccgatggaacgcaacaaacctgcagctagctctgaaccaaagttgtgcgtgattccatctggacaaagaccaacctgggggttttctcaaaaataaagctttcgcgcccgtacatggccatccgaatacaaacaaaaaaaacaactacccccctctatgtacccccaatccctcccaaagggagccgaaatacccagcaccctcgcagcgccgacgtataacaacgaccatgactgcggaaacgcccttacactaccccaaacccttcccccttgaccctacctcccccctttcccaccaccgtgcgtccaaaacgcgccatagggtcccgcagtacgactggcctttgcccagcacgtttgtgacacaaccctgctaaaggn

SEQ ID NO: 65549 - protein, 78 aa, Zea mays
  misc_feature: Ceres CLONE 1536926
  misc_feature (29)..(79): Pfam Name: Prot_inhib_II Pfam Description: Potato type II proteinase inhibitor family
MAASKFYVASCALLLIGVVLLGQQGIVGAVACPQFCLDVDYVTCPSSGSEKLPASCNCCMTPKGCTLHLSDGTQQTCS

SEQ ID NO: 65550 - DNA, 748 bp, Zea mays
  misc_feature: Ceres CLONE 1536929
  misc_feature: Encodes the peptide sequence at SEQ ID NO. 65551
  misc_feature (145)..(145): n is a, c, t, g, unknown, or other
  misc_feature (151)..(151): n is a, c, t, g, unknown, or other
  misc_feature (152)..(152): n is a, c, t, g, unknown, or other
  misc_feature (160)..(160): n is a, c, t, g, unknown, or other
  misc_feature (161)..(161): n is a, c, t, g, unknown, or other
  misc_feature (181)..(181): n is a, c, t, g, unknown, or other
  misc_feature (192)..(192): n is a, c, t, g, unknown, or other
  misc_feature (715)..(715): n is a, c, t, g, unknown, or other
aggagaacttagcaacaaaaaggaggtgtggttcggaggggggggaagattagaactccccgcggtggcggccgctctagaactagtgggatcccccgggctgcaggaattcgtctcacccctagaaaaaaaagaaagggggcantgatcnngttttgcnnctgcaggaatggtatcaccngctttacgttnggatagtgacaactacatcaaggcaatgcgtctatttgtgggcgagcctgtctggacaccatacaatcgtccgcatgaccatctcccggctaggaaggagtacgtcgaagaaaattcatcaaaccccgaaaggtggggaaaaaacccaaaaccccgctcccaaaaaaactctcccttttttaaaagaggggggggcccccccccaaaaggggccccccgggcgggttaagccccttctggggttttaaccccctacaaaaccccccaaaaaaccccccaaaaaaaaaaaatttttttttctcgggaaaggggtttttttcccccaccccccgggggggccccccttttattaaaaaagttttttcacaaaaaccccccccttaaaaaaaaaccctcccccaaaaaaaatatttttttgtcgcaacaaaaaaaaaacaaaaaacgcggggggtggttgttttaggacagaaaaataaaacgccacacctatgtagttggcgggggtcggccaaaaaaaaaaaanaaaaaaaaaaaaaaatgttccgcctccctctct

SEQ ID NO: 65551 - protein, 83 aa, Zea mays
  misc_feature: Ceres CLONE 1536929
  misc_feature (8)..(8): Xaa is any aa, unknown, or other
MVSPALRXDSDNYIKAMRLFVGEPVWTPYNRPHDHLPARKEYVEENSSNPERWGKNPKPRSQKNSPFFKRGGGPPPKGAPRAG

SEQ ID NO: 65552 - DNA, 676 bp, Zea mays
  misc_feature: Ceres CLONE 1536944
  misc_feature: Encodes the peptide sequence at SEQ ID NO. 65553
  misc_feature (1)..(1): n is a, c, t, g, unknown, or other
  misc_feature (306)..(306): n is a, c, t, g, unknown, or other
  misc_feature (312)..(312): n is a, c, t, g, unknown, or other
  misc_feature (321)..(321): n is a, c, t, g, unknown, or other
  misc_feature (673)..(673): n is a, c, t, g, unknown, or other
  misc_feature (674)..(674): n is a, c, t, g, unknown, or other
naaagctggagctccccgcggtggcggccgctcctagaactagtggatcccccgggctgcaggaattcgtctcacccctagaaaaactcctcctctatcttcgcatctggcacgagcagccaagcaaataaaagtagagcggcgagcgacgaccggcctgggccactctttcggccgagcgtagccagcaggtcgtccgtcgtcgtcgtcgtcgcagcacccggccggctagcatggccacgaggaggcagtggtggtggtggtgcctgctgctgctggcggcctgttgcttgccccccggccccncagtcnccgccgggnggcggacccgcttgcaaaaccaagtgccaggggggactttcggggatacttaacccacccccatgggagggcgggcggggggggcccccgggcgttccccccttcttcccacctgggtgggggggaaccgccggggaaaacggaaaaaaggggccccccccgaagggccctcttgcttaaaattatcccaggaaaaagcccccgggggggggcaaacccgggggagatcccccctcgaaaagggcgttttcaaccgaaatttatggggggctcccccccccccccctggaaaaccccccacatttcaaagagggtttggttttggaaatcccccgggggaaaactataaaanngg

SEQ ID NO: 65553 - protein, 46 aa, Zea mays
  misc_feature: Ceres CLONE 1536944
  misc_feature (25)..(25): Xaa is any aa, unknown, or other
  misc_feature (27)..(27): Xaa is any aa, unknown, or other
  misc_feature (30)..(30): Xaa is any aa, unknown, or other
MATRRQWWWWCLLLLAACCLPPGPXVXAGXRTRLQNQVPGGTFGDT

SEQ ID NO: 65554 - DNA, 577 bp, Zea mays
  misc_feature: Ceres CLONE 1536946
  misc_feature: Encodes the peptide sequence at SEQ ID NO. 65555
gctcttgaactagtggatcccccgggctgcaggaattcgtctcacccctagaaaaaaatctttttcttcctcgcgccgccgccgccgtgacggaaggaagaggaggagcaaggagcacgacgcgatgggtcactccaacgtttggaactcgcaccctaagaactacgggccctggctcccgcgtctgccgggggtctgcgcgaaacccctcacggggtcttgattccagggaaagtacccggggctccatgtgcttgcaggcattgctttcccaacaaccccaagggaatttggtttcctccaagaacccctttgaaagaaggccccccccggggggggccgggttggggaaaaattcccacctcaaaaaaaaggggcccttctttaaaaaggccaaattttaggcccctttaacctttttttttccaaaaaaatggaaaaccccccgggggttaaaaaacccccccctttttaaaaaattttttagggggccccctttttggtggtgtggggccccccctcttttttgcaaaagaaagggaggattttttcccccccccccaaaaaaaaaaaaaaa

SEQ ID NO: 65555 - protein, 32 aa, Zea mays
  misc_feature: Ceres CLONE 1536946
MGHSNVWNSHPKNYGPWLPRLPGVCAKPLTGS

SEQ ID NO: 65556 - DNA, 831 bp, Zea mays
  misc_feature: Ceres CLONE 1536951
  misc_feature: Encodes the peptide sequence at SEQ ID NO. 65557
  misc_feature (27)..(27): n is a, c, t, g, unknown, or other
  misc_feature (412)..(412): n is a, c, t, g, unknown, or other
  misc_feature (831)..(831): n is a, c, t, g, unknown, or other
tatgtataaagcacacagccccccttntcgatcattatcaaatataaaaaattggccatacccgcggaggaggccgctcttgaactagtggatcccccgggctgcaggaattcgtctcacccctagaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaatccgtcagccgcgaagagcggcggtgttaataatgttgagcagaagccccgggaaacccaaaggaaggtgaagagcagcaaacaggcggcggcggccaaaaagtgacgtacaatacntgtggagtgtaatggagcttccaatgcatgagtgaatccatgctcatgttatgaatccaggccttcgctttcttgtatcttcatagtgacgcgaccttgggcgtccccctctgtgtgaggatgcctgacgaatactacaaaaaagaagttggtcgtggaaaagaaaaaccaaatatccggagaacccttcgaagggaaccccaaacatttcaccctacatgctgaagggcaaattaagaccccgcttcacaggtcctgtcgtattttcaaacgtcgtgtggacgggctaaaaatcccaggtggcgatgccccaacttaaatccctccgttggcgggcgacacatccccccattttcgcacattctttggtcagtttctcaatttataagagaataggtgctccgactccgaggagccgn

SEQ ID NO: 65557 - protein, 63 aa, Zea mays
  misc_feature: Ceres CLONE 1536951
MASLKAAKPSGVAAQGKEPAPKLSETATNPSAAKSGGVNNVEQKPRETQRKVKSSKQAAAAKK

SEQ ID NO: 65558 - DNA, 678 bp, Zea mays
  misc_feature: Ceres CLONE 1536952
  misc_feature: Translation starting site: 99
  misc_feature: SWISSPROT Homolog: EC 3.2.1.23 Beta-galactosidase
  misc_feature (678)..(678): n is a, c, t, g, unknown, or other
gctcttaactagtggatcccccgggctgcaggaattcgtctcacccctagaaaaattgtctttcggatcggagagggtgtacgtgcgtggattgattgatgctgctagatgcatgtgtgtcttctgtctcacgttgcattgcatacgcaactcgagatgatgtgttggcgctgtacactaagatgaaccatgtctgtgcaggtacccaattcaacacgagacgctcgcaggatacccaattcgccctagagtgagtcgtattacgcgcgctcccgggacgacgttttacatcctcatgtctggcaaaacgctggcgttccccctttcactcgccttgcagcacatccccctgtccccacctggcgtactacccaacaggcccgcaccgatcgcccttcccgacaattgcgcaccctgaatggcggatggaaattgcaagcgttaatattttagtaaacttcgcgttaaatttttgtgaactcagctcgttttttctacccattaagccgaaatcggcccaatcccttattagacagaagaatagaccgagatagggttgagcgttgttccagtttggaaccccgaccccctatgtaaagaacgcggactcccacgtcaaggggccaaaaaaccgtactatcagggctgatggcccacttcgtggaaccaagcccgccn

SEQ ID NO: 65559 - DNA, 730 bp, Zea mays
  misc_feature: Ceres CLONE 1536961
  misc_feature (359)..(359): n is a, c, t, g, unknown, or other
  misc_feature (361)..(361): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
tccccgcggtggcggccgctctagaactagtggatcccccgggctgcaggaattcgtctcacccctagaaaatacaaaaaaaatgcggggtcagcctgtttctcagcaaagcagctgctgctcttgatcgtctgtctaaatcacagtagtgtgattgtgcagcaagcaaaacttaaattggttgctccctgtacattaagcctattactgtcccaaaaaactcgatgttatctatccgatactggaagtctgtctatcgactgcaacgcttaagcatatatggcctgttttatctacacaattcgtattttaaaaaaaaaaaaaaaaaaaaaaaaaaaaaaaaaaaaaaaaaaaaaaanannaaannnnnaaattgaaaaatatttttttgttcgggacgcccaaggtacccaattccccctatagtgatccaaataacccgccctcactggccgtctttttacaacgtcaaaactgggaaaaccctggctttacccaccttaatccccttgaaccaaatccccctttgcccaattgggataaaaccaaaaaagcccccaccaaatccccttcccaaaaattggccagcctaaagggcaaaggaaattggaaactttaaaattttggaaaaattcccggtagaatttttgttaaaccccccctttttttaaccaaaaaggccaaaatccggaaaaaccccttaaaattcaaaaaaataacccgagaatgg

SEQ ID NO: 65560 - DNA, 644 bp, Zea mays
  misc_feature: Ceres CLONE 1536970
  misc_feature: Encodes the peptide sequence at SEQ ID NO. 65561
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (499)..(499): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (570)..(570): n is a, c, t, g, unknown, or other
  misc_feature (571)..(571): n is a, c, t, g, unknown, or other
  misc_feature (604)..(604): n is a, c, t, g, unknown, or other
  misc_feature (629)..(629): n is a, c, t, g, unknown, or other
  misc_feature (639)..(639): n is a, c, t, g, unknown, or other
aaagctggagctccccgcggtggcggccgctctagaactagtggatcccccgggctgcaggaattcgtctcacccctagaaaaaaacggcgcgcctcctataggctatagcactgccgcatgagaagatagcgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggcaccctggtcggggtccggtgcccccccccccacgggcgggacggtgttcccgaatnannnnntcttgaccgaccgcaacgnnnagttccccgtgcacctcgcgacgggccagcagcttcaacaacaacaacagccaccagtccggtccgtcccctcctggtnggtggcggtgcacctcccgcagggttcccccccgggggnnnccccccccggatcccctccgggggttcccnnttggaggcccacgaaaataattccgaacaccgngggtggaaatccacttccctttccnccggcagccnttccc

SEQ ID NO: 65561 - protein, 167 aa, Zea mays
  misc_feature: Ceres CLONE 1536970
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (93)..(93): Xaa is any aa, unknown, or other
  misc_feature (133)..(133): Xaa is any aa, unknown, or other
  misc_feature (143)..(143): Xaa is any aa, unknown, or other
  misc_feature (163)..(163): Xaa is any aa, unknown, or other
  misc_feature (166)..(166): Xaa is any aa, unknown, or other
MNRASWLLLVLVQLSCLHCYSATHHGGGRKHGRPLLPAPANVVVGSVVVVHSGSSEATTTAVSSGTLVGVRCPPPHGRDGVPEXXXLDRPQRXVPRAPRDGPAASTTTTATSPVRPLLVGGGAPPAGFPPGGXPPRIPSGGSXLEAHENNSEHRGWKSTSLSXGSXS

SEQ ID NO: 65562 - DNA, 612 bp, Zea mays
  misc_feature: Ceres CLONE 1536974
  misc_feature: Translation starting site: 188
  misc_feature: SWISSPROT Homolog: EC 2.3.1.170 6'-deoxychalcone synthase
  misc_feature: SWISSPROT Homolog: EC 1.1.1.2 Alcohol dehydrogenase (NADP(+))
  misc_feature (377)..(377): n is a, c, t, g, unknown, or other
  misc_feature (379)..(379): n is a, c, t, g, unknown, or other
  misc_feature (382)..(382): n is a, c, t, g, unknown, or other
  misc_feature (385)..(385): n is a, c, t, g, unknown, or other
  misc_feature (395)..(395): n is a, c, t, g, unknown, or other
ctccccgcggtggcggccgctctagaactagtggatcccccgggctgcaggaattcgtctcacccctagaaaaaataccggcacgggctcaaggctctggctcgcgcacccctggtacctgttccgcaccgcaccgcacacctagacgcacctccagctgcagcgcgccatacttgaccgcatcaacatggcatccacggggacgacagcggcggtgccggacgtgaccctgcggtcgggcaacgggaagccgatgccgatggtgggcatgggcaccgcggcgttccccgtgatgcacgacgccgtctgggacgccgtgctggcggccatccaagtggggttcctccacttccacacggccagggggggggggaccnanaanccnctcggcaacnacttggacgaggcgctgcagaacggcctcctgcgggcccaggagaactcttcgtcacgtccaagctgggggggtcgcagacccccgcggacctccggcctgcgtccctgcggaaaactctcaaaaacctgcaaagggagtacctggcaccttgtcctgaatccctgggccggggtgcctcaggccggccccccggcccccacaatttcccaaacagg

SEQ ID NO: 65563 - DNA, 654 bp, Zea mays
  misc_feature: Ceres CLONE 1536979
  misc_feature: Encodes the peptide sequence at SEQ ID NO. 65564
  misc_feature (654)..(654): n is a, c, t, g, unknown, or other
tggagctccccgcggtggcggccgctctagaactagtggatcccccgggctgcaggaattcgtctcacccctagaaaaagtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggacttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcatcccagaactgctccgccacgcttaccggcaaccaccggatgcgcgccgccgccgttgcgctgccggagacgaaagactggatggaggatgggattgtgagcccagtgaaaaaccagggccactgtggn

SEQ ID NO: 65564 - protein, 165 aa, Zea mays
  misc_feature: Ceres CLONE 1536979
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTDFAALGRTRDALRFARFAVRYGKSYESAAEVHKRFRIFSESLQLVRSTNRKGLSYRLGINRFADMSWEEFRATRLGASQNCSATLTGNHRMRAAAVALPETKDWMEDGIVSPVKNQGHCG

SEQ ID NO: 65565 - DNA, 769 bp, Zea mays
  misc_feature: Ceres CLONE 1536981
  misc_feature: Encodes the peptide sequence at SEQ ID NO. 65566
  misc_feature (5)..(5): n is a, c, t, g, unknown, or other
  misc_feature (6)..(6): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttnntttttttnnnnnnntttttttctttttttctaccatnnntatatgctggagctccaccgcggtggcggccgctctagaactagtggatcccccgggctgcaggaattcgtctcacccctagaaaaaggaccacaggaacaccgaagtaccgaacactaccggccacacgctcgagaataggcggcggtgcaggtcctcctccatctctgtcgtgactattctagtttctgcgcatgccctcacggatctttagactccagggttcaacttcactgtgaatacgctgacgctacgagaagtcatcacggaaggggtctcgaagcaaggtgcaaagactcacctgccgtctctgatgggctttgctggctgggtatccatgctgctcttcctcctggtcgccggtgctgtagctaatgaccagatcttcaccacttcaggtgtgccattttgggcggagttcgcgtgagccaagttaccgcttcgaattccatcctgttgattcaccattccatccagaaaatggtcaagaaatccggtaccaatggctagccatgatgggtaacgtgtatagatgccttttctacctattttgaaagaaactaaaaccatgcaaatcctaagccttccgcaaaaatgcaaactaatggttattaaaaacaatagtggaaaaggcagaatttaagcccaaagggaaccccaaattgaattaaccttggagggcatccccaagggcacccagggggcttcctaactgagccataga

SEQ ID NO: 65566 - protein, 37 aa, Zea mays
  misc_feature: Ceres CLONE 1536981
MGFAGWVSMLLFLLVAGAVANDQIFTTSGVPFWAEFA

SEQ ID NO: 65567 - DNA, 645 bp, Zea mays
  misc_feature: Ceres CLONE 1536988
tggagctccccgcggtggcggccgctctagaactagtggatcccccgggctgcaggaattcgtctcacccctagaaaaaacctggggctggtgaggctgggcatatccgggcaggccaaagcgatagctttcgcgctagatgcgtcccgcgttccttgcttcgtcctacggtgttcgtggcccttacgcttcccccatttccgcccgtcctgttcccgccccgaccgaaccggcggcagctgaagccatgcatcactatccgcggtcgcctgccgctgagcccgccgccagggctggggcgggccctggtcccaccaccgtctacgaggcatccatggagcggagcatgagcttcgtcaaggcgcttcaggagctcacgaacctgcgcccgcaactctactagggctccgagtactgcgagaagtcctacctccgcatcgaacagaagcttgtggtgctggacaacttgaaagattactctgtctgggccctggacaactctggcgaccatcttgacacactggactaagagctaacagacttattctatgagcaagcttcacaaataacaactctcgacttgaaagtaccatgctggatacacaaggtccgtacctgccgcacatacacggactactgacgcct

SEQ ID NO: 65568 - DNA, 658 bp, Zea mays
  misc_feature: Ceres CLONE 1536993
  misc_feature (362)..(362): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (467)..(467): n is a, c, t, g, unknown, or other
  misc_feature (469)..(469): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (516)..(516): n is a, c, t, g, unknown, or other
  misc_feature (549)..(549): n is a, c, t, g, unknown, or other
  misc_feature (593)..(593): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (633)..(633): n is a, c, t, g, unknown, or other
ctccccgcggtggcggccgctctagaactagtggatcccccgggctgcaggaattcccctaaccccgggaaaaacttctccttcggaagacgggcaggcgagcaccgaatgtgcgacggaaatcagtggggatgaggcgcaatagcccgccgacggcgagcggcaaccgcctcgcggtcatcgcttcccacttatccctccctccgctcgggagtccggcagccatatccggggagaaggaagccgccctcgccaccgacctcaacagcaccccccccatttttgaacaaattattccgaaggagatcccctctcaggtggtttttgaggatgagaaaggttttgtttgccccccccaaagnggggggggggcggtctccccctttttccnnnnnnnngcgatcgctcaacacccggcctgccccccctcttccccccccccgctcccctnnngtctttgtctctgntncctgggnnnatctttcctttatgcttcgttccccttttctccgcccncgatcaccccttgccctactttcctgcccaagngcccctcgacaagtgattcgccgtgggtctttaaaccctccccnncnncgcgccccccccccctgacagtcgctcccagagggncccccctccccatcctcgtgcacca

SEQ ID NO: 65569 - DNA, 809 bp, Zea mays
  misc_feature: Ceres CLONE 1537001
  misc_feature: Encodes the peptide sequence at SEQ ID NO. 65570
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (26)..(26): n is a, c, t, g, unknown, or other
  misc_feature (809)..(809): n is a, c, t, g, unknown, or other
ttttgtgnnnctnnntnttttctatnggtggcctccaccccgttgtttggtcataagctggactccccgcggtggcggccgctctattcctagtggatcccccgggctgcaggaattcgtctcacccctagaaaaaagtaccgccctccacacaacgaaaacacaaacgcacacaagcacacgacgcaagggtgacgactgacgagagggggagaaagagaggcgaggaaggagggagagagcacgggggcttgatcgaagatggatgccggagcaaaggtggtgaagaaggccgcggcggggcgtcacggagggggcggccccaagaagaagccggtctctctctccgtgaaggccggcctacagttccacgtaggccgtatcggccgctacctcaagcacggacactactcccagcgtgacagcgccggcgcccccgtctacctcgcctgccgtactcagagtacctagtcagccgagctcctcgtagttggtcgggcaacgccaccccgatgactacaagtaagaaaccgggcacattccagccgcacaacacaactgcccgagcgtaccccgcaaccgatgtattaaccatcgtccaagccctacctgtgtccggcctctctccctttcgtttcaccagcgagatattgctgggctcaatatttctaacccttgctgtgcgcgccacctcggagatgaacccggcgtggaggtggggcctgccccacaggaatggcccaccaaaaaaacacacagccccccaccaaccaagagacccccccccccccccctagctccccctccan

SEQ ID NO: 65570 - protein, 69 aa, Zea mays
  misc_feature: Ceres CLONE 1537001
MDAGAKVVKKAAAGRHGGGGPKKKPVSLSVKAGLQFHVGRIGRYLKHGHYSQRDSAGAPVYLACRTQST

SEQ ID NO: 65571 - DNA, 659 bp, Zea mays
  misc_feature: Ceres CLONE 1537008
  misc_feature: Encodes the peptide sequence at SEQ ID NO. 65572
  misc_feature (396)..(396): n is a, c, t, g, unknown, or other
  misc_feature (399)..(399): n is a, c, t, g, unknown, or other
tagctggagctccccgcggtggcggccgctctagaactagtggatcccccgggctgcaggaattcgtctcacccctagaaaaaactcgagctcgagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcatgcccgaagaggctgcccccgccgccgaggccaaagtggtggagccccctcccccggcggagagggaggcagcttccnccncttatccccaagcggcccccgtggcgagggaggaagagaaccccaaggaggaaaagacggcaaaggatgccgaacccggacccgggaccgggggcgggttgaaaaagttaaggaggaatcgggaccgccccgctgccaaaaaaaaaaccgaacccggtagccgcttaaccccgagggtgctggctgtgctgaagaaccccccgggggctaaaccccccccctatagaaccccaaaaaggcctaaccccgccgctgaaagg

SEQ ID NO: 65572 - protein, 142 aa, Zea mays
  misc_feature: Ceres CLONE 1537008
  misc_feature (55)..(55): Xaa is any aa, unknown, or other
  misc_feature (56)..(56): Xaa is any aa, unknown, or other
MATAEVQTPTVVATEEAPVVETPAPPAVMPEEAAPAAEAKVVEPPPPAEREAASXXYPQAAPVAREEENPKEEKTAKDAEPGPGTGGGLKKLRRNRDRPAAKKKTEPGSRLTPRVLAVLKNPPGAKPPPYRTPKRPNPAAER

SEQ ID NO: 65573 - DNA, 696 bp, Zea mays
  misc_feature: Ceres CLONE 1537009
  misc_feature: Encodes the peptide sequence at SEQ ID NO. 65574
  misc_feature (351)..(351): n is a, c, t, g, unknown, or other
  misc_feature (352)..(352): n is a, c, t, g, unknown, or other
ggatcccccgggctgcaggaattcgtctcacccctagaaaaacggttcgcatagcagagctgctcttgcaacaagccaaacaacccagtggctgctagccgagacaggggatagattgagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaagttctcaaagagtgacatcatcgtgtccccttcgattctgtctgcttttttttcccccccctgttggggggggggggggggtgtnnacgtggccacgatcccactggaattcatggttaatgtaatgtaatggggccctttgtggcgggccgtcccgattttgcaaccctctgccttgctcgatgccctctacctcccgaagccctgaaactttccactcggcctgtcccttcctcacttttttgtgcgaactccgactccacctgattccctgtattttttatctccgcccccggtgccgattcttttgttctctcgccccaccgctcgcaccacgaaattgcatatctctcttctttttcctacggcatttctgttcttttcttcattgtaataccttcctttctaacttcaccccctctccaatttg

SEQ ID NO: 65574 - protein, 87 aa, Zea mays
  misc_feature: Ceres CLONE 1537009
  misc_feature: SWISSPROT Homolog: EC 5.1.3.1 Ribulose-phosphate 3-epimerase
  misc_feature (74)..(74): Xaa is any aa, unknown, or other
MATPSSSLCSSFASLRTASIGHPRGIASSTPRKAFHVRASARVDKFSKSDIIVSPSILSAFFSPPCWGGGGGVXVATIPLEFMVNVM

SEQ ID NO: 65575 - DNA, 710 bp, Zea mays
  misc_feature: Ceres CLONE 1537010
  misc_feature: Encodes the peptide sequence at SEQ ID NO. 65576
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (52)..(52): n is a, c, t, g, unknown, or other
  misc_feature (55)..(55): n is a, c, t, g, unknown, or other
  misc_feature (306)..(306): n is a, c, t, g, unknown, or other
ggtttnnnnnnnttttnnnncctattccacttcgctcgcacgtcaccttttnttntttaaaattggagctccccgcggtggcggccgctctagaactagtggatcccccgggctgcaggaattcgtctcacccctagaaaaagactccactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcnacgagtaccgttgcttcattgggaacctgtcctggtcaacgactgatgaaagcctcaaggatgcgttcagcaaattcggcaacctcactgaggcaaaggtggttcttgacaaattttcaagacgttctcgtggtttcagctttgtaacttttgatgacaagcaagccatggaggatgctattgagggaatgaatggactggacttggacgggaaggaacttcactgttgataaaactcaaccacatagaccctggtaaacaaccgtaatggtggaccgtgattaagaacgccgaaccggggcatctccgttaggaaccgtggcccggggactatgtttaattgaggccgtaataacatgaaaagttaggttgtctactaagcagcatgtaaacaatttgaaatg

SEQ ID NO: 65576 - protein, 80 aa, Zea mays
  misc_feature: Ceres CLONE 1537010
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (5)..(5): Xaa is any aa, unknown, or other
MADVXEYRCFIGNLSWSTTDESLKDAFSKFGNLTEAKVVLDKFSRRSRGFSFVTFDDKQAMEDAIEGMNGLDLDGKELHC

SEQ ID NO: 65577 - DNA, 688 bp, Zea mays
  misc_feature: Ceres CLONE 1537011
  misc_feature: Encodes the peptide sequence at SEQ ID NO. 65578
  misc_feature (420)..(420): n is a, c, t, g, unknown, or other
  misc_feature (421)..(421): n is a, c, t, g, unknown, or other
  misc_feature (473)..(473): n is a, c, t, g, unknown, or other
acagctggagctccccgcggtggcggccgctctagaactagtggatcccccgggctgcaggaattcgtctcacccctagaaaaaatcataattctcttgagaggaggagaagagaggagaggacagcaccggacccgcgacagagagggagaggcagaggcagccagaggcggaggatccggaatcaacctcgccggcggccgccgcggtgatgccggtgggggagttggctgcgcggccaggcggcgccatggcggcggcggccgtgggaggggacgacgctgtcgtcatgcagctggccgccgccgagggcgaggagaccgtcatcaccgtcaactgccccgaccaggccggcctcggctgccacccgtgccggagggggggggggggtcggcctccgcatcacccgcggcgacgggnntacggacggacactggggctccgtggtggtccggggtggggccccccctccncgtccatcaaaatcggggtgggggagccttcaaaaaccgggctcatggtcgatggggcccttcctccctactccattcccagtttgacccgggaaattgaagcccgcccgggccccccccccagatgctacgctccctcaaggcctctgggtcccgggagcccgaaaagagttttggtgggaccgatgtttgccggccctttccgtttccaaacc

SEQ ID NO: 65578 - protein, 159 aa, Zea mays
  misc_feature: Ceres CLONE 1537011
  misc_feature (70)..(70): Xaa is any aa, unknown, or other
  misc_feature (88)..(88): Xaa is any aa, unknown, or other
MPVGELAARPGGAMAAAAVGGDDAVVMQLAAAEGEETVITVNCPDQAGLGCHPCRRGGGGRPPHHPRRRXYGRTLGLRGGPGWGPPSXSIKIGVGEPSKTGLMVDGALPPYSIPSLTREIEARPGPPPRCYAPSRPLGPGSPKRVLVGPMFAGPFRFQT

SEQ ID NO: 65579 - DNA, 665 bp, Zea mays
  misc_feature: Ceres CLONE 1537012
  misc_feature: Encodes the peptide sequence at SEQ ID NO. 65580
tggagctccccgcggtggcggccgctctagaactagtggatcccccgggctgcaggaattcgtctcacccctagaaaaactagaaaaaatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctc

SEQ ID NO: 65580 - protein, 174 aa, Zea mays
  misc_feature: Ceres CLONE 1537012
  misc_feature (27)..(173): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIP

SEQ ID NO: 65581 - DNA, 672 bp, Zea mays
  misc_feature: Ceres CLONE 1537016
  misc_feature: Translation starting site: 248
acagctggagctccccgcggtggcggccgctctagaactagtggatcccccgggctgcaggaattcgtctcacccctagaaaaacttcgagcgatatagggcgcccccgtccacaccacccctcgtctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacgatacgaggaaatggttgagtacatggagaaggtggctaagactgtagatgtggaagagctctccgccccaccagcggagggggcggaggtgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaccttttgtgagggtaccctgaagttgatcgactctcaccttgtgccttccccccctggtggaaaagccaaggggtttttacctcacaaatgaagggggaattatccccgggcccttggctgagtttaaaaactggtg

SEQ ID NO: 65582 - DNA, 662 bp, Zea mays
  misc_feature: Ceres CLONE 1537017
  misc_feature: Encodes the peptide sequence at SEQ ID NO. 65583
  misc_feature (420)..(420): n is a, c, t, g, unknown, or other
tccccgcggtggcggccgctctagaactagtggatcccccgggctgcaggaattcgtctcacccctagaaaaaaagccgtgacggatccagccgaaccccctcgcagtcgcagccccctcacgccacgcgacatgggcaagatcaggatgcccgtgccgtccctgttccgccgccgctcctccaagccgccgccgccgcagccgcagcagcaggcgcctgccgcgggcgacggcgacggcagcgggtccccggagcgggcgacggcggaggaggagatggcgcgcgtgttccgcaagttcgacgcgaacggcgacgggcggatctcgcggtcggagctggcggcgctgttcgagagcctgggccacggcgcgtcggacgaccaggtggcgcgcatgatggccgaggcggacgcggacggngacggcttcatcaacctgcccgagttcgcggccctcaacgccccggtgggccggcgacgcggccgccggtcgaggaagaactgcgccacgccttccgcgtctttcaacgccgaagggagggggcggccatctccgccgcccgagctccggcgccgtccttccgcaacccccgggaagccccccccccctccgccgcatgccgccccgccttgaatcaaagggcggtccaaccaaaaccgccg

SEQ ID NO: 65583 - protein, 166 aa, Zea mays
  misc_feature: Ceres CLONE 1537017
  misc_feature (48)..(76): Pfam Name: efhand Pfam Description: EF hand
  misc_feature (84)..(112): Pfam Name: efhand Pfam Description: EF hand
  misc_feature: SWISSPROT Homolog: EC 2.7.11.1 Non-specific serine/threonine protein kinase
MGKIRMPVPSLFRRRSSKPPPPQPQQQAPAAGDGDGSGSPERATAEEEMARVFRKFDANGDGRISRSELAALFESLGHGASDDQVARMMAEADADGDGFINLPEFAALNAPVGRRRGRRSRKNCATPSASFNAEGRGRPSPPPELRRRPSATPGKPPPPPPHAAPP

SEQ ID NO: 65584 - DNA, 759 bp, Zea mays
  misc_feature: Ceres CLONE 1537018
  misc_feature: Translation starting site: 225
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
ttttttttgttttgtttgttggttattnncccnnnnnnncacaccaactaccaaaacccggaactccccgcggtggcggacgctctaaactagtggatcccccgggctgcaggaattcgtctcacccctagaaaaacgcctccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaattgccagactctcaagtacaacatgaagtcaagggctgggagaggctttacccttgaggagttgaaggctgcgggcattccaaaaaggcttgctccaaccattggcatttctgtggattaccgccgcaagaacaaatcccttgaggggctgccggccaatgtccaaaagcttcaacacatacaaggtcaaagctgagttaatcttcccaaaggcggtgcctcaccaagggtcaaaggcctcggagaactccaactcctggggagggatgctttaaccacttggcttaaccccatggtgatcagggggttgaacctatcggttggacactatttgaccttactccgggaagagaagaaa

SEQ ID NO: 65585 - DNA, 630 bp, Zea mays
  misc_feature: Ceres CLONE 1537023
  misc_feature: Encodes the peptide sequence at SEQ ID NO. 65586
  misc_feature (552)..(552): n is a, c, t, g, unknown, or other
  misc_feature (553)..(553): n is a, c, t, g, unknown, or other
ggagctccccgcggtggcggccgctctagaactagtggatcccccgggctgcaggaattcgtctcacccctagaaaaacctcctagcacaccagacgccgccgcgagcccccagcatcccagcccagatgttcctcgccgacaagtacagctcgctgctgcccttccaccaccaccattccaagcccagccgacgccagcagcagaagggggaggcgcaccggttcggcacggcgctggccgcgcgcctccggggcctgctgccgctgccgggctccccgctcgccgcgctcgtgcgggtggtcgacctcctcgcgctcacgcacgcctaggcggggcccgcgctcgcctgctccggcgagggcgccgccgtcatgacccacctcgacgccagcgtcgcgctcctcgacacctgggacaccctgggcgtgcggctccacgggctgcgcacgagccttctcctcgcgagtctcgcgttccacctcctcgtctcctggaccgcgacgtcccgcttgacgctcgctcgcactgcggttggtatagccgaaacccnnggtggcatcccctggagcctcctgcggctcccttgggctcccgtatcgagcttacccaagcgtccgctcacggccgg

SEQ ID NO: 65586 - protein, 67 aa, Zea mays
  misc_feature: Ceres CLONE 1537023
MFLADKYSSLLPFHHHHSKPSRRQQQKGEAHRFGTALAARLRGLLPLPGSPLAALVRVVDLLALTHA

SEQ ID NO: 65587 - DNA, 627 bp, Zea mays
  misc_feature: Ceres CLONE 1537028
  misc_feature: Encodes the peptide sequence at SEQ ID NO. 65588
aaagctggagctccccgcggtggcggccgctctagaactagtggatcccccgggctgcaggaattcgtctcacccctagaaaaacttcgaagaaagcgacgggtgccggatccagactttattccccaaaaaccaaaataatcgccaccgctctccgcacggaaccgaagcggcggcgatggcggcggagaagccggctcccgtgcgcgtgctctactgcggcgtctgcggcctcccggccgagtactgcgagttcggccccgacttcgagcgctgcaagccctggctgcgcgcgcatgcgcccggcgtctaccccgacgaccttgtcgccgcctcctcctcctcatccggcggcggcgacaaggacgtcgacggggtcggggatcgcctccagggcgtcgggatctccgacggctccaccagcgccgcaggggatgcttccgcgtcctagccccaagaggcgaaacgcctgcctggtggtaagctcaagagaaaggagaagcacgaagtggtcattggagaaaattgtccgtaacaagcgccaaatgtgttactgtggtgaaaggggcttgaattgtcttggtgtaaagcttactgatgcctccaaaaaagctttgggaagaattt

SEQ ID NO: 65588 - protein, 90 aa, Zea mays
  misc_feature: Ceres CLONE 1537028
MAAEKPAPVRVLYCGVCGLPAEYCEFGPDFERCKPWLRAHAPGVYPDDLVAASSSSSGGGDKDVDGVGDRLQGVGISDGSTSAAGDASAS

SEQ ID NO: 65589 - DNA, 691 bp, Zea mays
  misc_feature: Ceres CLONE 1537030
  misc_feature (263)..(263): n is a, c, t, g, unknown, or other
  misc_feature (264)..(264): n is a, c, t, g, unknown, or other
  misc_feature (270)..(270): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (295)..(295): n is a, c, t, g, unknown, or other
  misc_feature (303)..(303): n is a, c, t, g, unknown, or other
aagctggagctccccgcggtggcggccgctctagaactagtggatcccccgggctgcaggaattcgtctcacccctagaaaaaaccgtcattccactccatcagtgggcagcgctctgctctcctccactcacgaactcactcactcactccccttgcccccatccatccgctagccactagctccagcaggctcgccgccgacactccactagtgctctgctctctccgctccactcacaaactcccctcgctccccccccnnacccanacaaaannnnnngnnnnnnnnnnangggaaggncgacgcgggggcgaggagaaggacaaggggagaaagggaacggaactggacgtctacaaagccgaagcggaaaaacaaacaaaatcacatggacaactgcgaaacccaccccactggacccactgctcaagaacaaaaaaaaaaaagacccgtcccgtcagcatagcatcgcattctgccgagcagggcaacacgctggtagccacccacatgaatcacctaccgggataaacagcctccccggccaccaccaggaaaatccgcgcggcgccaccccctgatacaagtgtcaccgccgtcccccaaggtgtcatagtgatagaaacatggggggagagccaggggccacactctaaccgcgaggactgaaagcgtgccgagcctgggg

SEQ ID NO: 65590 - DNA, 768 bp, Zea mays
  misc_feature: Ceres CLONE 1537034
  misc_feature: Encodes the peptide sequence at SEQ ID NO. 65591
  misc_feature (19)..(19): n is a, c, t, g, unknown, or other
  misc_feature (768)..(768): n is a, c, t, g, unknown, or other
attttttatatggaagacnggcaaaaaataataaaaaaaccctacctccccctcaaccccggagctccccgcggtggcggccgctctagaatagtggatcccccgggctgcaggaattcgtctcacccctataaaaagagctgccatgaggcccgaacagttgaagctactagcgtgtagctagggaagagaagcgcgcgagtagctagcagacgtacgtaggcagaagcctagctgggtttgaagggccccgatcgatgatcccctacgcgactgcggcggaggcggagggagcactggggcgcaccatgacgtgggctgagacagcatggtacgagtactcggcggtgatgccagattcctggctgcactgccacaccacatttatcctgttcgtcatctacagcatcgccccgctgcccctgctactcctagagcagctcgctccgtccgtcgtgctgccgtacaagctgcagccccaggtatcgttgctcccggcagcctccctcagctgctacatggacgcggactgcttctttccgctcgccgttggcacttcaattcgtcacctaaccttgcgctcgcctataatactatcgacccctaatggcactgcccgtccgcccgtctcgcgagcgcaaaacccttcgcggccagctaactccgtattaactcctctatcccggcaaggatcttacccttcattccttctgtggtatggccacccagatccggcctggccatccccccccactcgtgctcgtctcn

SEQ ID NO: 65591 - protein, 170 aa, Zea mays
  misc_feature: Ceres CLONE 1537034
MIPYATAAEAEGALGRTMTWAETAWYEYSAVMPDSWLHCHTTFILFVIYSIAPLPLLLLEQLAPSVVLPYKLQPQVSLLPAASLSCYMDADCFFPLAVGTSIRHLTLRSPIILSTPNGTARPPVSRAQNPSRPANSVLTPLSRQGSYPSFLLWYGHPDPAWPSPPTRARL

SEQ ID NO: 65592 - DNA, 595 bp, Zea mays
  misc_feature: Ceres CLONE 1537039
  misc_feature: Encodes the peptide sequence at SEQ ID NO. 65593
ggagctccccgcggtggcggccgctctagaactagtggatcccccgggctgcaggaattcgtctcacccctagaaaaacccagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactgaagaggatcagaagatattcaagtacttggactcccttgatgtcgatgattctgatggttaaggcaggatattcccttttacctttaactttccccgaaaaaacccct

SEQ ID NO: 65593 - protein, 117 aa, Zea mays
  misc_feature: Ceres CLONE 1537039
MTAPADKGKKAKTDADGGEENEQIDGALVFSIEKLQEIQDELEKVNEEASDKVMEVEQKYSEIRRPVYLKRGDIIKTIPDFWLTAFLSHPLLSELLTEEDQKIFKYLDSLDVDDSDG

SEQ ID NO: 65594 - DNA, 648 bp, Zea mays
  misc_feature: Ceres CLONE 1537041
  misc_feature: Encodes the peptide sequence at SEQ ID NO. 65595
tggcggccgctctagaactagtggatcccccgggctgcaggaattcgtctcacccctagaaaaaaaacgcaacccctctcgctctcaagcttcaaaatcccactagcgaaaggaaaacgggagaagctaggaagcagcagccgcggcatttcttccttgagcgttcgccttcggctgctcaacgcgtgcttggtttcaggagagccttggtggcatctctgtttcatggccgagatctgctgtgaggcggcggcggcggggtcggaccagaagggggagtgcgccggcagccgcgcggcgcggcggcggaggatggagattcggcggctcagggtggtggccgacgaggcgtccgccgagaggcggaggctggacgcggatgacgaagacgcggctggggggcgagcgccgaggtacggcgtgacgtcggtctgcgggcggcggagagacatggaggacgcggtgaccgcccgtccggagttcatcaacggccaccacttcttcggggtgttcgacggccacggctgctcacatgtggcgacctcctgcggggagcggatgcaccatattgtggccgaagaggcgacacctgccgcaggctcctccgtttcggaccaaaacccccggtggaagggtgtccttgaagaa

SEQ ID NO: 65595 - protein, 141 aa, Zea mays
  misc_feature: Ceres CLONE 1537041
  misc_feature: SWISSPROT Homolog: EC 3.1.3.16 Phosphoprotein phosphatase
MAEICCEAAAAGSDQKGECAGSRAARRRRMEIRRLRVVADEASAERRRLDADDEDAAGGRAPRYGVTSVCGRRRDMEDAVTARPEFINGHHFFGVFDGHGCSHVATSCGERMHHIVAEEATPAAGSSVSDQNPRWKGVLEE

SEQ ID NO: 65596 - DNA, 666 bp, Zea mays
  misc_feature: Ceres CLONE 1537046
  misc_feature: Translation starting site: 164
  misc_feature: SWISSPROT Homolog: EC 2.7.7.4 Sulfate adenylyltransferase
ggagctccccgcggtggcggccgctctagaactagtggatcccccgggctgcaggaattcgtctcacccctagaaaaaaactcgccgtcgtcttctgcggttctgccgtctacgcctccaatttggcctctctcccttgcaagtttaagcttcatcttcggccatgggtaaggagaagtcccacatcaacattgtggtcattggccaagtcgactctggcaagtcgaccaccaccggcaaactgatctacaagcttggaagcattgacaagcgtgtaatatagaggtttgagaaggaggctgctgatatgaacaagcggtccttcaagtatgcttgggtgctccacaagctcaaggctgagacgtgagacgggtatcaccattgatattgctctgtggaagtttgagaccaccaagtattactgcaccgtcattgatgcccctggacaccgtgacttcatcaagaacatgatcactggtacctcccaggctgactgtgctgtccttatcattgactccaccactggtggttatgaggctggtatctccaacgatagccagacccgtgagcatgctctccttgcgttcactcttggagtgaaacagatgaattgctgctgcaacaacatggatgcaacgactcccaaatactcgaaggcgtgttatg

SEQ ID NO: 65597 - DNA, 792 bp, Zea mays
  misc_feature: Ceres CLONE 1537047
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (243)..(243): n is a, c, t, g, unknown, or other
ttttttttttnnnnnnncnanatttttnnnnnnnnnnnnnnggcattannnnnaagacaatggagctccaccccggtggcggccgctctagaactagtggatccccccggctgcaggaattcgtctcacccctagaaaaactccttccttccatccattcctccctgtctccgccctcttctcactcccgtaggccgtggtgccgccgccgactgctgggaccgccctacaccaagtgcccangtcatcttcgggccattcgccggcgacgagcaccaccaggtgtgccaggttgaacgaactatggacagcctgtggcatcttgcggacgagctcccttgtcaccccaaggggggggaggaccccccctggtctctcttgtactcccagctggcgaagaataccaggtttttttttttcccccatcaaggggggggagacgggccccccactccaaataaaacttcccccccccttttattaaaaaaaaaaaaatgtctcctatttctccccacgggcgctcctcaacctttgatcccccaccatgaaacacaaggtttctaccaagcaaagattccccgcttccccggggatatgtcccttttccctgtccaactaccagtcatctctaaaaagtgaagccaatgactaggttcccgtatgacgtaccaccgccccccacccacccccacgggttgggggttcataccattataaccccctcccatcagtagcctacaattcagatttcacgctgccccacgcccggtaaaaaaaaccaccggatcctgg

SEQ ID NO: 65598 - DNA, 791 bp, Zea mays
  misc_feature: Ceres CLONE 1537048
  misc_feature: Encodes the peptide sequence at SEQ ID NO. 65599
  misc_feature (17)..(17): n is a, c, t, g, unknown, or other
  misc_feature (18)..(18): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttttttctcttctcnnctttatccctttctttgnggggtcannnnntaaaagaggagctccccgcggtggcggccgctctagaactagtggatcccccgggctgcaggaattcgtctcaccccctaaaaaaaagggcctctcgatcgctcatcagtcgccaaaggagttgttgatcgaggcaagtgaggttgaaaagaaggcggcaaacaaaggcaccttcgtcttggacggcgaatactacggcggcgggtactacggcggcgggggcgccatcgcaacgccggggtacgctccggcggtcccgtacggaatgtcacaggtgaacatctagggcaacgggtgcgggcgggcgctgcccccgcatccaacagtgaaggtgtcctgcctcgccacccccaactacgcctttgacggtccgcaacggaataggtggtgcttgtcgccggcaaactccaaggaacaattaccagcacttggaatcagggcacatgcgggggaagcctcgagcttcctaggactagtgaaggttttccccaggattcccttctgggtgaaaaaaggccaaccgtgggaaggcctatcaagtcactcgcctgggggcaattccacccccggtgcccccaggggtcccctaccaaccccggaaactttttgggaaaaaaatccggtgtcttgtggaaccgagaaaagccccgcacacgactcgttaaacgggtgtcaccggctcagccttccccatctgtgtcaaaaacaacttccaatcctccataattttatacatccccctg

SEQ ID NO: 65599 - protein, 110 aa, Zea mays
  misc_feature: Ceres CLONE 1537048
  misc_feature (6)..(6): Xaa is any aa, unknown, or other
  misc_feature (12)..(12): Xaa is any aa, unknown, or other
  misc_feature (15)..(15): Xaa is any aa, unknown, or other
  misc_feature (16)..(16): Xaa is any aa, unknown, or other
FFSLLXFIPFFXGSXXKRGAPRGGGRSRTSGSPGLQEFVSPPKKKGLSIAHQSPKELLIEASEVEKKAANKGTFVLDGEYYGGGYYGGGGAIATPGYAPAVPYGMSQVNI

SEQ ID NO: 65600 - DNA, 862 bp, Zea mays
  misc_feature: Ceres CLONE 1537050
  misc_feature (9)..(9): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttttnccctctcttctccctccccatttttnnnnccataannnnnnnaaaactggagctccccgcggtggcggccgctctagaatagtggatcccccgggctgcaggaattcgtctcacccctagaaaaaacccccttctctctcgtagcaacgtttggggcgccgtcgctgccgccctactcgggtgcccaggtcttgttcgggcccttcgacggggagccaggggacactttctctggtatgagaggattaatgtccaatttgttatgatgattaccaaccaccctgacgcacatggaggacgactatgatatgaatgatcctgcctgaatgatttgtgttccaccaggcgggtgggtcttagggagttttgatgctcattaagaatgacttggggtattatctctttgggactgtttttgtttatccccctcccccgggggggggggggggggggggtgtcgggtaccatccccaccgaaacaccccttcttgatacatgcttagaataatcaccccccccactccgcgccagcgcccgccccgcctgtattttcaaatccgtccgctagacattccttcactggagtggtccctctttctcatcttttgtttaaaagttagtgtctccctcacaggagtcgcccaatatacacttatatttcataacacctcaccacttctaccaaacacctaactccctctttaattatgcgttcccccctcctcttgttgaagtgtacacggagtgcggggaatcaacggagagattgtgattgtcacgcggactctgcaccgcgtgcccccgcagaccgcgacccgcggtgtacaacgtgatccccacgccatcctactca

SEQ ID NO: 65601 - DNA, 952 bp, Zea mays
  misc_feature: Ceres CLONE 1537063
  misc_feature: Encodes the peptide sequence at SEQ ID NO. 65602
  misc_feature (7)..(7): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (605)..(605): n is a, c, t, g, unknown, or other
acacatnctttttttgttcttttnnnnttgtttnnnnnaaacactgggactccccgcggtggcggccgctctagaactagtggatcccccgggctgcaggaattcgtctcacccctagaaaaattcataatattgaagcctcctttgaagatgatgggtggttcaactaatatcaaatctggcttcgagactttcaggggatggagacaacaggctgatggtgggaacgctgaggacgacttggggaacatattttagcgggtgtcgactaatgggcatgtggatgttcgcgcaaacctgattgggccttgtaagggcaaggcaaatgtacaactgtgcatcctcccatgctcgattaacccttgacgaaatgcattatgaatcagttttttcctgttttttttcccccctcccaggcggggggggggcggggctctctttttcgttctcaaatcccccccccctgttatcacgagtcataagggcgtccgtcggttggaccccgggtggtggttggggaccaatccccggccgtcaaccgccgagttgcgtctggcgctcgccaacagccactccgcgttggcggggaccctctctgcggaaangttgctactggtgcggcgctcgtctgctgatggtcggccgttcagccacgcaccttttcaccccatcgcatcctaacgcgtgcgtcctgactactgccgctgtgcttgccgatatcctcgctacttgccattaaatacactccttctgtccgctgatgcgcgcgttctctggtcccttctccctttcctcctctgatgtcctagacgtgtagcgatcgtgcaatggactaaactacttcttcccggcgtgctgtcggagacgcacgtgtcagccgcggtgaggctctctacatgcttcatgatcttctcatagactcccctcacgtacctggcgaggctcactgtgg

SEQ ID NO: 65602 - protein, 85 aa, Zea mays
  misc_feature: Ceres CLONE 1537063
  misc_feature: SWISSPROT Homolog: EC 3.1.3.16 Phosphoprotein phosphatase
  misc_feature (3)..(3): Xaa is any aa, unknown, or other
  misc_feature (8)..(8): Xaa is any aa, unknown, or other
  misc_feature (9)..(9): Xaa is any aa, unknown, or other
  misc_feature (12)..(12): Xaa is any aa, unknown, or other
  misc_feature (13)..(13): Xaa is any aa, unknown, or other
THXFFVLXXLFXXNTGTPRGGGRSRTSGSPGLQEFVSPLEKFIILKPPLKMMGGSTNIKSGFETFRGWRQQADGGNAEDDLGNIF

SEQ ID NO: 65603 - DNA, 738 bp, Zea mays
  misc_feature: Ceres CLONE 1537065
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaacacagcatcctggcagctgcaagaattcatccccagtcgagtcacgaaaatggtttgcgtgttggctatgtcgtgtaagcttattcagttattcttggtggtttgggtcggtaccgtgtcattccccgtttacgtagctctgaaatctactattctcatgtgtgttgccttccaatcagtaatagtaatcagcaattgtctgccatatctcctacaaggatatttcccagttctattgttttctcttgatgttccaccaacatatcacattcaggtaatcgctctgcatatcaatgcaaaaaaaaaaaaaaaaactagacgctccaggtacccaattcgccctatagtgagtcgtattactcgcgctcactggccgtcgttttacaacgtcgtaactggcaaaaccctggcgttacccaacttaatccccttgcaccacatccccctttcgccagctggcgtaatagcgaaaaggcccgcaccgatcagcccttcccaacagttgcgcaacctgcatggccaatggaaattgtaagcgtaaatattcttgttaaatttcgcgtttaaatttttgttcaaaccagctcattttttttaaccaattagcccgaattcggcaaaattccctttataaatccaaaagattagacccaa

SEQ ID NO: 65604 - DNA, 820 bp, Zea mays
  misc_feature: Ceres CLONE 1537071
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (33)..(33): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (74)..(74): n is a, c, t, g, unknown, or other
  misc_feature (79)..(79): n is a, c, t, g, unknown, or other
gttggggttgcccccccccnccccannctnttnctttanaannnnnnnnnnnnnccccaacggagctcgccccngtggngggcgctcttcactattggatcccccgggctgcatgtattcctctcacccctagaaaaaagcgcgagtggtggcacccacgcacactcttctccccccagtccggaccccggaggagccaagccatggcgtccacctcctgctggctcctccaccagtcaaccgcccgcctcggggcgtccccccgcctggacgccgccccgccccaaaaggcctaaatcctcgtctgccaggccccaaagctcgatgcctccgcctaccaaacccacggcggcggccgtgtccccacagatctctctgcctgcgggagagtctcccaccggcgactaaagttttttttcccccccccaggggggggggggggggggggttcccttcttccctcttttcccacacaccccctcctcacctcactctaacttcgcagcgatcctccctgacaccacccctccccacaagagcagtgcgtccccgggattcatactgaccaccgaaggtgggagccctctctaccgagtgtacctatgcggggactatcgtagcggcccgaacttggcagactgccctcggccaaaaggtgtcagtgtctctgggtgcaagagcgcccatatgttcagttgaaaggtgggattgccgcgtcatatgtaaagccaatccctgtcgtgtgctatcatggaagacattatctgtggaactacaaagagagcaagcgagggacgagtattatactcagtgtacgagc

SEQ ID NO: 65605 - DNA, 913 bp, Zea mays
  misc_feature: Ceres CLONE 1537074
  misc_feature: Encodes the peptide sequence at SEQ ID NO. 65606
  misc_feature (22)..(22): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
cacccttacctaaacgtgaacntcttccccncccnnnnnnnnnnnttcatactggagctccccgcggtggcggccgctctagaactagtggatcccccgggctgcaggaattcgtctcacccctagaaaaacttttcacagaccaattggccgtcatgcagcatccacaaaggagtccagctgtagccacagagtgcaagggtgatgagaagccaaagcccgtggctagcatgagttgatacgagtacatcctcagcgtagcatggttacacttcaaatgtaccattggagccgcgttcatccgccatctgccgttggcaggattggaactcccttcatattactacatatgcggccctgcctcccgcctctctcgcattcactgacagcgatgttgtgtagtacttctatcagtcacagtaagatgcccgaaggaattttgcgctccgccagtatttagaggttgacccccccctctggtgagtgtctcatactgtacccaacatatcgccgtaagacgaagtagcccctaccaaagccggcagctccgatgattaccgcaacgtcttttacaaaagcaactgctcaaaactcgcagactctctgggagctgatgcaagctcacgcgttaaaatcatccaccctctgactactatcctaataccgcgcccttgtcccgtctaagtctgtcgctgtctgatccgcccataagaagcgttcccgcagctccggattatggtcttctgttgcgatatatcgcgcctcacgtccccgtgattgcgcgcgcctcatgctacccatcactctgagcctccacctcactacttctctcaaatttcaagccgaggacattttcctggctttctcgtctgatccatcgcattgtttatccttaacggtggacggtggctcg

SEQ ID NO: 65606 - protein, 78 aa, Zea mays
  misc_feature: Ceres CLONE 1537074
  misc_feature (7)..(7): Xaa is any aa, unknown, or other
  misc_feature (10)..(10): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
  misc_feature (15)..(15): Xaa is any aa, unknown, or other
PLPKREXLPXPXXXXHTGAPRGGGRSRTSGSPGLQEFVSPLEKLFTDQLAVMQHPQRSPAVATECKGDEKPKPVASMS

SEQ ID NO: 65607 - DNA, 796 bp, Zea mays
  misc_feature: Ceres CLONE 1537076
  misc_feature: Encodes the peptide sequence at SEQ ID NO. 65608
  misc_feature (7)..(7): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
gttgtgnttccgcgtctcgtcctttctcccctccccnnaacacacnnntattaaaactgggactcctcgcaggtggcggccgctctagaactagtggatcccccgggctgcaggaattcgtctcacccctagaaaaaaccactggatccttatatacgccggcggcctaagacaccgccagcagccagctcccactcgcaccgcccgtccgcccagaactatctcgctcgtccgcgttcagctcagctactccaatttcgcaacaagttgcaagctataaccgaccaaggacgactaacgggtcgatggccacgctctcctcctgcagccgcctgagtagcggcaccggcgccgcggccatccaccggcagccggtccgtgctggaagccgtcctcgtcgtcacctgcaaggggagctcctccgcgaccgtccgcgccgcaaccgctgccacggcggcggcgccagctgccgtagagctgcagaacaagggggtgtcgcatgccaacaggggattaattcaagctcgggagggcgcctgactactgtaaaaaccaactacggccctccccgccctcccccccggccgaaggcggcctgaaccctggttcttaaaaacccgtccggcgaactaaaatgggccctcctcaaacaagggggttcacgacatagggaaatttcaaacaggctggtattccaatcacagaccccatctcattgttgcggggcggtaaaaaatcctcgtacagctacttaaatgaaaccccttctcaaagtaataaccccgcggccacacat

SEQ ID NO: 65608 - protein, 97 aa, Zea mays
  misc_feature: Ceres CLONE 1537076
MATLSSCSRLSSGTGAAAIHRQPVRAGSRPRRHLQGELLRDRPRRNRCHGGGASCRRAAEQGGVACQQGINSSSGGRLTTVKTNYGPPRPPPRPKAA

SEQ ID NO: 65609 - DNA, 757 bp, Zea mays
  misc_feature: Ceres CLONE 1537079
  misc_feature: Encodes the peptide sequence at SEQ ID NO. 65610
aaagctggagctccccgcggtggcggccgctctagaactagtggatcccccgggctgcaggaattcgtctcacccctagaaaaactgcccctaccgacggtaccgtccgcgtccgcccgctccgcctcccaaacattcccccctagaaaaatttggatctgggcttaatattatgcttgcgtcttgggcttgctaggagattaggacaatttactacaagagcccatgaggatatgagcaatttggaattctaaatgttttgtttatggtgttgtcatctggttttaattcaaatcgataagagatgagattattcttgctttgccattagcccattacctttttatgtttatatccatgttccatggtgtataatgtttatactctctctgttgcggttgctcttacctctcttatttgatttgacaaaaaaaaaaaaaaaaacgagacgctcgaggtacccaattcgccctatagtgagtcgtattacgcgcgctcactggccgtcgttttacaacgtcctgactgggaaaaaccctggcgttaccccacttaatcgccttgcagcacatcccccttttcccccgctggcgtaaaagcgaaaaggcccgcacccgattcgcccttcccaacagtttgccccaccctgaatgggcgaatggaaatttggaagcgttaaaaattttggttaaaattccccgttaaattttttgtttaaatccgcctccttttttttaaccccatagggcccgaaatg

SEQ ID NO: 65610 - protein, 73 aa, Zea mays
  misc_feature: Ceres CLONE 1537079
MFILSLLRLLLPLLFDLTKKKKKTRRSRYPIRPIVSRITRAHWPSFYNVLTGKNPGVTPLNRLAAHPPFPPLA

SEQ ID NO: 65611 - DNA, 641 bp, Zea mays
  misc_feature: Ceres CLONE 1537080
  misc_feature: Encodes the peptide sequence at SEQ ID NO. 65612
tcccccgggctgcaggaattcgtctcacccctagaaaaagtccatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaacccaaaagggaagggggaaaaaagtcagcaaaaaaggggggggggccaaaaaaggcctacaaaccgttgggagggaatggaaccttcctggccgaacccccccctggcagggatagaaaaccagccccccccttcctgggccctccccggtgagcccgcgggggggcgccccccccctttgggggaagagccccaaaaaaatatcccccaaaaaaaacctctttttttacactgtgggcccaaaaaaaaaaaaaaaaagcgaggcccctcagggggccccccattccccccctattggggggggggttatttggcgccccctcgtgtgcggcttttttcaccgcggggggtgggggggaaaaacctcggtg

SEQ ID NO: 65612 - protein, 85 aa, Zea mays
  misc_feature: Ceres CLONE 1537080
MASLKAAKPSGVAAQGKEPAPKLSETATKPSAAKSGGVKKAEQKPRETQKGRGKKVSKKGGGAKKGLQTVGREWNLPGRTPPWQG

SEQ ID NO: 65613 - DNA, 751 bp, Zea mays
  misc_feature: Ceres CLONE 1537085
  misc_feature: SWISSPROT Homolog: EC 3.2.1.23 Beta-galactosidase
  misc_feature (251)..(251): n is a, c, t, g, unknown, or other
  misc_feature (253)..(253): n is a, c, t, g, unknown, or other
tggagctccccgcggtggcggccgctctagaactagtggatcccccgggctgcaggaattcgtctcacccctagaaaaaaatgtatatattgtttcgaaatttgggaagtgaacagaaccttttgttaaatcacagggtgcacctggattcgtttgacctacttctgtacatgaatcaaacatggaggctcgtacttgagctaatgagtccatgagcagagtggtagatcgtttcagtttccgtttgccgnanaaaaaaaaaaaaaaaaaaaaaaaaaaaaaattgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatccccttgcagcacatccccctttcgccagctggcgtaaaagcgaagaggcccgcaccgatcgcccttcccaacatttgcgcagcctgaatggggaatggaaattgtaaccgttaaaattttgttaaaattccgcgttaaattttttgttaaatcagctcatttttttaaacaaataggccgaaatcggcaaaatcccttataactcaaaagaatacacccagaaagggttaagtggttgttcccgttttgaaacaagaatccaccttttagaagaacggggattcccaccttcaaagggcgaaaaacctctctatcagggcgaatgcgcccttact

SEQ ID NO: 65614 - DNA, 632 bp, Zea mays
  misc_feature: Ceres CLONE 1537086
  misc_feature: Encodes the peptide sequence at SEQ ID NO. 65615
atagctggagctccccgcggtggcggccgctctagaactagtggatcccccgggctgcaggaattcgtctcacccctagaaaaaactccaaccgccgagccagaagcacccggagcagcgcacagcaacagagcacacgccgcacaccgccgcctccgcagcagcagcaatggcgcgcgccggcgctctctgcctggtgctgctctgcctcgtggccgcgcactcagccgcggcgcagaagtccacgacagccccggccgccgcgccggccgccgccaccaccccgccggcgaccccgaccaagaagacgcccgcgcccgccgccgcgccgcccaccaccccggccaccctggccccggccgccgcgccgcccaccacgccggccacccccgcgcccgtcgctgcggcgcccactaccccggccaccctggcacccgccgcggcgccgcccaagtccgcccccaaggcgtcccctcccgccccgtcgcccaaggccaaggccaccccgccggtggccgagctgccgcccgccgcctcgcctcccgcccccgcccccgcctccccgcccaccaagcccgccgaggtccccgcgcccgcgccgtccaagaagaagaagaagccctcctcgtcgt

SEQ ID NO: 65615 - protein, 154 aa, Zea mays
  misc_feature: Ceres CLONE 1537086
MARAGALCLVLLCLVAAHSAAAQKSTTAPAAAPAAATTPPATPTKKTPAPAAAPPTTPATLAPAAAPPTTPATPAPVAAAPTTPATLAPAAAPPKSAPKASPPAPSPKAKATPPVAELPPAASPPAPAPASPPTKPAEVPAPAPSKKKKKPSSS

SEQ ID NO: 65616 - DNA, 688 bp, Zea mays
  misc_feature: Ceres CLONE 1537093
  misc_feature (566)..(566): n is a, c, t, g, unknown, or other
  misc_feature (567)..(567): n is a, c, t, g, unknown, or other
atagctggagctccccgcggtggcggccgctctagaactagtggatcccccgggctgcaggaattcgtctcacccctagaaaaacggtaacgccgccagcatcccctccaagtgcggcgtcagcatcccctacaccatcagcacctccaccgactgctccagggtgaactgaaccctaaacgacgacgacggcgccggcggccgcctgaagacgatccatatctatcccgccgtcgtcggcgcctgcggttcggaccgtcatgaccatatctacctacgcatgatcacgacttgcatgtctactactactactgaataaaaaaacctctccgcgcacgtcgtccttgtgtctgtgtgtgtgtgagagagagaggagagccggccatgtccttttggctgtttggtttatttttgagttcatgcggtctttatttatttccatgtacccagtacccaccttgtaccatgcatgttccttatgatacactcaccctcctttttttgtttttgcaaaaaagggggtttccccccccccgccccccaaaaaaaaaaaaaaaaaaaaaaannttgcccccctccgggggacccccccccccccccctaaagggaaaaataaccccccccccccccggccgcgtttttttaaccccccggggggaaaaaaaaaaattttttttctttttttttt

SEQ ID NO: 65617 - DNA, 837 bp, Zea mays
  misc_feature: Ceres CLONE 1537098
  misc_feature: Encodes the peptide sequence at SEQ ID NO. 65618
  misc_feature (11)..(11): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ggggtgtggcnttttggttttttttcccccccannannnnnnnncccccnnnnnaaaaacctgggactccccgcggtggcggccgctctagaactagtggatcccccggggtgcaggaattcgtctcacccctagaaaaaacacccaatggcatcacgaatgtggaacctcaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgaccccactagcccggtcatctcgctggccaactggcgcctcctcctccaagaccaacaccggaaaggtttactgttattgcccctcccccccaccggggggggggggggtgatatccccgttgttttcccggtcctcccctcccggcggggaggccccagcgggggcgtcctgtcacgccacgcgcggggcgtttcttgggattcgggtttccacacgcggcgcccccccgtccgcctcgccccgctcgtccgccccccgatgcggtcctcgctggtctccgctcccaatgcccacatgcgggtcgccctcgccgcgcggaggtgcggtccccccctagcccctgcgccccccccgcgtcgcgcgtgggacaggagtgaggggggggggggcgtagatgggtgcgggggatacggcccgccgccgcggtgccccttgtgggggatggtgagaggttgcgcactggaggcccgtgggcgctcgtcggcaggcgtattg

SEQ ID NO: 65618 - protein, 230 aa, Zea mays
  misc_feature: Ceres CLONE 1537098
MASRMWNLKALVTSLLCISALSSSPWPCTAAGQLGGKPLVTAVTKDASTSLYTAPLKDGHPLVLDPTSPVISLANWRLLLQDQHRKGLLLLPLPPTGGGGGDIPVVFPVLPSRRGGPSGGVLSRHARGVSWDSGFHTRRPPVRLAPLVRPPMRSSLVSAPNAHMRVALAARRCGPPLAPAPPPRRAWDRSEGGGGVDGCGGYGPPPRCPLWGMVRGCALEARGRSSAGVL

SEQ ID NO: 65619 - DNA, 798 bp, Zea mays
  misc_feature: Ceres CLONE 1537109
aaagctggagctccccgcggtggcggccgctctagaactagtggatcccccgggctgcaggaattcgtctcacccctagaaaaaactactgaaccaacggatgatatgaccatcgcgcccatcgatcgtgcacatgcatgcatacgtactagcagaataacaggggtcttatctcccgaggcgtctttttgcatgcatgccagcagttgcatagataaagcaggagcgagacaaagggtgttcatgtatattgcagctgtatgtatgtgccattgtgccttgtaataatacatataataataaagttgctcggagtgtattaattctgagaaaaagaaaaaagaataaataataaaattgtaaaaccatatgaaaaaaagaaggaaggatcgagacccttcgaggtacccaactccccccctataaatgagctcgaaataacaccgcgcttccccgggtccgtcctttttaacaacggccctgaacatgggaaaaaacccttgggcggttaccacaaatttaaatcagcccttgaaacaacaattccccccttttcccccacgctggccgaacatagccaaaaaagtccctgcaagccgattaccccctttccccaaatagtttgcgtagcccttgcaatgggctaaaggcaaaattggctacagcgtttcaaactttcggcaaaaaatatccccgataaacatttctgccatatacacgctcctcttatgtttacacagaaaagcacccaaatacgtggtaatatcccttattataagctaacagaacaacgccgcc

SEQ ID NO: 65620 - DNA, 693 bp, Zea mays
  misc_feature: Ceres CLONE 1537113
  misc_feature: Encodes the peptide sequence at SEQ ID NO. 65621
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (398)..(398): n is a, c, t, g, unknown, or other
aaagctggagctccccgcggtggcggccgctctagaactagtggatcccccgggctgcaggaattcgtctcacccctagaaaaaatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgcagggatcaacgcggcagcttagtgacgacgacgactcttctatctctgcgttgattaatggacaggaacagatccatggcgacgagcggcgtggctccgttcgtggccaagacgtaccgcatggtggatgacccgcccacagacggggggggggcgtgnnncangnacaacaacagcttcctcttgaccgaccccttcgccttctcgcagacgctcctgcccgcagacttcaagcactccaacttctcccgcttcggtgcgccagctcacaacctacggctttccggagggccgatccggacccggggggaattcgccgcacggggcgttccattcgcggccagaacgcaactccgtggggcaaaatggtccggccggaacaaaccgttggtaaagcgcacagaaacaagggctacgggtcgagcgcttcctggtgtctcccagaaatacaaagggacgcg

SEQ ID NO: 65621 - protein, 128 aa, Zea mays
  misc_feature: Ceres CLONE 1537113
  misc_feature (28)..(28): Xaa is any aa, unknown, or other
  misc_feature (29)..(29): Xaa is any aa, unknown, or other
  misc_feature (30)..(30): Xaa is any aa, unknown, or other
  misc_feature (31)..(31): Xaa is any aa, unknown, or other
MATSGVAPFVAKTYRMVDDPPTDGGGAXXXXNNSFLLTDPFAFSQTLLPADFKHSNFSRFGAPAHNLRLSGGPIRTRGEFAARGVPFAARTQLRGAKWSGRNKPLVKRTETRATGRALPGVSQKYKGT

SEQ ID NO: 65622 - DNA, 712 bp, Zea mays
  misc_feature: Ceres CLONE 1537116
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
ccagctggagctccccgcggtggcggccgctctagactagtggatcccccgcggctgcaggaaaattcgtctcacccctagaaaaaatgtagagggaggattcttccaacaatttgttttggatggagacttagatctccaaacactcgtaactatcctactaggtggtgacatcagtccccaaaaaacgtttatgggtcataagagtccctgcccccttcggttttgtcccaacccccggggccaaattttttttttccccaccnnnccacacaaacccctccctttaaaaatcccggaagagttttcccccccccccccacaaaaaaacaaccagagagagagaacgctcccacaatcccgcaggaaaaaatatcctttcttgttaaaagaataataagactacgtgggcccaaaattttttttatccccccccactccgggggggggcggcctccccccccacacacaagaaagtatctcccccccccccccgagggtcgggcgatgtttttttccccccccccctctgtgtggagaaaaacacctcctccctctcctaccacttaaaattccggaacctacacgcagaaccccgcactctctattatcctaacggggtggagtttttatatagagaaaaagcaactagaccgactctccccacaaccgcccgcgattcttgtcatcgctactagaggtgcgcagcacg

SEQ ID NO: 65623 - DNA, 835 bp, Zea mays
  misc_feature: Ceres CLONE 1537127
  misc_feature: Encodes the peptide sequence at SEQ ID NO. 65624
  misc_feature (7)..(7): n is a, c, t, g, unknown, or other
  misc_feature (19)..(19): n is a, c, t, g, unknown, or other
gttgttncccccgcgcttncgctctcttttttttttttttattcctccaaaactggtactcaccgcggtggcggccgctctagaatagtggatcccccgggctgcaagaattcgtctcacccctagaaaaagctagcaggaggttggatttcagaggcagaagctttcttcctggcgggctcagggcgcgggcacatcaatggctggcaaggaaatcctccacaaggtgaaggacaaggtgaaagatgcatttacctcatcaggaccagaaacagggaaaggcaagacaaagttatcacgcaagcgtgtctagcatggttaccatctggtgaagggcaaatctaatcatcccatgcaggatcctctagtggcaaagcaccggcaagttggtgaacatgatttgggattgattgctataatcctaaggtcgacccggggctacactgattcacaatttcttcaagccccccattcttattccacaacccatttgacatggtcccagaaatacttggacgtgaacccagaaaaacaggttaatccaataacgctattcccgtacttataccgatcataaaagatcatcttagaataacccccatctattaccttccggcaaggaaggatggcctcccacctgcctggtaaacgtgcccattccgttaattagctataatcgaccgagtctcacgctgaatactcaactctcatccccctaattgcgtctgcggcaactctaccccttgcttattcccttcaagactaacaaacacgcgcgctcaccacccaacgccagcccttttgctactctggatccgcaaggtatcctcacaac

SEQ ID NO: 65624 - protein, 37 aa, Zea mays
  misc_feature: Ceres CLONE 1537127
MAGKEILHKVKDKVKDAFTSSGPETGKGKTKLSRKRV

SEQ ID NO: 65625 - DNA, 820 bp, Zea mays
  misc_feature: Ceres CLONE 1537130
  misc_feature (9)..(9): n is a, c, t, g, unknown, or other
  misc_feature (14)..(14): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tgggggggnttttnttttttctcttctctttctctcccccttnnttggtaannnnaaaaaaagctggactccccgcggtggcggccgctctaaaactagtggatcccccgggctgcaggaattcgtctcacccctagaaaaaaaaacctaccagttccagccagagccagccttccccttcgccatggaggactccgccgcacctcaacgtagatctgcaggaagtaggtcgacgtacgagagggcagagctcgaggcgctcatggacgccccgccgaacgaggcctcacgcccggctcttggtcctaaatccgcgctacctcggccgctttccgggttctcctgccgcagacaaacggggcggactcgctcccctagttagtatgtgagcgagccggggagggtaagcatgagtggctggaaggtttttgttcccccccccaacgggggggggggggggggcggtctcctttcttctttttttttttctgctcccccccccccaacatactgaacgctctgcatgctttcgttcccccaccccgactcccttgtagctccccctgcgtatataattgggattgttggttaacactcccccccccccgctccacccaacgtcctcagccttgtcattttttatagttaatgtcatgtccccacgaaatgcctgaacaaactctcatgccacacacggccaaactcgcgcatttgtgtttatcgttgtgttgcgcttcctctctctcccggactctctggccccacgtttgtgctgtggggctggggcttctccatcacatctctgcccccccacgtcctg

SEQ ID NO: 65626 - DNA, 701 bp, Zea mays
  misc_feature: Ceres CLONE 1537134
  misc_feature (194)..(194): n is a, c, t, g, unknown, or other
  misc_feature (206)..(206): n is a, c, t, g, unknown, or other
  misc_feature (649)..(649): n is a, c, t, g, unknown, or other
aaagctggagctccccgcggtggcggccgctctagaactagtggatcccccgggctgcaggaattcgtctcacccctagaaaaaatttagtgaagctgacactggaaaacaagagacacccgtgtctgctgaggctatggtagaatcatcgagcgagcctcgcagccatgaggcaaaggaagctccaacccctngacctgtctggnggatgatgaaaaagcgaagtcagcaagggctgctgttgttgcggactttttggagatgcacagaagtgttcggatcagccatgccgtctctagagacaaggcaagagcagagccgatggaggctttagagtaaattgcaaatattgtatccagagatactaaaatcccggttagtaaaaaactgcctaaaaaggccttttagttggaaacggggggtaaaccttcttcccccaaaatcaaaaacccaccttgcttgaaatttaaccccaaccctggggcccttcccgggcaagtttcccacccgggtttttggggccacaaaaaaaaaaaaaaaaaaaaaaagcggggccccccctcggggggagccccccaattttccccccccttttaggggggggggcgtttattttcccccccgcccctcccccttggggggggcgcgnatatttttatttaaaacaaaacacgtttctgcgtgaaagaaaaaaaaaaaaa

SEQ ID NO: 65627 - DNA, 652 bp, Zea mays
  misc_feature: Ceres CLONE 1537136
  misc_feature: Encodes the peptide sequence at SEQ ID NO. 65628
ccccgcggtggcggccgctctagaactagtggatcccccgggctgcaggaattcgtctcacccctagaaaaaaccctcaatctcattcaatccagtggattgagagtaaagacgggtggtgcaagcaaggcaggcggagcgggcaagggcaactgggtaagcaagtgagggatgagaatgagggccgtggtgatcacgtgcgccggcgggccggaggtgctggaggcgcgggaggtggaggaccatcccgcgctaggcgaaggagaggtgctcctcgaggtcgccgccgcgggcgtcaatcgcgcggacaccgtgcagcggatgggccggtacccgccgcctgccggcgcgtccccttacccggggctcgagtgctccggcaccatcctcgcgctcggccccaacgtcccctcccgctgggccgtgggcgacaaggtttgcgcgctcctcagcggcggcgggtacgcggataaggtggtggcgccggcggggcagctgctgccgatacccgagggggtgtcgctgacgcacgcagccggcttgcccgaggtggcctgcaccgtctggtcaaccgtattcatgaccagtcacctctcccccggtgaaacattccttatccatggaggatccagtggaattgggacattcccca

SEQ ID NO: 65628 - protein, 158 aa, Zea mays
  misc_feature: Ceres CLONE 1537136
  misc_feature (28)..(110): Pfam Name: ADH_N Pfam Description: Alcohol dehydrogenase GroES-like domain
  misc_feature: SWISSPROT Homolog: EC 1.6.5.5 NADPH:quinone reductase
MRAVVITCAGGPEVLEAREVEDHPALGEGEVLLEVAAAGVNRADTVQRMGRYPPPAGASPYPGLECSGTILALGPNVPSRWAVGDKVCALLSGGGYADKVVAPAGQLLPIPEGVSLTHAAGLPEVACTVWSTVFMTSHLSPGETFLIHGGSSGIGTFP

SEQ ID NO: 65629 - DNA, 778 bp, Zea mays
  misc_feature: Ceres CLONE 1537140
  misc_feature: Encodes the peptide sequence at SEQ ID NO. 65630
  misc_feature (11)..(11): n is a, c, t, g, unknown, or other
  misc_feature (13)..(13): n is a, c, t, g, unknown, or other
  misc_feature (20)..(20): n is a, c, t, g, unknown, or other
ttttttttttntntatcttntttttttctttaccaaccaaaaaaaaaaatagtggaactccccgcggaggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgccacctggaggtgatccactgccgctgggtcatgctgggcgcgctcgggtgcatgttcccccgaactgctccgcccgcaacttccgtcaaattcctgaccaggccctgtcggctcaaaggccgagcccccaaaaccttcagccaaggggcggggcttgaactaaactccgaataaaaccttatcttttattccaacgacgcaaataaaaatccctagaaccaattctcggggccgttggcccagggtggggtgagaccccaagggggctccctcctcccttaatcgggttcccc

SEQ ID NO: 65630 - protein, 146 aa, Zea mays
  misc_feature: Ceres CLONE 1537140
  misc_feature (58)..(147): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRHLEVIHCRWVMLGALGCMFPRTAPPATSVKFLTRPCRLKGRAPKTFSQGAGLELNSE

SEQ ID NO: 65631 - DNA, 576 bp, Zea mays
  misc_feature: Ceres CLONE 1537142
  misc_feature: Encodes the peptide sequence at SEQ ID NO. 65632
acccgcggtggcggccgctctagaactagtggatcccccgggctgcaggaattcgtctcacccctagaaaaagccctaaaccaaatcctccccaaaggcaaatacgaaggtacagtgccccagccccgcgccccctagaccaaagcagaccagaatccgccctaccaatcgcctccccagatcggcggcgatggcgtcgtcgcaggcgaacctcgacaagatgcagctccgccagagctaccgcaacgtctggcacaccgacatgacgaacgccatccaggccgacttcccctactgctgcctcgcgctgtggtgtggaccttgcgtgtcgtacatgcttcgcaaaagggctctctacaatgacatgtcaagatatgtctgttgcgctggctacatgccatgcagtggaaagtgtggcgagagccggtgcccagagttctgtcttgcaactgaggtgttcctttggctttggcaattcagttggcttcaaccccgcttcttgctgccaaaaggaattttaacttacaggacccactcattggggaacaaacgtgctcctttgggcctccagggtta

SEQ ID NO: 65632 - protein, 128 aa, Zea mays
  misc_feature: Ceres CLONE 1537142
  misc_feature (21)..(115): Pfam Name: PLAC8 Pfam Description: PLAC8 family
MASSQANLDKMQLRQSYRNVWHTDMTNAIQADFPYCCLALWCGPCVSYMLRKRALYNDMSRYVCCAGYMPCSGKCGESRCPEFCLATEVFLWLWQFSWLQPRFLLPKGILTYRTHSLGNKRAPLGLQG

SEQ ID NO: 65633 - DNA, 1383 bp, Zea mays
  misc_feature: Ceres CLONE 1537143
  misc_feature: Encodes the peptide sequence at SEQ ID NO. 65634
aacctggcagcgtgacgactgacgagagaggtgtctggacaaatcccaacgactccctgtctcatccgcggccgctgagcggcggcgggccggcggcatccccgccatgcacgaaccgccgcacgacgcggactagctcacccgcatcctcgccatcgggctcgaggatggcgaacccgtgccccgcgcccgggaactcgacgaggtcgacgcgcctgttgcccgcggcggcggcccgggcccgcgcccgcgccacgtactccctgatgcggtcgatcagcatgtcgcggtcgccggccgcgacgagcagcggcgggagctcgcccgcctccgggttcgcggccgggtggtcacgcgtcgcccccgccggcagcgccagacgccacatctggtcgtacagcgggagcgtcaggaacgcgtcgcccgggcaggccgcctccgaccgcgtcctccgctcgccgccgaagaagggccacagcagcacgcacccggcgaggcggcgccccggcgccgcggcggcgtggtgcgcgatgttggcgccggccgagtcgcccgacacgaacacgcggcccaggtccgccgcgtcggcgagccacgggtctgcctgctgctcctgcgcgccgagccaggagaagagggcgtcggcgtcctggagcgccgcggggagccggtgctccggggccaggcggtagtcggcggagagcaccacggccgggagcgcggcggcgaggcgggcgcacgcggcgtggaactccggcgacgcgaagctgccgacgatgaagccgccgccgtggaagtagaccagcaccgggagcttctcggcgccgccgttccccgccctggaggacgatggcacgtacatgcggaggctcaggttgcgagcctcgtcgtagacgacgtccttgcatccgaccggtgccgcatcgtcggcagaggccaagcaggccggcgcgcgcttgacggtgccgtcgctcatgagctggacgagcccgaggcagtcctccacgatgcgcggaggaggagcctcgccggagacaccggacgctggcgaggtggtcgacgacatggcaatgtggagtggagcaagcaacagcagcgtggcgtgcctagcttttggcgtgcagcatatatgctgtgaataatgcgcttcagctggcccctgacgatgaataactgctggtcctcactcctgacagtatgcatacgcctggcaaattagcttaccatatggtaacatttggattcattactgatttagggcctgtttgggagggctccggcacctctgaaaatggcttcggctctggctcttttaaaagagtagctcctctataggagcctgtgttttttgcaaatcgtttggcataaaaaaaaaaaaaaaaa

SEQ ID NO: 65634 - protein, 174 aa, Zea mays
  misc_feature: Ceres CLONE 1537143
MANPCPAPGNSTRSTRLLPAAAARARARATYSLMRSISMSRSPAATSSGGSSPASGFAAGWSRVAPAGSARRHIWSYSGSVRNASPGQAASDRVLRSPPKKGHSSTHPARRRPGAAAAWCAMLAPAESPDTNTRPRSAASASHGSACCSCAPSQEKRASASWSAAGSRCSGARR

SEQ ID NO: 65635 - DNA, 795 bp, Zea mays
  misc_feature: Ceres CLONE 1537145
  misc_feature: Translation starting site: 401
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (36)..(36): n is a, c, t, g, unknown, or other
gtcctctcctccccgcccnnnnnttnnttttttttnttgtaatctccccaatagctggactccccgcggtggcggccgctctagaatagtggatcccccgggctgcaggaattcgtctcacccctagaaaaaaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtccgccttccttggccactctatccgcctcggccgcaccgcgtctcacacgaggcgcatcctctaggcggatgccaagggcgagtggctccccggccttccctccccctcctaccccgacggcagcctggcgggtgaaaatggcttcaacccgttgggcctggctgaggaccccgagaacctgcggtggttcgcgcaggcccatcctcgctaacggccttgtgatccatgctctgcgagacccgaaatgctcattccaagaggatgctgaccaaaacctggtgctgatctaaactcccgtcatttggtaacaacgccccgacaattccccaattactatcgcgttctatacgatcctacacccgttccgaagggccaaagcttacatccctgtatcccccttacttcggcaatttctccacctttttggcttgtgtaattttaaggatacacccgggacattcctctcaaaccgagataacccacattctttgtctaaaaagctatcaagccctatggccgccccacataaaaa

SEQ ID NO: 65636 - DNA, 766 bp, Zea mays
  misc_feature: Ceres CLONE 1537146
  misc_feature: Encodes the peptide sequence at SEQ ID NO. 65637
  misc_feature (12)..(12): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gtgtggcgcccncccgccccccgggcttttttnnttataatannnnnnnaaatactggagctccccgcggtggcggccgctctagaactagtggatcccccgggctgcaatgattcgtctcacccctagaaaaagtgctatccccgcccattcgtcaccagccaggtcccggaaccttatcacaaaatcctcacgtcatggcggccgcgctcttctccacctcgctctcgccccgcttcctcgccctatcctacccgaagccggccgcgcccgcggcctcggcaatcctccccttcacgctgccgctgcgctctgtgtcggcgccggcgccagcgaagcggatcttcgagcccgttgccgtcgcggtgtcgtcggagtacgggaccgagggcgcggagcagcaggacggggagttctacgaggacctcaagctgatcatcggtaacctgccgttcagcgtcgaccctgcgcagctggccgggttcttcgagcaggcgggctccgtccagatggcccaggtttgtattcgataataatgaatggggctgagccccgggatttgggactcttgtaaaatgtcttcagcctgaataaatccgggggctggctgttcgaaccactttccaacgtttatacacttctccaggcaacaacctcctgaagggttgaactgggggggtccacccgcccaccctagtaatactggaacccggcaccctaataatccccccaaggggatggcttggtagaataacaaaccgcgcgg

SEQ ID NO: 65637 - protein, 111 aa, Zea mays
  misc_feature: Ceres CLONE 1537146
MAAALFSTSLSPRFLALSYPKPAAPAASAILPFTLPLRSVSAPAPAKRIFEPVAVAVSSEYGTEGAEQQDGEFYEDLKLIIGNLPFSVDPAQLAGFFEQAGSVQMAQVCIR

SEQ ID NO: 65638 - DNA, 803 bp, Zea mays
  misc_feature: Ceres CLONE 1537154
  misc_feature (380)..(380): n is a, c, t, g, unknown, or other
  misc_feature (803)..(803): n is a, c, t, g, unknown, or other
ctcgaactagtggatcccccgggctgcaggaattcttctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaaaaataaggaggaggagcccccccacaaggcctaggaccaccacaagaatgacgagggggagctccccccgagcgacgggcgggtagcactaggaaggcttcctggcaaaaaatcaccgacaatctccccccctatttttttccccccccccagggggggggggggggggggttaatttcttcttcttntttccctccccccgacctctaacaaaaccctcctaccctctccctcattccctcccgctctcactttgcctaccacccccttacacacctcctatcgatcgaagaataaacctctcctccctataccaatcccaacacctcgatatgaccacctactccatccaccttctcacctcttctccactcccacccctctgtgcgacactatgaccgcctacttccccccctaatactcaacgcaaactctttgtgtactcaccttagatcaccgcccctcgccgtcgcgtcccacctcccatctctccacgcctttggtctacgcccctcgctcccccccagcagctccaccctcatacaacgtataccgacacgccccccccggttgcgcacacggactatcctcgcctaacgtctcttcccttn

SEQ ID NO: 65639 - DNA, 944 bp, Zea mays
  misc_feature: Ceres CLONE 1537159
  misc_feature (17)..(17): n is a, c, t, g, unknown, or other
  misc_feature (19)..(19): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (944)..(944): n is a, c, t, g, unknown, or other
ccgggcatatcattttncncccnnngggatcacnnnnaaaaactggagtccccccggaggcgggcgctctttaatagtggatccccccggctgcaggaattcctctcacccctagaaaaaaaacccccaatccccttcaacaacgcaccggactccacggcagccagaaaacacaatccacagagtctccgtgagggctgagggggggaggactagctctgagcgagttcttccgtcttccaggaataatcctcgcaactctcgctgtccgcctcgcagccctccgactgttttttcgaccccggtgggatgtgtctagtctttcccccggggccggggcgacctcgcagaaccacagcgtcgggctcgtttgtagggtcagggcgctcgggcgtgccctctttttttttttccccccccccgggagggggggggggggggacctcttcgtgccaccgaccggctccccgcctcgggtccggcgcggtcgagcccaaaacgcctcctccctccgctcggcggtgcgccctggctgccgcgcgcgggcgcgccgggcccgacccaccccggctcttcgtgcaccggggtgctgtatggtgagagtagtgcggatcggcacgcgctgcgtactcgcccctgcgcgtcgtccgggcgtcgcgagttccactcgcaggcgctgagcccgagctggcgcgctaccaaccccttcggctcgcgaatggacgccgagcgcatggagtcgcggccggctctccgcgtgcaccccatagcccccacccgcgctcgccgtcctggtgtccggccgccgcgccccgtcaacccgcactcgcgcacagctgcgtagtctgagtggcgccaccacggctgttggtgtcgtcacccccccccgccggtcctgcatctcaccgctctaggggtgctctctccgctcacccactatgcgn

SEQ ID NO: 65640 - DNA, 843 bp, Zea mays
  misc_feature: Ceres CLONE 1537162
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (71)..(71): n is a, c, t, g, unknown, or other
cgtcgctcggctccctgttactgttggtgagaggnnnttnnnggggtcatactgggagctccaccgacggntggcggccgctctagactagtggatcccccgggctgcaggaattcgtctcacccctagaaaaaaaacacttggtataagggtgacattatgccagccgagaacaaagctgaattcctgaaatccagcaatgcagacctagcaagggctctgggaccttgagaatctggtccccagagcggacgggtttccgtccctggccgtcggtgggcctgtttcttcggggcatgggtccccgggtaaagaggatcccggccccggaacccccccggatctctttgggcctttccccggtcccggccccctgaaccactggggttccaaaattttgttttcgccccctatattatctcccaaaaaaaaaactccaccttttttcctccccgcgggcggctttcttcgctctatacgatccctctttttgttcgttcctccgcccgctttctattaaagagacaccagctttccgctccttttttccccccacccccaaattaatatatttgctttcctctgggggggggtaactgtaacaacaacactcgacctctcctccgccgcggtatcgatcgagaggaatggtatggtttatctccgcacccccgtccgacctccggtgcgttggccgatcagccccgccagcaaaactattagcgacccaccctcgaccctctcgcttccctctctcacgtttctccgtttcgtatttgactgttcctgctaacctcacgggccgttgtttggtcaccgcgtctccattacggactatcgagg

SEQ ID NO: 65641 - DNA, 784 bp, Zea mays
  misc_feature: Ceres CLONE 1537163
aaaactggagctccccgcggtggcggccgctctagaactagtggatcccccgggctgcaggaattcgtctcacccctagaaaaaatgaggacgaacaccttaataggatgcttgaagtgttgttgttcgatgtatatttataacagacaacattgttgatttgttgtataaattaaaaggagacgtacactgcgtttgcactaaaaaaaaaaaaaaactggaaagaacaatttacaacgtcgagaactggaaaaaccaccgagacgctcgaggtacccaattcgccctatagcgagtcgtattacgcgcgctcactggccgtctttttacacgtcttgactgggaaaaccctggttttcccacctccctccccgggagggggggccccctttcccagctgggctaaaacccaaaaaagcccgcaccgaatcgcccttccaaaaggttgcgcgccctgaatggcaaaatgaaaattttaacgcgttaaatattttgttaaaatttcccgctaaaattttccataaatccagcccattttttttaaaccaaaagggccgaaattccggaaaaatcccctgataaaataaaagaatacacccggagataggcgttggagcggctgctcccacttttcgaacaaagtgtccaagattaaaggacgcggcattccacacgtttaaaggggcaataaaccacccctctgcggggggaatgcgcccccaccgaatacgaccacccgccccaatcgaaggattattggcggcccaggtgtgctccaaaaggg

SEQ ID NO: 65642 - DNA, 794 bp, Zea mays
  misc_feature: Ceres CLONE 1537166
  misc_feature: Translation starting site: 237
  misc_feature: SWISSPROT Homolog: EC 3.2.1.23 Beta-galactosidase
ttgttttttggaatccgttagatatgtagccgctatatgtctttttaaaactggagctccccgcggtggcggccgctctagaactagtggatcccccgggctgcaggaattcgtctcacccctagaaaaaaaaaaaaggattccttttttcctttttttttcttcttttccccggccatggttcctttgctttccagcagttctctgctggatgtgatgtatccattgttgcaatcatggccttgcattggctacctctatacctgctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgaccccccttcccaacagttgcgcatcctgaatggcgaatggaaattgtaagccgtaatattttgttaaaattcgcgttaaatttttgttaaatcacctcatttttttaaccaataggccgaaatctgcaaaatcccttttaaaatcaaaagaattacacccagatagggtttgagtggtgtctccccatttggcaacaagagtccctcttttaaagaaacgtgggcattccaactttctaaagggcggaaaaaccccttcttattcagggcggaatgggcccccctaacggtgaaacctctcctcccttacatcatagtttttatttggggttctgaag

SEQ ID NO: 65643 - DNA, 750 bp, Zea mays
  misc_feature: Ceres CLONE 1537168
  misc_feature: SWISSPROT Homolog: EC 3.2.1.23 Beta-galactosidase
tccccgcggtggcggccgctctagaactagtggatcccccgggctgcaggaattcgtctcacccctagaaaaactaccatcagacccatccattcgtccgtccgtcgagtgaacagtgtggtcttccctgtactctacttgttcagatcgtaggcgtgtagtagttgcaccagccggcgtatgctcatgatcgatgtgtgtgctcatcaatcaatgtcaatggctgcctgctgtaagcggtcgatgtaaactaagcacagacgcatgtatcgtcatcagtggatgaatcaatctatcgatggcctgtgccattcatttttgaatcgatcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggccccgcaccgatcgcccttcccaacagttgcgcaacctgaatggcgaaatggaaattgtaagcgtttaatattttgttaaatttcccgtctaattttttgttaaatccccctcattttctttaaaccaattagcccaaattcgggcaaattccctttataaatccaaaagaaatacaaccctataaaggggtttgaatgtttggtttccggtttggaaacaagaagttcactctgtataatga

SEQ ID NO: 65644 - DNA, 824 bp, Zea mays
  misc_feature: Ceres CLONE 1537170
  misc_feature: Pfam Name: FF Pfam Description: FF domain
tttgtttccgtggcagctgtccagtccctggatccgggtgtttaatagcttgggctccccgcggtggcggccgctctttactagtggatcccccgggctgcaggaattcgtctcacccctagaaaaaaagtggtgaaatctggatagattcctatgacaacatcatggacattagaggaattccaaactgctattctggaggatgatgctcttaaaggaatatcaaccatcaacatcaagcttatctatgatgatcaacttgaaaggttctaggaaaaagagcaaaaggaggctaagaagcgccagcgtttgggtgaaaatttttcagatcttttgtattccatcacggaaatatcacgcttcttcaacatgggatgattctaaactgcttttcgaggatagccaagagttcatggccttggacagtgagacttatgctcgagagctttttgatgacccccttggttcagcctgaaagaatggtttaaaagagaaagaacgtttgaagggagaaaagtaaaatctaaaaccaagaccctccgaggtacccaattccccccctattgtggagtcgatattacgccgtgcccccgtggccgtgcgttttcacatacggtttgattgtagcaaaactctgggttttgacccaacttaattcgccttcgcaggccccaccccccttttccccaatctgggaataattagccggataaggcccgggaccaaatgcaaccctttccaactaattgcatagcgcctgataaggcgtcaagggaatatcgggctacggttcactatttctgtctagaatgcccggtaatatt

SEQ ID NO: 65645 - DNA, 628 bp, Zea mays
  misc_feature: Ceres CLONE 1537175
  misc_feature: Encodes the peptide sequence at SEQ ID NO. 65646
  misc_feature (206)..(206): n is a, c, t, g, unknown, or other
aaagctggagctccccgcggtggcggccgctctagaactagtggatcccccgggctgcaggaattcgtctcacccctagaaaaatgggcgggatgaagctgcacgtgctcgtcagccagccggcgggaggagctccggcgaaggccacgccgcagtccacgccgcagacgggctccggggccgcccttgaggcccaggccacccgnaaacgaattggccgggggggctttggccgggggcatttaccccccggggcttcggtttttcccccgggggggggggtccccccttcagaacatcccggggggggggcccccctcctttctaaaaaaaaagggttttttttttaaaacccccaaatttttttttttttttttttttttaaaaaagagttgccccaaaaaaaaaaaacccccccccccttcttttttttttttttttttctaccccccccccgtgttttttttttttttttttctaaaaaaaaaatattggggggcgccccccaaaaaaaaaaaaaaaaaaaaagaaaaaggggggggggggggggggcccccaaccccccccctccccccccgccgggggggggggtggttcccccccgcccccccccccccgccgcggctgc

SEQ ID NO: 65646 - protein, 88 aa, Zea mays
  misc_feature: Ceres CLONE 1537175
MGGMKLHVLVSQPAGGAPAKATPQSTPQTGSGAALEAQATRKRIGRGGFGRGHLPPGASVFPPGGGVPPSEHPGGGAPLLSKKKGFFF

SEQ ID NO: 65647 - DNA, 859 bp, Zea mays
  misc_feature: Ceres CLONE 1537176
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
cctccgcctgtttttttcttggtcgggngggggnnngggnnnnnnttataactggagctccccgcggtggcggccgctctagactagtggatcccccgggctgcaggaattcgtctcacccctagaaaaaacaagtgcggcgtcgattccatggtctctaccgtgtccgcagtccacgcctcgaaggagtagactctggtcagcggtgataatcgtgattccatatattgtcgaactataatccctgctagtaatccatttgtgctgtttatgtatcgaaggcagcagagatgtgtgaagcggcaatgggatgcttgctgtaaggtaatatgtttagcttgctaggcatgctacacgctctttggatgtcgcaacgttatcaccggctgtatacgctttttttatcgaccacatttgaaggataggtgcattaccctcccaccatttcgaactcgccaccacgctccgaggtacccatttccccccttatcgtgatgtcgtaataacgcgcgactctcttggtcggccgcgtttacatacgccgtggactcgggacgaaatcccctggccggttgacgcccaactttgatccggcgcctagctgaaccatcccgctctttctccgccctgcttggtcggttagttagttgtaagcaggcgcccctcaacgcattcagcacgctttcccctgcccggttcgccgcagccccgtgtatggtgtcacagtgcgagacggcctcacgctccttcacgagccgtcgcttcggacttcatcctgttcacattttgttgtggtatacggcgcctgccccgttcttacgccgcgtgggctgcttagcaaggtggccgcgttcggtgg

SEQ ID NO: 65648 - DNA, 942 bp, Zea mays
  misc_feature: Ceres CLONE 1537183
  misc_feature: Encodes the peptide sequence at SEQ ID NO. 65649
  misc_feature (1)..(1): n is a, c, t, g, unknown, or other
  misc_feature (15)..(15): n is a, c, t, g, unknown, or other
  misc_feature (36)..(36): n is a, c, t, g, unknown, or other
ngtgcgtgtggcggngtgggggtcctttgtactaanattaatagctggagctccccgcggtggcggccgctctataactagtggatcccccgggctgcaggaattcgtctcacccctagaaaaaacactgcgacacacagtaggcgaggcgaacgagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcacgccgaaatagggctatactgtcagctaatgcttagtgagatcgcttgacactttgtagtgcatattcatggtaagctggggctttgccggtttccttgggcatttttctcgcgtatggcccccccctgtagttttagcaattctgcgcgacccccccccatcgtatctcctcgctagatataagtctcataacttggtcttgttgcttatctcctattcatgccgcatacctgcaggcctgactgtccaccctagcgctttcatcgccccggtacggcgcttacactacagcactactgacagtcgttgatccaaccgctctccctgtacgtactgtctgcgtcgccaccgctgcctttcgggcccctgctcttccctacccaaccactaccacaagtcgtcacgccttcgttgttgggcgtgcccgattgtccgctagtttattctgtgaagtgtgtggcgtggatgaggcgcgtgcgctgcgtttactggcgagcggtgggtggatatagacgacggcatgcatcctactatctctgttattgatacttaatcgctcgctgctctcccccaactcgttgcctgcgccgtacagtgatcactgctattctcag

SEQ ID NO: 65649 - protein, 37 aa, Zea mays; identical to SEQ ID NO: 60895
  misc_feature: Ceres CLONE 1537183

SEQ ID NO: 65650 - DNA, 643 bp, Zea mays
  misc_feature: Ceres CLONE 1537186
  misc_feature (99)..(99): n is a, c, t, g, unknown, or other
  misc_feature (100)..(100): n is a, c, t, g, unknown, or other
  misc_feature (282)..(282): n is a, c, t, g, unknown, or other
  misc_feature (355)..(355): n is a, c, t, g, unknown, or other
  misc_feature (356)..(356): n is a, c, t, g, unknown, or other
  misc_feature (388)..(388): n is a, c, t, g, unknown, or other
  misc_feature (389)..(389): n is a, c, t, g, unknown, or other
  misc_feature (399)..(399): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (429)..(429): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (513)..(513): n is a, c, t, g, unknown, or other
  misc_feature (520)..(520): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (595)..(595): n is a, c, t, g, unknown, or other
  misc_feature (628)..(628): n is a, c, t, g, unknown, or other
caagctggagctccccgcggtggcggccgctctagaactagtggatcccccgggctgcaggaattcgtctcacccctagaaaaagagaattgttgaacnngcgccgcgcagctcgacattgtggtcaccaacaagctcgccaggctccgcagccaggaggatgagtagtctggtttcttgtcataacggccaactagatcctgccattcccgggctgtaggaaaaactactctggctttgtggcgtggttagtacttagttataccacaaatttttctaacntttttttgggtccccgtaggcgaaatccaaggggggaaaatttccaacgggtatatcttgccggccttatatnnccccccgcacccccacagggtttatctccctnntttgaggggnccacgnnnnnntntnnntctttatggcgcntcaggggggggggttttgtccttttttttttacaaacacccccaaagaggtacaacaggnnnttttggtttttttttttttatntttgcgntaatatggaacaagaagggnnntnnnntccccnnncnnnnnnnataggttaaagaaaagcatacacataatacgngcgatccggggagttgcttttatcgtctggagnctaccctcacccaca

SEQ ID NO: 65651 - DNA, 751 bp, Zea mays
  misc_feature: Ceres CLONE 1537190
gctctagaactagtggatcccccgggctgcaggaattcgtctcacccctgcaaaatctcgctgttctggtgaatcgaggtgcgcgcacgactccactctgtccggcttctctccacttcactgacctgcccagacatggctattcgacatttgcctcctgttcaatactcacatccggccacgacgacgatacccatgccgtccaatgtgcgttctgctgactgtgcgtctggcgctgtgccgactgctcgtccccctccattagccttctggggtgatgcgaatgcgtcggaacagatacattgcacctacagcttcgttgcatgcaattccccctaaactggagactgcttcttcccgatcctgggacggataataacacccccccatctctgaaggtgcctatgagattccagccttaatcaacattgaaccgagtccctctttggccccctttgtcgcccttatagaggaggcccttaccggtggcccctgccccatcgttttacaccctctaatgccggaatagaaccctggacaggctccccaacttttgcgccattgtcggtcatccctctttttcaaatccttggtctttttttttaaccaaggccccctccgattcgccctttcccctctgttggcccaacttgtatagccaattggaaattgaaaggcgttacctttttgtgaaaaaggcgccgttaatttttcggtgaggcacccccacttttatagcccaaaagcccga

SEQ ID NO: 65652 - DNA, 945 bp, Zea mays
  misc_feature: Ceres CLONE 1537196
  misc_feature (1)..(1): n is a, c, t, g, unknown, or other
  misc_feature (2)..(2): n is a, c, t, g, unknown, or other
  misc_feature (18)..(18): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
nnttttgtaatccccccncnactccnnnnnnnnnnnnnnnnaaaaactggggctccccgcggtggcggccgctctagaactagtggatcccccgggctgcaggaattcgtctcacccctagaaaaagagaagggggagggatccacagttcccacacaccccgcttcccatggcgctagggctgcgctgccctcccgccgccacctgcgtccgggagccccttcctaccgtcgacctccccagcccctgcgggggaaggccccgcaggaggccgccccgccagctggaggtggcgctgcctactacgggcaagggccggattccggcagaggttacggccagtgtgggcggagggggtgccccgcggcggcctccgccgcggcgacccttcgcgtggcctgcgcgcgccgttttttttttcgcgtttccggagggggggggggggggggggtccttcacttttttccctggacttgccgcgccgggagtgctaccctctgttcatctcggcctccgattcctctcgcttgcggtgttcccgggtcccgacggggccccccctcgtgggcgccggggcgctgcgcgtcgcccacgccggccgcggtcttgtcggcgctctgcttgtctgctctcctccagccgccgcgtccgttccgcgtcctccgcgcgatgctagtcgtcgactccccgaggtgtccgtcctcgacttgcgggttccagcatctactgcccggcttctgttcgcgggcgccgcggcgcgccgtcctccgtcttgttctccgtcgcggcgctccgccgtcccgctcggtctacggctggaccgccgtcacggtggggttgtgtggtctcttacccgctcttccttctcgttacctaggcagcgctcgccgcctggttgtcatcgctctacttatgtcccccggcgccgttagctgccggacgggg

SEQ ID NO: 65653 - DNA, 728 bp, Zea mays
  misc_feature: Ceres CLONE 1537198
  misc_feature: Translation starting site: 161
  misc_feature: Pfam Name: ATP-synt_Eps Pfam Description: Mitochondrial ATP synthase epsilon chain
  misc_feature: SWISSPROT Homolog: EC 3.2.1.23 Beta-galactosidase
  misc_feature (132)..(132): n is a, c, t, g, unknown, or other
  misc_feature (331)..(331): n is a, c, t, g, unknown, or other
  misc_feature (335)..(335): n is a, c, t, g, unknown, or other
  misc_feature (340)..(340): n is a, c, t, g, unknown, or other
  misc_feature (343)..(343): n is a, c, t, g, unknown, or other
  misc_feature (349)..(349): n is a, c, t, g, unknown, or other
  misc_feature (350)..(350): n is a, c, t, g, unknown, or other
aaagctggagctccccgcggtggcggccgctcttgaactagtggatcccccgggctgcaggaattcgtctcacccctagaaaaaattcacattcggtcattctccaccgtccaaccaaccaccggcggcggnacaagggaagcgaaaaggaatcaacgctatgtctgccaccacggcggcggtgcccttctggcgggcggccggcatgacctacatctgctactccaacatctgcgctgcgctggtacggaactgcctcaaggagcccttcaagtccgaggccgcgtcccgcgagaaggtccatttctccatctccaagtggacggatggnaaanagganaancccacnnccctcaccccccccccccccccaagctctggtgccatagtggcatagtccttgctacagatgatttgaagtgttgttgcaagtttccggaacatgctatttagctggcttgattttatagtcaatgctgaataataaatactttttacgacaaaaaaaaaaaaaaaaccgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaaaagcgaagaggcccgcaccgatcgcccttcccaacagttgcgcagcctgaatggctaatg

SEQ ID NO: 65654 - DNA, 930 bp, Zea mays
  misc_feature: Ceres CLONE 1537199
  misc_feature: Encodes the peptide sequence at SEQ ID NO. 65655
  misc_feature (12)..(12): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (743)..(743): n is a, c, t, g, unknown, or other
  misc_feature (930)..(930): n is a, c, t, g, unknown, or other
ccccttatttanaccgccagaaccaccnnncnnnnnnnnnnnaaaaactggagctccccgcggtggcggccgctctagaactagtggatcccccgggctgcaggaattcgtctcacccctagaaaaaaaccctaagtctcggaccccaaccctcgaggaaggcgaccggagatggcggcgtcgtctgcggtggagaagctcacggtcctctgggactcgcaggtcaacgacgaggagcagtgggcgctcaattataagctgctgaaggctgctggtctgtttgcgggatccatcttcctgatgcggaacttcagtgatgtgatggccatttagtaggctctatcaccgtttgtttactcgcatcctgtgagtgttcgttaaggatgttacccatgtgtcctcgcttcgcaatttgaaggctatttttgctccacagacaggaataattccttttcgcctgattgccgctccacccccttagtacttcttttgcctgtaaatcattaagactctttttaatgcttcgggtcgccttcacgtaggctagtttttctgtgaactcaatgtttaataagtgctgctccctccatcatataagagccccttgactcacgtcctcttcaactgtcttctctccacctatgactactcgtgctctcctcttgttgttaacacttaatgctaacatctgtattcttcctgagagcgcctgctccgggtgctcacgattcatcgtgtgctcntgattggcatgagcgtctccattcctcgtatgctgcgcctctccggtcgggtctccctcgggtatggttagaggtatactagtacccagacttttcctgtttgcatgctattgccttttacatgtgtctcatttgccacgcagttcgcacctattctctcgtcgtatagtcgctccactacattctn

SEQ ID NO: 65655 - protein, 53 aa, Zea mays
  misc_feature: Ceres CLONE 1537199
MAASSAVEKLTVLWDSQVNDEEQWALNYKLLKAAGLFAGSIFLMRNFSDVMAI

SEQ ID NO: 65656 - DNA, 733 bp, Zea mays
  misc_feature: Ceres CLONE 1537200
  misc_feature: Encodes the peptide sequence at SEQ ID NO. 65657
tctgaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatggctctgtatctgcgtctgttcctatgccccaatccgacttgtgctgtattgagttgcttgaattcagccttgtttttgctacctgaccccccccctggatcgtctggtcccgtcgactgcatagtcatggcgatcccaagtttctgagattcgattcaaaagaaatgacaaactctatacgctctcaagcacccgattcccccccttaacgggaggcttctttacgtcccggtacgcggggcctgccggtttttaagtctccgcttactcggtaaaacccttgggtcattccgtgcgttaaatccccctttacctgattgtcctccccctttctcccctgctttgggcttaaatgcttcagtaggctctcggccccctgattcgc

SEQ ID NO: 65657 - protein, 58 aa, Zea mays; identical to SEQ ID NO: 46528
  misc_feature: Ceres CLONE 1537200
  misc_feature (6)..(56): Pfam Name: UPF0057 Pfam Description: Uncharacterized protein family UPF0057

SEQ ID NO: 65658 - DNA, 800 bp, Zea mays
  misc_feature: Ceres CLONE 1537202
  misc_feature: Encodes the peptide sequence at SEQ ID NO. 65659
  misc_feature (369)..(369): n is a, c, t, g, unknown, or other
  misc_feature (800)..(800): n is a, c, t, g, unknown, or other
tctagaactcgtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccaaaagcctcggcaacgtcagcaacggcggaaggatccgttttttccccgtgtgaggggcctacctccacaagaatttctatacgctgtcgaaccagaccgcccctgttcgatttttttccccccccccccagggacaagcacggggggcttcattncttttaataccccctttccccccccctctttcaagatatacattaccttgcaccttccagggacggcgcggggccacgttccttacttcctgcacgccctttctctgtggcacaatccggtaaagcgtccctactagttcggttccggattacatgcacctctatcattcatgttattaacaagagtaattagcaaacgtgaatatatgctctgctgccccgtccttgagcatacccccgcatcctatgagcctgtgatctatcgtgtatctcaccctctgccctcggcctcttccctcctcatcctcattgtgtcctaccctttattgtccaccgcttaccaactccgcatcgaccacacaccatcggattctattctgtttgatatattcgatagtcttaccgtaatccgatcctcacttgagagtcan

SEQ ID NO: 65659 - protein, 50 aa, Zea mays
  misc_feature: Ceres CLONE 1537202
  misc_feature: SWISSPROT Homolog: EC 4.1.1.39 Ribulose-bisphosphate carboxylase
MAPTVMMASSATAVAPFQGLKSTASLPVARRSSKSLGNVSNGGRIRFFPV

SEQ ID NO: 65660 - DNA, 719 bp, Zea mays
  misc_feature: Ceres CLONE 1537204
  misc_feature (445)..(445): n is a, c, t, g, unknown, or other
  misc_feature (457)..(457): n is a, c, t, g, unknown, or other
  misc_feature (540)..(540): n is a, c, t, g, unknown, or other
  misc_feature (561)..(561): n is a, c, t, g, unknown, or other
  misc_feature (562)..(562): n is a, c, t, g, unknown, or other
  misc_feature (604)..(604): n is a, c, t, g, unknown, or other
  misc_feature (615)..(615): n is a, c, t, g, unknown, or other
  misc_feature (639)..(639): n is a, c, t, g, unknown, or other
  misc_feature (640)..(640): n is a, c, t, g, unknown, or other
  misc_feature (655)..(655): n is a, c, t, g, unknown, or other
  misc_feature (656)..(656): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (719)..(719): n is a, c, t, g, unknown, or other
acccgcggtggcggccgctctagaactagtggatcccccgggctgcaggaattcgtctcacccctagaaaaaccctccctcccctccagcgctccagctcccctccatcctcggccaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgcccgcgaaacttttctcccccccccaggggggggggggggggtcgggccgggagggacgagcctggacatggccaaggaggtcaggcccgagttccccctgcccctcctggctcnaggaccccccanttcggatcccctccgcgcgcaccctggaggagggagcaccccgtccccaaccccaagcccccggcccgcccctgcctcctccnagccgcggttccgaggcggannggttcacccctttttttttccgcccgccggtgcgcgggtttngtggaatgccncgccccgccgcgcctagcatcccnnactctccagcgtganncagtggcgtttcctctttgtgagannnnagtgtcccgcgggaaagccccactctcgcacctcn

SEQ ID NO: 65661 - DNA, 654 bp, Zea mays
  misc_feature: Ceres CLONE 1537205
  misc_feature (93)..(93): n is a, c, t, g, unknown, or other
  misc_feature (353)..(353): n is a, c, t, g, unknown, or other
aaagctggagctccccgcggtggcggccgctctagaactagtggatcccccgggctgcaggaattcgtctcacccctagaaaaaacggttccntcctcctccctctatttccctgtccagactggtggccacagcagggcacgccggcgacgcgcacccgccggcgaccaggtttcccggcgccgccccttgtctagttctcagcttctcctcgcggcgccccttactggcttcctcttcttcccagacgggtggcgcgtcaagactccccacccggctgtccggcgaggacctcggcttcctcgccccctccgccgctaaagagccgccatccagccgcccagcccccgggnccccaacgcccccagcttaacttggggccccttttcctaaattggaacccggatttccgccccttgggtttaactttgaacctaaatttggcctctttcccccttggaagggggggggaaaccccaaacgcccctaaaaaattttttggggcctacctaaaaaaaaaaccctaaaagttcccccccttgggttaacctaattttttaaaacccccccccgggagtgaaactttttgaaaatttttttttggggagagaaggggggcccccaaaagaggacccccccggaatttttttaaaa

SEQ ID NO: 65662 - DNA, 748 bp, Zea mays
  misc_feature: Ceres CLONE 1537209
aaagctggagctccccgcggtggcggccgctctagaactagtggatcccccgggctgcaggaattcgtctcacccctagaaaaatgatcttgctcgccagcacaacctgccccctgtgctgctcccacgacgacgcaatggggggtatgcgtctcggactcttaagaccggtgcctatttctacattttccaactgaacttcgggataacgaaggatgatatcacagacttgttgtccgagataagggtgattaaccgttattcaatcatgtacgatcgaccctaatacgtctttgttagccgattatactctgcatttacatcgctgtcacgatgcttatctgctagtaaagaaatatgacatggtccttgctgctgcctactctctgaagatgccgctatatggtaccgatactcctcctgacctctgatgctcttgcctactgcactggacttctgctagctactcgctgtgatgaatgatcgaggtgttgcatgccccatatgaatgccatgtcgaagcacctcatcaaagacttcgtcaggcgaaccgctgatcagaggaggcccttccgtgctctcgtgcatgtcaggcatatccagactacaaactggaacctgatctgtagtaccctcatgctgactctatacggacgactgaatgttctcacaacttgatatgttcgccggattcagaaagatgaccccttccttacgctgatcccgctactaggactctgtgacagca

SEQ ID NO: 65663 - DNA, 760 bp, Zea mays
  misc_feature: Ceres CLONE 1537211
  misc_feature: Encodes the peptide sequence at SEQ ID NO. 65664
  misc_feature (165)..(165): n is a, c, t, g, unknown, or other
ttttgttttgtttgcttctgtttgtgcgcccccctcttccctacctcctcattctggggctccccgcggtggcggccgctctatactagtggatctcccgggctgcaggaattcgtctcacccctagaaaaagcacgagacccgtccttgaggggcacgtcctanattggtgtcgcctgcctctcgccgccgatacggtgcctctcgcggtctcgctccccctcgcaggtcttttggtttttttagttcctccctttgcttcttggaggtgtttgttgccgtctcaccctcagttcttgagacttgcagagccagatagtgtgccacgggtgcaggacccttctgttctacccaagaggtgctccgagcgtgtgttgtgcggtatgccatgtggtccccaatgtgccgccttcagcaatggagatggctcgacttatatgtggtggctgccagacattattgatgcatgctcgcagtgccacaactgtaaaatgctcttgttgtgacacagttccatcctgtccgacctgtgagtagcctagcctcatgttgaactgaggcccagtggcccacagtggttgaatgtttccataccggaaccaccctcctggtcaatttgtgctggtttggcaaccttctctttacaaatggttgggccggggttggaactcccccatggattacccttttggcccccccccccactgccccttaacctttcctatcccacgtgggcaaccctttcctttattatctattg

SEQ ID NO: 65664 - protein, 39 aa, Zea mays
  misc_feature: Ceres CLONE 1537211
  misc_feature (8)..(32): Pfam Name: zf-LSD1 Pfam Description: LSD1 zinc finger
MEMARLICGGCQTLLMHARSATTVKCSCCDTVPSCPTCE

SEQ ID NO: 65665 - DNA, 804 bp, Zea mays
  misc_feature: Ceres CLONE 1537217
  misc_feature: Translation starting site: 223
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
tttacactctttccccatgccctatagnnggagggaannnncaaaagtggggctccccgcggtgggggccgctctagaatagtggatcccccgggctgcaggaattcgtctcacccctagaaaaaaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggggggcgccatcgcccccgaaatcttcggcaagatgggcatcatcccccccggagaccgccctgccgtggttcaagaccgggcgtccatccccgccgcggggcacctacaaactactggggccggacttcctacaccgcttcttccgtcctccaaaatggggggcctcaattgggctttccgccagaacaactccccggcctcccgagggactggggtaccaaccccgggggctcccactggtgccaaagcatgttaactttccctc

SEQ ID NO: 65666 - DNA, 744 bp, Zea mays
  misc_feature: Ceres CLONE 1537229
  misc_feature: Translation starting site: 167
  misc_feature (616)..(616): n is a, c, t, g, unknown, or other
  misc_feature (744)..(744): n is a, c, t, g, unknown, or other
ggagctccccgcggtggcggccgctctagaactagtggatcccccgggctgcaggaattcgtctcacccctagaaaaactgccactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagtgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgcccctcaccgctgagaacttcctcgcaaggcggcttcaaacacttgtcttcaaggctggcatggccaagtccattcaccatgctcgtgtcttgatcaagcagcgtcacatcaggggtggcaggcaaattgtcaacgtcccatcattcatggngagggtggagtctgagaagcacattgacttttcactgtcaagcccattcggggggaggccccccaggaaaggtgaaagagaaagattcaaaaaaaagcgacgcggtgggcggcgatgcttgccaatan

SEQ ID NO: 65667 - DNA, 651 bp, Zea mays
  misc_feature: Ceres CLONE 1537239
aaagctggagctccccgcggtggcggccgctctagaactagtggatcccccgggctgcaggaattcgtctcacccctagaaaaagcaagagtcaattggagaggagtgcttctctgtccaacctctcagctcagaatgtgcatccaaagaaacctctttcttctcatgccgatacatatatgcccttggttttcttcttcttgtatctctctctctctctctctctctctctctctctctctctctctctctgtgtgtgtgtgtgtgtgtgtgtgtgtgtgtgtaaaactgtgctcctacacaattctctggatctccaaaatctgaccagattggatgtgcgattcccgtttcttttcatgtctcccctgtcgagacgtcgtcggtgccagtaaacggaaataaacctttcccggcatatattagcagctagccttcctcttccacggttccacccacgtcctcctccatatatataaaaagtcccacaccctcctccactccacctccaagggcgtgattgcagtagagcatctccttttctttatgtgctatatatatgcatgttctgatcttcaagcagctcggccgatcaaacccatagcatcgccaccaaattaaaggtcttctctagatcattacatacacata

SEQ ID NO: 65668 - DNA, 732 bp, Zea mays
  misc_feature: Ceres CLONE 1537244
  misc_feature: Encodes the peptide sequence at SEQ ID NO. 65669
  misc_feature (577)..(577): n is a, c, t, g, unknown, or other
  misc_feature (578)..(578): n is a, c, t, g, unknown, or other
  misc_feature (619)..(619): n is a, c, t, g, unknown, or other
  misc_feature (648)..(648): n is a, c, t, g, unknown, or other
  misc_feature (653)..(653): n is a, c, t, g, unknown, or other
  misc_feature (654)..(654): n is a, c, t, g, unknown, or other
  misc_feature (687)..(687): n is a, c, t, g, unknown, or other
aaagctggagctccccgcggtggcggccgctctagaactagtggatcccccgggctgcaggaattcgtctcacccctagaaaaagcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaagganngatgtgatctgtgccttgaccgtatcccgcagcttgctgancactgcacccggcctcagggcttcctggntctcnnatgcgttggtggtggcaccggctctggcctggnttctctcctccttgagcgcctgtctgtggagtacggcaagaaatc

SEQ ID NO: 65669 - protein, 164 aa, Zea mays
  misc_feature: Ceres CLONE 1537244
  misc_feature (49)..(164): Pfam Name: Tubulin Pfam Description: Tubulin/FtsZ family, GTPase domain
  misc_feature (113)..(113): Xaa is any aa, unknown, or other
  misc_feature (114)..(114): Xaa is any aa, unknown, or other
  misc_feature (127)..(127): Xaa is any aa, unknown, or other
  misc_feature (137)..(137): Xaa is any aa, unknown, or other
  misc_feature (139)..(139): Xaa is any aa, unknown, or other
  misc_feature (150)..(150): Xaa is any aa, unknown, or other
MRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKXXCDLCLDRIPQLAXHCTRPQGFLXLXCVGGGTGSGLXSLLLERLSVEYGKK

SEQ ID NO: 65670 - DNA, 706 bp, Zea mays
  misc_feature: Ceres CLONE 1537245
  misc_feature: Encodes the peptide sequence at SEQ ID NO. 65671
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (16)..(16): n is a, c, t, g, unknown, or other
  misc_feature (44)..(44): n is a, c, t, g, unknown, or other
nnnnnntttacaattnttcccaaatacacttaataccaattttngcgcatgaaatcatagtgagactccacgcggtggcggccgctctacaatagtggatcccccgggctgcaggaattcgtctcacccctagaaaaaaagtgggtggttcatccccctcacactcacacgcgattctcgactcccctccacccatacgtaacacgttctcctcccacgcccccactaaaacagatgccttcggccttcgtgcgccacaacggaaaacccactactcgcgagcaagtgcaagcaccgttgcccatccatcgttcatgatcccagcctgcctccgcggcctctgcacctgctttgacgtggacgacgacaaggctaacaaccacgaccaagagccgacgatggccgacgccgccgccgctacagtcggcagcgccgacgacgaccagacggcaagcaccatcatcacccaccgcaccgtggagctgagcaccggcgtgcgcctgcacttggcggaagccggcgcggcggcggcaacagcaacagagaagctcgcccgcggtgctgactgcatgccagcttccccggagctcgtggtacaacctggggcccaccagaatgcgtggcgcctggcccgcagtacgggttacccaacccccaggagcaccgagaacttgcgcctatagtaacaaggaagtcttcacaaaac

SEQ ID NO: 65671 - protein, 122 aa, Zea mays
  misc_feature: Ceres CLONE 1537245
MIPACLRGLCTCFDVDDDKANNHDQEPTMADAAAATVGSADDDQTASTIITHRTVELSTGVRLHLAEAGAAAATATEKLARGADCMPASPELVVQPGAHQNAWRLARSTGYPTPRSTENLRL

SEQ ID NO: 65672 - DNA, 772 bp, Zea mays
  misc_feature: Ceres CLONE 1537246
  misc_feature: Encodes the peptide sequence at SEQ ID NO. 65673
  misc_feature (1)..(1): n is a, c, t, g, unknown, or other
  misc_feature (2)..(2): n is a, c, t, g, unknown, or other
nntttaatatacttatataaaaacaaaccagccaagccccggtgcccaaccccccattggtggtcccccgtgtggcggctgctctataactgtggatcccccgggctgcaggaattcgtctcacccctagaaaaaggccgccgctttcctttccctcgatccacagctcgcgccgttcctgcaagtgcgcacccatcgtcccgcctacacactgacgcccaacgatctacgagctgccatggctaaactcagcggcaccgggaggaatgaggtcgttcctgcaggccgtgtctacggtcaccgaggaggcgccgacgccactccgcgtcctccaaatggagggcctggctgcactgaagatcatcaagcactgtgaggagtttgtgctacctttaaatacaggtcaaattgcccggctcgaatgtcggcaatggtctggaagtgcacccatatgtttttcctttccttattccgccatcaagatgcacgaaccacaaagcaaatggtgcctaattaacaccctttacaaaaatgaaggctggttccacggaaaatttaaaaggttcaaaacctacacctattagaacgggaaacccgctcaagcccccgcctggacaaaatacctaaaccggcggcaaatcgaaacgcaaaacatttcatgcaaccttagccaggtaaagaacatattaccgaataatacacccggcgccggacttggagcaaatcacacacccctattgtaaacaccttttttctcacgggttttggtttt

SEQ ID NO: 65673 - protein, 105 aa, Zea mays
  misc_feature: Ceres CLONE 1537246
MRSFLQAVSTVTEEAPTPLRVLQMEGLAALKIIKHCEEFVLPLNTGQIARLECRQWSGSAPICFSFPYSAIKMHEPQSKWCLINTLYKNEGWFHGKFKRFKTYTY

SEQ ID NO: 65674 - DNA, 758 bp, Zea mays
  misc_feature: Ceres CLONE 1537248
  misc_feature: Encodes the peptide sequence at SEQ ID NO. 65675
  misc_feature (9)..(9): n is a, c, t, g, unknown, or other
  misc_feature (37)..(37): n is a, c, t, g, unknown, or other
  misc_feature (470)..(470): n is a, c, t, g, unknown, or other
aattataantatctttttttttttctaccgaagaaanaaaataaaaaaaaaaaaactggagctccccgcggtggcggccgctctagaactagtggatcccccgggctgcaggaattcgtctcacccctagaaaaaagaagcgccacttgcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagatgacatacaagaggtggggaagaaaggggatacaatgaaggtgcgagctggattctaccgcaactccttgcttcccaagggcaaggctgcgcttctaaccccagcagtccacaagcaaaatacaatagtggcatctggnaaatgaaaatccaccttttatgccggcaatcatgactcctggtggggccgcttgatctccgcaactgtacctacggggaaaaccgaaaaatccttcatttggcccaaataattaaactcccaagggtgggcccaacggtgggaaatccaagttttgtaaacccttggttgcccctcccaataaaaaaggctgaaattttcggaaaataacttataacctgcccccggggggggaaatcccctttttcccaatttttatagaaatttataaaaatggccggggcccggg

SEQ ID NO: 65675 - protein, 100 aa, Zea mays
  misc_feature: Ceres CLONE 1537248
  misc_feature (47)..(94): Pfam Name: Ribosomal_L9_N Pfam Description: Ribosomal protein L9, N-terminal domain
MASLSCASTLPWTPASYPRPSAGRCLTASRRAPSLVIVAQGKVKKYRQVILTDDIQEVGKKGDTMKVRAGFYRNSLLPKGKAALLTPAVHKQNTIVASGK

SEQ ID NO: 65676 - DNA, 735 bp, Zea mays
  misc_feature: Ceres CLONE 1537254
  misc_feature: Encodes the peptide sequence at SEQ ID NO. 65677
  misc_feature (1)..(1): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (55)..(55): n is a, c, t, g, unknown, or other
  misc_feature (57)..(57): n is a, c, t, g, unknown, or other
ntttatttttttttgctttttagagattacatacnaanncccnnngggcaacaananggacactggagctcaccgcggtggcggccgctctttactagtggatcccccgggctgcaggaattcgtctcacccctagaaaaagaccgccgcaaccacgcgctacgcccccgatggctcacctccagctcctcttctcatactcgcggcggaacccgcagcgccaccgcctgctctcactcttccacttctcctccgacgccaagtccagctccgcctcgccgccgcctcctcccatcaagcccgtctcctacgctccgaagccgcagcagcaggccccgcccgaggagtctgccgccccgacaaccccggacgttgcccctagggaccaatccccactgccacgacggcctcagcagccgatgccgccgccggagtggacgcggcaggatatgcggtacgtgaaggacgcggcccccgcgatctcgcccgtctcgtacccgtccagggtcgcgccgctgccggaagaccgtccggtcggccgccaacgtggaagaagtgcagggaggggggggctgcaggggggaatccggagccggatcccgaatgaaccgccggtggcgttccccccccgggaggcggtcctttgggggaacggcaccgagggaagggaaaagggtctggcccggtaacccgcgaaacggcttcaattcaccccggtgccgttctaaaaggtgg

SEQ ID NO: 65677 - protein, 172 aa, Zea mays
  misc_feature: Ceres CLONE 1537254
MAHLQLLFSYSRRNPQRHRLLSLFHFSSDAKSSSASPPPPPIKPVSYAPKPQQQAPPEESAAPTTPDVAPRDQSPLPRRPQQPMPPPEWTRQDMRYVKDAAPAISPVSYPSRVAPLPEDRPVGRQRGRSAGRGGLQGGIRSRIPNEPPVAFPPREAVLWGNGTEGREKGLAR

SEQ ID NO: 65678 - DNA, 739 bp, Zea mays
  misc_feature: Ceres CLONE 1537260
  misc_feature: SWISSPROT Homolog: EC 3.2.1.23 Beta-galactosidase
  misc_feature (13)..(13): n is a, c, t, g, unknown, or other
  misc_feature (15)..(15): n is a, c, t, g, unknown, or other
  misc_feature (31)..(31): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (739)..(739): n is a, c, t, g, unknown, or other
tttttgttttgtntnacgaattatacttttngatanannnagaaacgagaacacaaaactggcgctcaccgcggtggcggccgctctagaactagtggatcccccgggctgcaggaattcgtctcacccctagaaaaactttcatgcaattgcatagttgatgttttacttctgttgccaccaagagttgaacggtgtacttgcagattgataatatctccgtgcttcctttctagtttgcgttgttactcatctttccatgaaaattgagtgataaaaaaaaaagtcataaagaacaagcataaacaaaaacgagacgctcgaggtacccaattccccctatagtgagtcgcattacccgcgctcactggccgtcgttttacatcgtcgtgactgggaaaaccctggcgttacccaatttaatcgccttgcagcacatccccctttccccagctggcgtaataccgaagaggcccgcaccgatcgcccttcccaccagttgtcccccctgaatggctaatggaaattgtaagcgttaatattttgttaaaaactcccgtaaaatttcttgttaatccagccccatttgtttaaccaaatacgccaaaattcggccaaaatcccctttattaatcaataaaaattaaaacccaagcatagaagcttgaatatgtttgctccccacgttttgggcaaaccaagaactccccctcttttcacaccgaacccgttgcgcacn

SEQ ID NO: 65679 - DNA, 734 bp, Zea mays
  misc_feature: Ceres CLONE 1537263
  misc_feature: Encodes the peptide sequence at SEQ ID NO. 65680
  misc_feature (521)..(521): n is a, c, t, g, unknown, or other
  misc_feature (643)..(643): n is a, c, t, g, unknown, or other
  misc_feature (664)..(664): n is a, c, t, g, unknown, or other
  misc_feature (665)..(665): n is a, c, t, g, unknown, or other
  misc_feature (682)..(682): n is a, c, t, g, unknown, or other
  misc_feature (697)..(697): n is a, c, t, g, unknown, or other
  misc_feature (699)..(699): n is a, c, t, g, unknown, or other
  misc_feature (700)..(700): n is a, c, t, g, unknown, or other
  misc_feature (706)..(706): n is a, c, t, g, unknown, or other
aagctggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgctacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaagggggaggtcgaggtagagattgaggccaagtttgttgagaaggaagaggtcacaggctcgggtgacggtgcgggaggaaagggtaccaagaagaaggatacaaaggagaaagacaaganaaagaaggaaggtggtgacgattcagggaaggcagaggaagaacataagggtaaagcgaaggattcggagggcaagggccaagtgaagaaggaaaagaaggatggtgctggggacgacggangcgaagagaaggggcaagaannagaagatagaaggacangggtgagaagaatgncnnggagangaaagagaagaagaaagacagggcgccc

SEQ ID NO: 65680 - protein, 147 aa, Zea mays
  misc_feature: Ceres CLONE 1537263
  misc_feature (77)..(77): Xaa is any aa, unknown, or other
  misc_feature (118)..(118): Xaa is any aa, unknown, or other
  misc_feature (125)..(125): Xaa is any aa, unknown, or other
  misc_feature (131)..(131): Xaa is any aa, unknown, or other
  misc_feature (136)..(136): Xaa is any aa, unknown, or other
  misc_feature (137)..(137): Xaa is any aa, unknown, or other
  misc_feature (139)..(139): Xaa is any aa, unknown, or other
MGKDRESAKLKEEKGSKDEIHMKVKSKGEPSGEEDGKGEVEVEIEAKFVEKEEVTGSGDGAGGKGTKKKDTKEKDKXKKEGGDDSGKAEEEHKGKAKDSEGKGQVKKEKKDGAGDDGXEEKGQEXEDRRTXVRRMXXRXKRRRKTGR

SEQ ID NO: 65681 - DNA, 683 bp, Zea mays
  misc_feature: Ceres CLONE 1537264
  misc_feature: Encodes the peptide sequence at SEQ ID NO. 65682
  misc_feature (538)..(538): n is a, c, t, g, unknown, or other
  misc_feature (539)..(539): n is a, c, t, g, unknown, or other
  misc_feature (617)..(617): n is a, c, t, g, unknown, or other
aaagctggagctccccgcggtggcggccgctctagaactagtggatcccccgggctgcaggaattcgtctcacccctagaaaaaatctccacaacgacgaaccttcatggcggtgccggcctccgcctccgcgtgcgcgcgcgccggcccgccgcagccccgccaccgcgcgcgtagtgccgccgcgaccgcggcggcgttcttgctccgccgccaccagcgaccgccacggcagataataaacatcgtcgacgaccgccgtgccagctccgatctccgctgccggcgacggctcctcacggcgcgaggcgagcgcccgtcccacgacgacgacgaggacgaggagcagacgtcgtctgctggtggtggttacggctcgttcggcgcggcggtggcgctgttcaaccgcggcgagtaccacgcgtgccacgacgtggtggaggagctgtggtacagcgccgaggaccccgcccggacgctcctccacggcctcctccagtgcgcccgtcggcttcacccacctcttcaacagaaccanncgcgcgcgatgattgagctcggcgaagggctctgcaagctccgtaagctgcagctagacggcgaaggcgaccgccacngcgacggggggcggccctttctcccgggttccggaacgagtccccccctgggcttgcattcctctc

SEQ ID NO: 65682 - protein, 192 aa, Zea mays
  misc_feature: Ceres CLONE 1537264
  misc_feature (144)..(144): Xaa is any aa, unknown, or other
  misc_feature (145)..(145): Xaa is any aa, unknown, or other
  misc_feature (171)..(171): Xaa is any aa, unknown, or other
MAVPASASACARAGPPQPRHRARSAAATAAAFLLRRHQRPPRQIINIVDDRRASSDLRCRRRLLTARGERPSHDDDEDEEQTSSAGGGYGSFGAAVALFNRGEYHACHDVVEELWYSAEDPARTLLHGLLQCARRLHPPLQQNXXRAMIELGEGLCKLRKLQLDGEGDRHXDGGRPFLPGSGTSPPLGLHSS

SEQ ID NO: 65683 - DNA, 731 bp, Zea mays
  misc_feature: Ceres CLONE 1537265
  misc_feature: Encodes the peptide sequence at SEQ ID NO. 65684
aaaactggagctccccgcggtggcggccgctctaaactagtggatcccccgggctgcaagaattcgtctcacccctagaaaaagccggcctctttctctttctcgtttctgccccctctgcttgcccccctttcatctcaggcgtcgaagagagagagagagagagagaggagttgccagttggtgagatggatctgttggagcggaatattaagacggagacggaggagacgcgcaaggaacatgagcgtaaggaggaggaggcggatgcggatgccgacgccgtggacaggaagacccaggacccgccccagctaggcctgggtccttcagcctctcactccaccaacgggagtgggcatgtttttcccacgcccccagaggaggggggggagggcggcttaatcccttcccaaacttcaacaattccccccctgggagggaatccagtatgcggggtgtatgaactccaggggccccccggggaaaaagggctccaagccaaatccttggccttatctgcctgcccccctgccatgcgtccaccgggcagacttccccaaaaagttaggggcctggccccttaccttggcatctttgctggaagaaaacccgggaagaatcccacccgggatggtaagccttaagcactaacctcaacaatgccacaagtcccaaagcctaaacctcccccagtatgcctaggagggacactacagcttggaggggtt

SEQ ID NO: 65684 - protein, 152 aa, Zea mays
  misc_feature: Ceres CLONE 1537265
MDLLERNIKTETEETRKEHERKEEEADADADAVDRKTQDPPQLGLGPSASHSTNGSGHVFPTPPEEGGEGGLIPSQTSTIPPLGGNPVCGVYELQGPPGEKGLQAKSLALSACPPAMRPPGRLPQKVRGLAPYLGIFAGRKPGKNPTRDGKP

SEQ ID NO: 65685 - DNA, 668 bp, Zea mays
  misc_feature: Ceres CLONE 1537268
  misc_feature: Encodes the peptide sequence at SEQ ID NO. 65686
  misc_feature (668)..(668): n is a, c, t, g, unknown, or other
ggagctccccgcggtggcggccgctctacaactagtggatcccccgggctgcaagaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaacggtcggaagtgccggagtacctcaccggaaaggtccctggagactatgggtacgacccttttgggccgggcaaaaaagccaaaggacttcccccaagtaccaggccctaccaacctgaacccttggccaaaatgggccttgctccggggccccctgtgggcttttccattcccaaaaagccctggaaacaaagttcgggcccctaaaccggggagcccccgaaaggcttgcctggggtttaaaaaaacggggccccccttttccccctgagaagagggaaaaacaccccccn

SEQ ID NO: 65686 - protein, 148 aa, Zea mays
  misc_feature: Ceres CLONE 1537268
MAALAPSKILGTQLNFAGSSRYATAAPTAGAQKIVSLFSKKPAQKPKPAAVSSSSPDISDELAKWYGPDRRIYLPDGLLERSEVPEYLTGKVPGDYGYDPFGPGKKAKGLPPSTRPYQPEPLAKMGLAPGPPVGFSIPKKPWKQSSGP

SEQ ID NO: 65687 - DNA, 676 bp, Zea mays
  misc_feature: Ceres CLONE 1537274
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (42)..(42): n is a, c, t, g, unknown, or other
ttttttgttttgtgtttttttttttgctctggannnancnanacatcccactaacaaaaaactggaactcacagcggtggcggccgctctattactagtggatcccccgggctgcaggaattcgtctcacccctagaaaaattccattccagtactcgctcatcttgctccgccttctgcttctgcgcatcctccaaggatcgtgatggccatggccacgcaagcctccgcggccacgcgccacctggtggccgcatgccgcttccgcctgggcgccgtcatgcgaagccagcggaagctaaagctcacaagctcgcggcttgccgacctttcttccatcctcagcgcagcggggtcccccgacttcccgactcaaaaaccctccctatggtaagtcgggttgaacccaaaagaaagcagcccccaagggggttttcgaggggaacccccgcaatcctgggaaaccccaagcaaagcacggtcccccccgaaaccttcccgaccggcccatcaacaaaaacaagaccttaacaatcaaacaaaagacccccaccgtcgcgaaaggaaggtcccttcccctgccatttaacccctgtggggagggtccccccccccaaacggcattcaaaggatggcttctccacaaaatatggaacccaaccccgcgatcgtgatt

SEQ ID NO: 65688 - DNA, 727 bp, Zea mays
  misc_feature: Ceres CLONE 1537282
  misc_feature: Encodes the peptide sequence at SEQ ID NO. 65689
  misc_feature (670)..(670): n is a, c, t, g, unknown, or other
  misc_feature (693)..(693): n is a, c, t, g, unknown, or other
  misc_feature (694)..(694): n is a, c, t, g, unknown, or other
  misc_feature (702)..(702): n is a, c, t, g, unknown, or other
  misc_feature (709)..(709): n is a, c, t, g, unknown, or other
ccgcggtggcggccgctctagaactagtggatcccccgggctgcaggaattcgtctcacccctagaaaaaaccccttttccctttccatttcgtctcgtcccggctcgttgccggcggatagaaatcttctactgacttctcccgtgtcgtgctctctctctgccggcggatagaaatcttctactggctcgctgcgacgcgtccggcctctcctctcctctcctcacccccccccccccccccccgcgcgggagcgggtggttgcggtggcggctgaggtttagtcgagggacccggccgaccagcggtcgcgcggcggagccgagggcaaggggatggggaaccaggtcgggggccgacggcggcggcggccgccggtggacgagcgctacacgcgcccgcaggggctgtacccgcacccggacatcgacctcaggaagctccgccgcctcatcctcgaggccaagctcgcgccctgccaccctggcgccgacgacgcgcgcgccgacctcgacgagtgccccatctgcttccctgtctaccccagcctcaaccgctccaagtgctgcgccaagggaaatttgcacgagtgcttcctccagatgaagtcgcccacctcgtgcaaaccgacgcagtgtccgtattggcagacgctgaattacgcagtgnagtaccggggcgtgaagacccanngagagaanggcatanagcagcttgagaagcaaa

SEQ ID NO: 65689 - protein, 130 aa, Zea mays
  misc_feature: Ceres CLONE 1537282
  misc_feature (112)..(112): Xaa is any aa, unknown, or other
  misc_feature (119)..(119): Xaa is any aa, unknown, or other
  misc_feature (120)..(120): Xaa is any aa, unknown, or other
  misc_feature (122)..(122): Xaa is any aa, unknown, or other
  misc_feature (125)..(125): Xaa is any aa, unknown, or other
MGNQVGGRRRRRPPVDERYTRPQGLYPHPDIDLRKLRRLILEAKLAPCHPGADDARADLDECPICFPVYPSLNRSKCCAKGNLHECFLQMKSPTSCKPTQCPYWQTLNYAVXYRGVKTXXEXGIXQLEKQ

SEQ ID NO: 65690 - DNA, 742 bp, Zea mays
  misc_feature: Ceres CLONE 1537286
tcttttttgttttgttcgttctggcaacaaattgggggttttttttttttttcaaactggaatccccgcggtggcggccgctctttaatagtggatcccccgggctgcaagtattcgtctcacccctagaaaaaatggatggcttcacgggcgcgcacgcttcttccttctcgtgtcatctccgcttgcgccgcccctagccccaccatcgtcctccccatgaagccgccggttgagccgccccctcttgtgtcgcctccatgtccgcgcagatatgcctcgctcgccaccccgccgtgttcctccccgagacaccgtggccagcctctagcccgcgctcttcctcgtcacggcgatgtcggcttcccggaacccttccggcttgctttcatgccttcgcttcggtttgttcgggcgcaagagaggctacacctttctccatgagtcgaagttgggccggtcgccaaaacctcccgaaagggttcccagggcgctgcagcaatcctacaccaagggccaggcttcgcagtcttacttcctgcacagattgaagtggcgggctaattgttccaaagttttaagcttccaccttcttagccatggggtaaaagagaaagtcacctttttcaaacatttgtgggtttaattgggccattgtcccaactcctgggcaaaagtcgaacccacccaacttgggcccacccctgaattctaacacaaacctttgggagagggcattttg

SEQ ID NO: 65691 - DNA, 737 bp, Zea mays
  misc_feature: Ceres CLONE 1537294
  misc_feature: Encodes the peptide sequence at SEQ ID NO. 65692
tccccgcggtggcggccgctctagaactagtggatcccccgggctgcaggaattcgtctcacccctagaaaaaatcccctctcaaccttatcttggcggcggcgcatgcgcatgcgagcggccgtccagtcgcgcgggcagtagggggcggccgtccgtccaggcgcaggcgagcgaccgtctgtccagcgcaggctagcggccatccgtccagcgaactgcgagcaggcgtccgtccaggcttccatccagacgagcggcagaacttttctacgcacaacacattccaagaaccgaaaatggagagtgaaggagctggtgagcactttgtggaacaagctgatggtagtggccatgctcccgcggacttgggcgaggtccgcttacatgctcagtaacctagcaagccttgtggctgaatggatcaggacatcaacaggcttcaagaaagttcaccttaacatgtgtgctatagctctatatgactatttcaagatgaagctcactggaaaacaagtgaagacccatttgaggacatggcaagaaaatatatgcacaggataaaccgacttatgaagtttatttgctgctttcttgaaccaaaataaactccttgatcactcttggtcctgaacattatgcaaacttttgggggggatccacaattctgaagcttgatttcttaaacaaagcctttgggaaaactaataaggaaatggtcccttgtctctttggaa

SEQ ID NO: 65692 - protein, 73 aa, Zea mays
  misc_feature: Ceres CLONE 1537294
MVVAMLPRTWARSAYMLSNLASLVAEWIRTSTGFKKVHLNMCAIALYDYFKMKLTGKQVKTHLRTWQENICTG

SEQ ID NO: 65693 - DNA, 747 bp, Zea mays
  misc_feature: Ceres CLONE 1537295
  misc_feature: Encodes the peptide sequence at SEQ ID NO. 65694
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (83)..(83): n is a, c, t, g, unknown, or other
  misc_feature (86)..(86): n is a, c, t, g, unknown, or other
  misc_feature (89)..(89): n is a, c, t, g, unknown, or other
  misc_feature (114)..(114): n is a, c, t, g, unknown, or other
gtttgggtgggannnccccnnaaaaaactcnnntnnnnnnnnnggagggtnnnnntaaaagtggagctcaccgcggtggcggncgntcnatacatactgaataccccggggtgnaggtattcctctcacccctagaaaaaccaactcgccgtcgtcttctgcggttctgccgtctacgcctccaatttggcctctctcccttgcaagtttaagcttcatcttcagccatgggtaaggagaagtcccacatcaacattgtggtcattggccacgtcgactctggtaagtcgaccaccaccggtcacctgatttataagcttggaaggattgacaagcgtgtattagacaggtttgagaaagatgctgctgaaatgaacaagcggtcctttcaagaatgcttgggtggtcagaaatgttttatgccccaccgtgagagggggagtgaatattgatattgctcctgtgaaaattaagacacaaccatagtataattgcccagttcattgaaggaccctggtacaacatcgaatttctttcatatatcgtgttgctagtgggtactatcttaaaaatttgaatagtagttgtccaattaataaaacgaatgtccaagaaccgggtgcgatataaaggagtcgggcacataccaaatgaatagaccataataacaaaaagagtaggtaccacactagatggacacctctctattcattgccttgatgttatgttttttcggggctagaaatg

SEQ ID NO: 65694 - protein, 74 aa, Zea mays
  misc_feature: Ceres CLONE 1537295
MGKEKSHINIVVIGHVDSGKSTTTGHLIYKLGRIDKRVLDRFEKDAAEMNKRSFQECLGGQKCFMPHRERGSEY

SEQ ID NO: 65695 - DNA, 702 bp, Zea mays
  misc_feature: Ceres CLONE 1537296
  misc_feature: Encodes the peptide sequence at SEQ ID NO. 65696
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
tgtttgttttgtnnnnnnnnntnnttnnnntntatcgtgcccccccctcaagggggaaacacccaaacaaaactggaactccccgcggtggcggccgctctattctagtggatcccccgggctgcaggaattcgtctcacccctagaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggacaaggaggccgggcgcgccgccgccgccgctgccgagggctcgtgggtgcccgaccccgtcacgggccactaccgcccccccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccatggtgagacgaggtgaggggtcggggttcgtgtggggaacggcgtgttgagccacgcgcgcgtgcgcccgcgctctgtgt

SEQ ID NO: 65696 - protein, 95 aa, Zea mays
  misc_feature: Ceres CLONE 1537296
  misc_feature (1)..(89): Pfam Name: LEA_3 Pfam Description: Late embryogenesis abundant protein
MALSLSGTSARFALASLVPRARAYAASAASGAMRRAAEGAAAGEDKEAGRAAAAAAEGSWVPDPVTGHYRPPNWAAAVDPADLRAAHLARTYARA

SEQ ID NO: 65697 - DNA, 656 bp, Zea mays
  misc_feature: Ceres CLONE 1537300
  misc_feature: Encodes the peptide sequence at SEQ ID NO. 65698
  misc_feature (143)..(143): n is a, c, t, g, unknown, or other
  misc_feature (473)..(473): n is a, c, t, g, unknown, or other
agaagctggagctccaccgcggtggcggccgctctagactagtggatcccccgggctgcaggaattcgtctcacccctagaaaaagctgcctgcggcctgcccctttttttattcccaaaaaaactcccatctcgcggcgganagagagagaggagaggtgcgagctggtaagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgatcccttcagctaatcccacacaggtgaggattttctatggtggatcagtatgtgtgtatgactcggtgccaccagaaaggctcaggcaatcatgcttatagctgcggctgcancaactgcggcagccaccaaaggcagtgctgccactgcttttaatcctcccatgagcacttctggagcagctggacaacctcaggttgttgctgaccctacctcaataagcaggcttcagctgatctcccattgcccggaaggcctctcccaacgcttccttgaaaaacctcctggccaggtcg

SEQ ID NO: 65698 - protein, 95 aa, Zea mays
  misc_feature: Ceres CLONE 1537300
MDRLEERNIKKGEREMEEARKEEERKEEAGDRNTQEPQQGQGLSLSLANGSDSGRSGMLPMSIPSANPTQVRIFYGGSVCVYDSVPPERLRQSCL

SEQ ID NO: 65699 - DNA, 690 bp, Zea mays
  misc_feature: Ceres CLONE 1537303
  misc_feature: Encodes the peptide sequence at SEQ ID NO. 65700
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnnnnnnnnnggggggtggggggagaaaattaaagtaaccnnnnnnccttnnnnccaaaatggagctccccgcggtggcggccgctctacaatagtggatcccccgggctgcaggaattcgtctcacccctagaaaaaatccacaatcgcaattcgcaagcccttccaacggcagccatggcttccatcactctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccgtcgtctgcagcagcgccgcggcggcagccgaggcctcggacgccgcagcgccagtggagaagttccggctcgacaatttggggccccagaaggggtcgcgccggcggcccaagcgtaagggacgcggtattgctgcaggccagggcgcgagctgcgggttcggtatgcgcgggcagaaatcgcgctcggggcccggcgtccggcgcgggttcgagggagggcagatgccgctctaccgccgtctccccaagctacggggcaattgccggcgggaatgcacatttggcctgcccgaagtatgtgcccattccaatttaaaaaaacataagagccgcggggggaattccaaagaa

SEQ ID NO: 65700 - protein, 171 aa, Zea mays
  misc_feature: Ceres CLONE 1537303
  misc_feature (75)..(164): Pfam Name: Ribosomal_L15 Pfam Description: Ribosomal protein L15 amino terminal region
MASITLLSLAPTAIFLHIPAFTSSSVVGPGILAGRWAAPRALPLRALPPRRVTVVCSSAAAAAEASDAAAPVEKFRLDNLGPQKGSRRRPKRKGRGIAAGQGASCGFGMRGQKSRSGPGVRRGFEGGQMPLYRRLPKLRGNCRRECTFGLPEVCAHSNLKKHKSRGGNSKE

SEQ ID NO: 65701 - DNA, 675 bp, Zea mays
  misc_feature: Ceres CLONE 1537309
  misc_feature: Encodes the peptide sequence at SEQ ID NO. 65702
  misc_feature (409)..(409): n is a, c, t, g, unknown, or other
atacgtggagctcaccgcggtggcggccgctctagaactagtggatcccccgggctgcaggaattcgtctcacccctagaaaaaaaaaaaacaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggggagatgagggtgcaagtggaagacaaccggntgctggtgatcaccggcaaaccgcccccgggaggagcgcgaggacccccagtacctgcccttggaacggcgaataggcaaattatggcccaaattcggggtgcccgaaaaacgccaaatgggaaaaggtccccccccttgtgaaaggaacgcgttgcccccggggaacctccaaaaaattccccccccccggagacccaaaaaacccccaaaacctttcgaaattaaaggggccccctaaaaaagtaaaacccttttttcgaaaaa

SEQ ID NO: 65702 - protein, 126 aa, Zea mays
  misc_feature: Ceres CLONE 1537309
  misc_feature (80)..(80): Xaa is any aa, unknown, or other
MDARMFGLETPRVAALHHLLDVPDGDKAGGGATRTYVRDARAMAATPADVKELAGAYAFVVDMPGLSTGEMRVQVEDNRXLVITGKPPPGGARGPPVPALGTANRQIMAQIRGARKTPNGKRSPPL

SEQ ID NO: 65703 - DNA, 702 bp, Zea mays
  misc_feature: Ceres CLONE 1537312
  misc_feature: Encodes the peptide sequence at SEQ ID NO. 65704
  misc_feature (5)..(5): n is a, c, t, g, unknown, or other
  misc_feature (6)..(6): n is a, c, t, g, unknown, or other
  misc_feature (10)..(10): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (23)..(23): n is a, c, t, g, unknown, or other
  misc_feature (49)..(49): n is a, c, t, g, unknown, or other
  misc_feature (55)..(55): n is a, c, t, g, unknown, or other
  misc_feature (57)..(57): n is a, c, t, g, unknown, or other
  misc_feature (59)..(59): n is a, c, t, g, unknown, or other
ccggnngggnnggnngggggganccaaaacaaaactgaagaaggttaangaatcntntntcaatactggagctccccgcggtggcggccgctctatcactagtggatcccccgggctgcaggaattcgtctcacccctagaaaaaatccatccatccacacacacaaacagacaagcatacaacaccgttgccatttagctgttcttgctaggcagttgcgcgcttacattgagccgcagctagctgtctactacggcacaactatctcctgcgcgcgtgctcgatcgatctgaaggccagacctgtgcctgtccaattttgccttgttctacccaccacaccagtagtcgagaaggttccatataagcgcaagcagacagcagcaaaagagctaaggagagtctgagacaaggttcgaacagatggaggatgtggtgaagttcgtctttggagtttccggaaatgtcatcgctctcttcctcttcctttccccagtgcctacgttctggaggatcatcaagaggaagtcgacggaggatttctcgggggtgccgtacagcatgacactcctcaactgcctcttgtccgccttgataaagggctgcccgtttcgtgtcccccaaaccaccatgctgggtgtccaacgaacaaacggcgccggggcccccggcgaatccaaaagccccgggtaccgtgggtga

SEQ ID NO: 65704 - protein, 92 aa, Zea mays
  misc_feature: Ceres CLONE 1537312
  misc_feature (7)..(79): Pfam Name: MtN3_slv Pfam Description: MtN3/saliva family
MEDVVKFVFGVSGNVIALFLFLSPVPTFWRIIKRKSTEDFSGVPYSMTLLNCLLSALIKGCPFRVPQTTMLGVQRTNGAGAPGESKSPGYRG

SEQ ID NO: 65705 - DNA, 689 bp, Zea mays
  misc_feature: Ceres CLONE 1537317
  misc_feature: Encodes the peptide sequence at SEQ ID NO. 65706
  misc_feature (1)..(1): n is a, c, t, g, unknown, or other
  misc_feature (29)..(29): n is a, c, t, g, unknown, or other
  misc_feature (37)..(37): n is a, c, t, g, unknown, or other
nttttttttgttgcatgttttacccacgntgttatancccttcccttcctatttaaaactggaactcaccgcggtggcggccgctctttctcagaggatcccccgggctgcaggaattcgtctcacccctagaaaaacagaacacgcggaaaaccaaaccgagagccgagagcaaaagctcgccacggcacgccaaaatactcctccccctcccctcatcgtcctcctcggctcggccgggctcctctgatcctctcccagtccggcaaaacacacctcccgctctcgcgtcgcgttcctgtcccgtcgtgacaagcacaaacacgtagtagcagcaaaccgaagcgacgcgtgcccgtcccgcgatggccacggcggccgcggccaggcaccaccaccagcaccagcaccagcagcgccggggtgcccagcgggggcggcgccgcgggagcgggatacggtgctcgtcgccggcgcaggagttcgcgtcgctggccgcggtgttccggcggcggctggtggtcggggccaccacggcggcggccgcggcggtgggggccaacttcggcggcgtcaccagcttcctgctgggcctgtcgccggagctcggccgctcgctccgcctcgacgtgctctaccccgtcggcggcttcacgcgctgcctcgactccgaaaatgggttcgaattc

SEQ ID NO: 65706 - protein, 108 aa, Zea mays
  misc_feature: Ceres CLONE 1537317
MATAAAARHHHQHQHQQRRGAQRGRRRGSGIRCSSPAQEFASLAAVFRRRLVVGATTAAAAAVGANFGGVTSFLLGLSPELGRSLRLDVLYPVGGFTRCLDSENGFEF

SEQ ID NO: 65707 - DNA, 635 bp, Zea mays
  misc_feature: Ceres CLONE 1537325
  misc_feature: Encodes the peptide sequence at SEQ ID NO. 65708
ggagctccccgcggtggcggccgctctagaactagtggatcccccgggctgcaggaattcgtctcacccctagaaaaactatcaaaaaaaaaacgccgcttgttctccctccctctctgcctgaccggctaggatcaacggaagcagcaatggtgatggcgtcttctaccgttctgaggagctgcaccgccctgggcgtgcccatcctgctggcgccgtcatcacggtccggccgcctggcgccgttctgctccaacgccaccacctctggccgcgtcaccgtgtccgcggagtgtatgcccggccagacacgccctgcccacctcgacggctcctctcccggggacttcggcttcgatccgctgggcctcgcgaccgtgccagagaacttctagcggttcaaggagtcggaggtgtaccactgccgctgggccatgcttgccgtcctcgggatcctggtgccggaagctctgggtctgcgcaactggatgaaggcgcacgaatgggcggtcgtacccggacggcaggccacgtaattgggcccccggtgccgtgggggacgctgccgaacatcctggagatcgagctcttgtccatccccttttgcggacacggggttacattggaaaaggacc

SEQ ID NO: 65708 - protein, 81 aa, Zea mays
  misc_feature: Ceres CLONE 1537325
MVMASSTVLRSCTALGVPILLAPSSRSGRLAPFCSNATTSGRVTVSAECMPGQTRPAHLDGSSPGDFGFDPLGLATVPENF

SEQ ID NO: 65709 - DNA, 600 bp, Zea mays
  misc_feature: Ceres CLONE 1537329
  misc_feature: Encodes the peptide sequence at SEQ ID NO. 65710
  misc_feature (600)..(600): n is a, c, t, g, unknown, or other
gggctgcaggaattcgtctcacccctagaaaaagacccagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgatggccgctactggaccatgtggaagctgcccatgttcggctgcaccgacgccacccaggtgtacaaaggagctgcaagaggccatcgccgcgtaaccgggacgcctttccaccgcgtccttcggcttcaaaaacttcagggaaaaacaattgcgttatn

SEQ ID NO: 65710 - protein, 161 aa, Zea mays
  misc_feature: Ceres CLONE 1537329
  misc_feature (58)..(150): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKGAARGHRRVTGTPFHRVLRLQKLQGKTIAL

SEQ ID NO: 65711 - DNA, 842 bp, Zea mays
  misc_feature: Ceres CLONE 1537335
  misc_feature: Encodes the peptide sequence at SEQ ID NO. 65712
acagctggagctccccgcggtggcggccgctctagaactagtggatcccccgggctgcaggaattcgtctcacccctagaaaaagagctcgagccccagccaccgcagccatggtcctcacgaaaccctacctctccaactcgctccttccagtcccatccccgccgccgtcgagccctactctcagctccaaccatgcaagccccgttgccgcccctacttgccgtcgcagccgcctccgcatctccgccacatccacgggtgcgccggctccttcgtcggttgccgctgccaccgcgtcgctgagtccagtggacgtgctctcggaggcgctcccttttattcagcgattcaaaggcaagaccccgccgggcgggggggggggtggcgcaaatgaagtccccggaacctgccgggcgtccgtgaacccgggaatctcgtggcggctcttcctgcggcaggccctccgccccgttgactcatatcacgggcggcaggccccggaagaaataaaattcccctgggctgtcttgcaacgttacaacgtctaagccctgcgagttatcgtatgacgggacttcacgtgggacaggggacggccgcccaccacagcaagagacgtacccaagaacgcggcgtctggttcgcgcatatgggtaaaactaattaagcacccgacacctaccgaaatcatcacaatcggcgggagcgggcccgccgccacttgggcgcgctgaggcgaagcacgaagaccaatcacccttatataagtgacataggcccgcggccttcgcgtacgcgcttggcgcgcgtatctgggatcatctgcggcgcggccagtg

SEQ ID NO: 65712 - protein, 146 aa, Zea mays
  misc_feature: Ceres CLONE 1537335
MVLTKPYLSNSLLPVPSPPPSSPTLSSNHASPVAAPTCRRSRLRISATSTGAPAPSSVAAATASLSPVDVLSEALPFIQRFKGKTPPGGGGGGANEVPGTCRASVNPGISWRLFLRQALRPVDSYHGRQAPEEIKFPWAVLQRYNV

SEQ ID NO: 65713 - DNA, 734 bp, Zea mays
  misc_feature: Ceres CLONE 1537337
  misc_feature: Encodes the peptide sequence at SEQ ID NO. 65714
  misc_feature (24)..(24): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
tttttttttatttttctcctttancctccacccnannggggcaaaaaaaaaaaaactgggactccccgcggtggcggccgctctagactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaacaaccgcgagctggaggtgatccactcccgctgggccatgctcggcgcgctcggctgcgtcttccccgaactgctctcccgcaacggcgtccagttcggcgaaggcccgtctgtttcaaggcccggcttcccagatcttcaacggagggcgggcctggaactacctttgggaaaccccccagccctgattccacgctacaaaaacaatcccttcgccccatcctggggcccttggccacaggtccggggactccaatgagggcccgcaccg

SEQ ID NO: 65714 - protein, 170 aa, Zea mays
  misc_feature: Ceres CLONE 1537337
  misc_feature (56)..(160): Pfam Name: Chloroa_b-bind Pfam Description: Chlorophyll A-B binding protein
MAISSTAMAGTPIKVGSFGEGRITMRKTVGKPKVAASGSPWYGPDRVKYLGPFSGEPPSYLTGEFPGDYGWDTAGLSADPETFANNRELEVIHSRWAMLGALGCVFPELLSRNGVQFGEGPSVSRPGFPDLQRRAGLELPLGNPPALIPRYKNNPFAPSWGPWPQVRGLQ

SEQ ID NO: 65715 - DNA, 851 bp, Zea mays
  misc_feature: Ceres CLONE 1537341
  misc_feature (13)..(13): n is a, c, t, g, unknown, or other
  misc_feature (16)..(16): n is a, c, t, g, unknown, or other
  misc_feature (18)..(18): n is a, c, t, g, unknown, or other
  misc_feature (21)..(21): n is a, c, t, g, unknown, or other
gtataaagaagcnttntnttntccaacccgccgaagcaggagataccctcccaactggagctccccgaggtggcggacgatctaaaacaatggatcccccgggctgcaggaattcgtctcacccctagaaaagatcccccgagcttcgctcacaccggtcacctccgcctcctcccgcttcgcgcgcatctccttctatcgctccagcctccagcacacgtcctccatgccctcgcggttctgatccggccacagccatgcaccaccgctcgccggaggcggcttcggcatccgcctcaccgacggccgcggcggtggaggacatggcgcccggcgtcagcggggatgagctcgccgtgacgctcaaccagattctgcgctgggatagacccaggaacagatgatactctctggatgacccctcacccccccccagaaccaaaagaaacccgggcttcaacctttcctttgcccccccccccaaaccgctataaccggcaaaaaaaacccggatcaacgaggagaaaccgggggggcccgcgtggaggaagaaaatacgagtctccccccgtcccacatgaaccgacgtaccccatcttgtacaaaaacctatacactcccgggccccagagggtcccccaccgggtggaaacccctccacagggccatatacccaccgggtgtgccctatctttcaccccccaacctgatttaaatattcgcggaaccaaaaaaccacacctaagcatatatatcggtggtggtcctcccagatacacatatagtcatagtatcacttgaccgtttttatcatccctaaaaagaaacaccgcaccccccacctatagaag

SEQ ID NO: 65716 - DNA, 644 bp, Zea mays
  misc_feature: Ceres CLONE 1537348
  misc_feature: Encodes the peptide sequence at SEQ ID NO. 65717
tggagctccccgcggtggcggccgctctagaactagtggatcccccgggctgcaggaattcgtctcacccctagaaaaagaagcagcaaccagcaaagtgatcagtgtgatcgatcacacactgccatggccgtcatgggcaaggaggaggaggagcagcagcagcagcacaaggaggaggaggtggtccaaggagatgtgcgagtcgtcgtccagcaggagacggcggcggacgaggaggccgagtcggcgctggtgcgcaagatctccggcctggccgccgccatcgccaggctgccgtcgctgagcccgtcgccggaggtgaacgcgctcttcaccgacctcgtcacggcctgcatcccgcgcagcaccgtggacgtggagcgcctgggcccggagctgcagcgcatgcgcgcgggcctcatccgcctctgcgccgacgccgaggcgctgctggaggcgcactactccgacctgctggccgccttcgacaacccgctggaccacctgccgctcttcccctacttcaccaactacctcctgctgagccagctggagcacggcctgctggcgcgccacgtcccgggcccgcccccctcccgcgtcgccttcgtcggctccggcccgctcccgctcagctccct

SEQ ID NO: 65717 - protein, 172 aa, Zea mays
  misc_feature: Ceres CLONE 1537348
  misc_feature (35)..(172): Pfam Name: NAS Pfam Description: Nicotianamine synthase protein
  misc_feature: SWISSPROT Homolog: EC 2.5.1.43 Nicotianamine synthase
MAVMGKEEEEQQQQHKEEEVVQGDVRVVVQQETAADEEAESALVRKISGLAAAIARLPSLSPSPEVNALFTDLVTACIPRSTVDVERLGPELQRMRAGLIRLCADAEALLEAHYSDLLAAFDNPLDHLPLFPYFTNYLLLSQLEHGLLARHVPGPPPSRVAFVGSGPLPLSS

SEQ ID NO: 65718 - DNA, 586 bp, Zea mays
  misc_feature: Ceres CLONE 1537351
  misc_feature: Encodes the peptide sequence at SEQ ID NO. 65719
  misc_feature (202)..(202): n is a, c, t, g, unknown, or other
  misc_feature (236)..(236): n is a, c, t, g, unknown, or other
  misc_feature (238)..(238): n is a, c, t, g, unknown, or other
  misc_feature (335)..(335): n is a, c, t, g, unknown, or other
  misc_feature (398)..(398): n is a, c, t, g, unknown, or other
  misc_feature (553)..(553): n is a, c, t, g, unknown, or other
  misc_feature (554)..(554): n is a, c, t, g, unknown, or other
aatctggactccccgcggtggcgccgctctatcacaaaggatcccccgggctgcaagaattcgtctcacccctagaaaaagttgatgcaaaatcacgtgtggaggacatttggaagaaatgaacagaggttttcctaataagatgcccaaacctgcaatgacaaagctcagtacaaccgaaaaacaaagttaaattaaccancaaatatttggatgactgttctaagccctttcancnaagcaagggacataagggtcgatcaaggatcccaaaattgggttccaaccgacccaacttgaaaatggaacgaagaaggccaaaaaaattttgaaancaaaaggcccttttggactctcccaaaaaaaagttgcgttgtttgtggggctctcccggcccncaggggaaaaaaggggaaaacctcccccccagcgttataggggaaatttttttccggggggaaagaaaaacctcccaaaatccacaaaaaaaaagggggggggaaaagcgcctttttttcccaaaagagagaggaccccctccccaaaaaaaaannaccataaagaaaaaagtgtggggccccccccc

SEQ ID NO: 65719 - protein, 39 aa, Zea mays
  misc_feature: Ceres CLONE 1537351
SGLPAVAPLYHKGSPGLQEFVSPLEKVDAKSRVEDIWKK

SEQ ID NO: 65720 - DNA, 628 bp, Zea mays
  misc_feature: Ceres CLONE 1537352
  misc_feature: Encodes the peptide sequence at SEQ ID NO. 65721
  misc_feature (488)..(488): n is a, c, t, g, unknown, or other
  misc_feature (522)..(522): n is a, c, t, g, unknown, or other
tggagctccccgcggtggcggccgctctagaactagtggatcccccgggctgcaggaattcgtctcacccctagaaaaagctagcacccatcttgcagcaggcggagccgcccgacccaatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaagtcggcctcgcccacggctacctcctcgtcgggcccttcgcgctcaccgncccgcttcgcaacaagccccgtgcacggccaagncgggggccgctcggggcccgccggggcttcgtccccattccttaagggttggcctccacctggtaaggggtccccctccttcaaacaaaggggaaccccctccacg

SEQ ID NO: 65721 - protein, 133 aa, Zea mays
  misc_feature: Ceres CLONE 1537352
  misc_feature (44)..(132): Pfam Name: PsaL Pfam Description: Photosystem I reaction centre subunit XI
  misc_feature (108)..(108): Xaa is any aa, unknown, or other
  misc_feature (119)..(119): Xaa is any aa, unknown, or other
MASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTXPLRNKPRARPXRGPLGARRGFVPIP

SEQ ID NO: 65722 - DNA, 635 bp, Zea mays
  misc_feature: Ceres CLONE 1537354
  misc_feature: Encodes the peptide sequence at SEQ ID NO. 65723
tggagctccccgcggtggcggccgctctagaactagtggatcccccgggctgcaggaattcgtctcacccctagaaaaaaggaaaaggccaaaaactcatcggcaatctccatctgaaaattctctcgcctgaacgtccaagcacaatcccgaaccctaaccagcgccccagctcgccgtcggcatgtccgccaggttgctccggcgagtcctccaagagcgtgaggccactcctcaggacaccgacgtcgccgacgaataccagtcggtggaggaggaggcttctcctccgcgcacctccgcgcggaatctcttcaatctcctcgacgacggaaacggcgacggcgacgaataagatgaaaaggaagatgaaacagaaataattcaagctgtgagctatacagaacacagacattctgtgcaaaagaaagcgaacgctgtacccgaaacaaacaaaaaatccaaaaaaaaaaaaaaaaacgagacgctcgaggtacccaattcgccctatagtgagtcgtattacgcgcgctcactggacgtcgttttacaacggcgtgactgggaaaaccctggcgttacccaacttaatcgccttgcagcacatccccctttcgccagctggcgtaatagcg

SEQ ID NO: 65723 - protein, 56 aa, Zea mays
  misc_feature: Ceres CLONE 1537354
MSARLLRRVLQEREATPQDTDVADEYQSVEEEASPPRTSARNLFNLLDDGNGDGDE

SEQ ID NO: 65724 - DNA, 803 bp, Zea mays
  misc_feature: Ceres CLONE 1537358
  misc_feature (387)..(387): n is a, c, t, g, unknown, or other
  misc_feature (389)..(389): n is a, c, t, g, unknown, or other
  misc_feature (393)..(393): n is a, c, t, g, unknown, or other
tggagctccccgcggtggcggccgctctagactagtggatctcttgggctgcaggaattcgtctcacccctagaaaaagtccgcaagtggccgggtgttagagaagtgcaggctcgtaggtccgatcgccggagtcacatgctctgggctggcttctgctgccaggcgccagctgcctcgctagcccaaccgcaatgcgcgccatcgcctccccactcgcgcctcctcgcccagagccacccattgccgtccgatcaagatccaacgccctcgaacgcgccactttaccaccagtccccctcaccgccgcccttttccgcctccgccaacaaccggagccagggctcttttcccccccccccggggggggggggggggggtccttcnanatantaaaatcttcccccccaggggcccgctcccatttcccaccgctccgcgcgcgccggcgggattctccccaaccgacccccctcaccccggctgggcccccgcgcccggcagccgccgtcccggccccccctctaagtggagccccttgcagccgcgccactcccggcgggcgggatgcccgccggcccgcccccagtccccgcaccaacccccgcccggtgcaagaatccatcgcctccccctcacagcagcccgccccactccctcccgggacgcgccccatcgcaccgcccttatcgaccccccgcgctcgtccctcgtgccccgcgttcctgcaagcccctcggacgacacaccagcgcctgtggactccctggtgaccacccccatcctccccacgctcgcgccgg

SEQ ID NO: 65725 - DNA, 694 bp, Zea mays
  misc_feature: Ceres CLONE 1537359
  misc_feature: Encodes the peptide sequence at SEQ ID NO. 65726
  misc_feature (694)..(694): n is a, c, t, g, unknown, or other
ctggagctccccgcggtggcggccgctctagaactagtggatcccccgggctgcaggaattcgtctcacccctagaaaaaccacgcatcctccgtctccgtccccatctcgcgaagctagcgggaataacaagcaacgatacctacgacgacctacccccctttccctgctctctccttccaactcttgtttctgcaacgccagggcgcaaccatgggtcagcagcagaagggccggcggccaggcggatggcacgctcgcctccacctgcgcatccctccgtctctcccctcagaggaagatgttcccctcttgaggggatcaattgccgtgcaaaaggtgcggcgccaggctttcaagtcgcgatcttgggtgcagcaagtgggattgggcagccacttgcgctattgatgaagatgaaccctcttgtttcggggctccatctatacgatgtcgtccacgcacctggtgtcacagcccgacatcagccccatggacaactggtgcttgggtacctggcttcctgggccacccacagtttggaaaagccccgggctggaaagggaacttgaaaaaattcccggccggggggccccccgaaaccggggaaaaaaagggaatgattttttccaaaaaaaaggcgggaaaaaccccctcccccggggagaggaaatttgaaaaagctcccccaaan

SEQ ID NO: 65726 - protein, 107 aa, Zea mays
  misc_feature: Ceres CLONE 1537359
  misc_feature: SWISSPROT Homolog: EC 1.1.1.37 Malate dehydrogenase
MARSPPPAHPSVSPLRGRCSPLEGINCRAKGAAPGFQVAILGAASGIGQPLALLMKMNPLVSGLHLYDVVHAPGVTARHQPHGQLVLGYLASWATHSLEKPRAGKGT

SEQ ID NO: 65727 - DNA, 643 bp, Zea mays
  misc_feature: Ceres CLONE 1537360
  misc_feature: Encodes the peptide sequence at SEQ ID NO. 65728
  misc_feature (391)..(391): n is a, c, t, g, unknown, or other
  misc_feature (409)..(409): n is a, c, t, g, unknown, or other
  misc_feature (449)..(449): n is a, c, t, g, unknown, or other
  misc_feature (474)..(474): n is a, c, t, g, unknown, or other
aaagctggagctccccgcggtggcggccgctctagaatagtggatcccccgggctgcaggaattcgtctcacccctagaaaaaaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcngcatggtcgtcccctacngcgcctttctcgtccctgcccggctcgggaaacgccggcngcgggacctacgcgaaagacaagcntgggcaacgacatccacgtgggagggcggggctcaaacacgcaaagtccctaagaaccgcacagctccgcgcaggggcctcaaaggtgaacccccccgtaccttgggggggtggaacaaggacaaaaaaccctggcccacctaacgggaatcaaccgcccgggggccac

SEQ ID NO: 65728 - protein, 153 aa, Zea mays
  misc_feature: Ceres CLONE 1537360
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
  misc_feature (79)..(79): Xaa is any aa, unknown, or other
  misc_feature (85)..(85): Xaa is any aa, unknown, or other
  misc_feature (98)..(98): Xaa is any aa, unknown, or other
MATSAALSTAANPTQLCRSRASLGKPVKGLGLSMGRERAQRSIVCQAASSISADRVPDMEKRKLMNLLLLGAISLPTVXMVVPYXAFLVPARLGKRRXRDLRERQAWATTSTWEGGAQTRKVPKNRTAPRRGLKGEPPRTLGGWNKDKKPWPT

SEQ ID NO: 65729 - DNA, 618 bp, Zea mays
  misc_feature: Ceres CLONE 1537364
  misc_feature: Encodes the peptide sequence at SEQ ID NO. 65730
ggagctccccgcggtggcggccgctctagaactagtggatcccccgggctgcaggaattcgtctcacccctagaaaaatggcactattggaatgcattcacttgtttgcagagctatggggacctttctttagcaaagtctgcgagctcatatctctgcgtattttccgcgagggtacctgatcctgaatgaattgactcttgccggggagctgcagtaaataagcatagatgcaaaaattggacgtatggtggaactgcatacactggaatgacgaagaccatttctatgctgcctcatgcgttgaattccgatttgaattcttcgtttcaagtgttttatatttgctctccaggtacgttccggctgaccgcgtgatccccatgcggtcacttaaaagaaaggcactcgtggctagcatgactacattataaacgtaccttccagaacatactacgttccccgccttattactctcccaccgagacgctccaggtaccccacccgccctaaagtgagtcaaataacacccgttcgccggactccgttttacaacatagtgactggaaaatcgacgtcgtaaccgatcttaatcgccttgaaacacatccacctttc

SEQ ID NO: 65730 - protein, 34 aa, Zea mays
  misc_feature: Ceres CLONE 1537364
MALLECIHLFAELWGPFFSKVCELISLRIFREGT

SEQ ID NO: 65731 - DNA, 619 bp, Zea mays
  misc_feature: Ceres CLONE 1537368
  misc_feature: SWISSPROT Homolog: EC 3.2.1.23 Beta-galactosidase
tccccgcggtggcggccgctctagaactagtggatcccccgggctgcaggaattcgtctcacccctagaaaaaaagcatctcaagtcgtacatcatagagacgctaaacaagcagcagcccgcactggcgctaccactggctaaggatcaaaatgctggacaaagtgttcttcctcccttcacgctccctcttccgcaggatgcgatggatggattttctaagttccagaactttttgtcgtcgaaatttcagggaaaatgagtcaccttatggagtgacgtttagttgccttgtaaatgcgtcaatctgagcccttttttgggtttatttctctgcaaatgtatgtttctaaggtagtgtcttgttaatgttaatgattctacacctttctgtgacagtattgcgaataagaggagaacctcattctttgttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcac

SEQ ID NO: 65732 - DNA, 634 bp, Zea mays
  misc_feature: Ceres CLONE 1537375
  misc_feature: Encodes the peptide sequence at SEQ ID NO. 65733
aaaagctggagctccccgcggtggcggccgctctagaactagtggatcccccgggctgcaggaattcgtctcacccctagaaaaaaaatggccgcgtcccactgaaccaaccgtctgcacatcctcctcctgttgccgctcgctcgccgtgccgcaatggctacggccgtcgcctcccatacgttgctctcctccgccttcgccccgcaccactaccaccgccgcctgacccggaccgcgtccgtggggccgcgccgggccgccccggtgggactggccgtgcggtgcgagaagagcgacaagcagaagaggcagccgctcgccgcgctcgtgccccgcgagcagcgcttcatgttcgagggagacgagctctgcggccgcgacatatggaatacaacctggtatcctaaggctgcagatcatgtaactaccgagaagacatggtatgttgttgatgcaacagacaagatcctaggcaagctagcatcccccattgcagtacatatcaggggaaagaatgaacccccttacactccctagtgtaaacatgcgaagctttttgttatgtaagagctcccctgctttgttcaaaacttcagagccccttccctcttgtggtccgggccaaattggg

SEQ ID NO: 65733 - protein, 127 aa, Zea mays
  misc_feature: Ceres CLONE 1537375
MATAVASHTLLSSAFAPHHYHRRLTRTASVGPRRAAPVGLAVRCEKSDKQKRQPLAALVPREQRFMFEGDELCGRDIWNTTWYPKAADHVTTEKTWYVVDATDKILGKLASPIAVHIRGKNEPPYTP

SEQ ID NO: 65734 - DNA, 658 bp, Zea mays
  misc_feature: Ceres CLONE 1537378
  misc_feature: Encodes the peptide sequence at SEQ ID NO. 65735
aagctggagctccccgcggtggcggccgctctagaactagtggatcccccgggctgcaggaattcgtctcacccctagaaaaacgaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaggtcatcaaaggtcgtgtccgaccgcaaccccagcaacctgccgtggggcgagctcggcatcgacctcgtcatcgagggcaccggcgtcttcgtcgaccgcgagggcgcggggaagcacatccag

SEQ ID NO: 65735 - protein, 180 aa, Zea mays
  misc_feature: Ceres CLONE 1537378
  misc_feature (68)..(180): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGRSSKVVSDRNPSNLPWGELGIDLVIEGTGVFVDREGAGKHIQ

SEQ ID NO: 65736 - DNA, 629 bp, Zea mays
  misc_feature: Ceres CLONE 1537383
  misc_feature (512)..(512): n is a, c, t, g, unknown, or other
  misc_feature (516)..(516): n is a, c, t, g, unknown, or other
  misc_feature (517)..(517): n is a, c, t, g, unknown, or other
  misc_feature (531)..(531): n is a, c, t, g, unknown, or other
aaaagctggagctcaccgcggtggcggccgctctagaactagtggatcccccgggctgcaggaattcgtctcacccctagaaaaccactcttctccttcactgtcgcagccgccccttgtagaagcttcgaggctgctgctgctgcgcccatgaccgcggaaggcaagacgccgtccctcgccgaggagtattcacttccaccacagggaagttcccagtggaaaaagggcacctgaaggaaaaacccccttcctatgggtaactggaatccctgaaactttgcctcccccctcaaacccaagggggggaaaatttttccccccccccccgggggggggaagaaaaaaaaaaaacggggccccccttcctccaaattatacccaaaaaggggtgcccccacaaaaaaaaccccccccgggggggggcggaaaaaaaaatttttttttttccccccccccccccccccccccaagggggggggggggggggggggggggggctctctcaacanacannattctctcctcctntccctcccccccccccccccccccccggcgggggccaagggggtcctcctttatctaacaaaaacccttcttcgcccccatccactacgagccccggg

SEQ ID NO: 65737 - DNA, 716 bp, Zea mays
  misc_feature: Ceres CLONE 1537391
  misc_feature: SWISSPROT Homolog: EC 3.2.1.23 Beta-galactosidase
  misc_feature (1)..(1): n is a, c, t, g, unknown, or other
  misc_feature (6)..(6): n is a, c, t, g, unknown, or other
  misc_feature (42)..(42): n is a, c, t, g, unknown, or other
nttttnttttaaattaattatttagaacgaaataaagttttncttaaaaaaatcaaaaaaactggtactccccgcggtggcggccgctctagaatagtggatcccccgggctgcaagaattcgtctcacccctagaaaaaaattattactcattctatattgttattcgaagcattgtgctatgatgagtcatttatgtaatcactgtgtacgtgaatttctgatcctggcacgtacatggttcgcattcggtttaccttcctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttttaccaatagggcccaaaatcgggaaaaatccccttttaaatcaaaaaaaataagacccgaaataagggcttgaggtggttggttccaagttttggaaaacaagaagtcccacctatttaaaagaaacgatggaaactcccaaacggttcaaaaggggcc

SEQ ID NO: 65738 - DNA, 821 bp, Zea mays
  misc_feature: Ceres CLONE 1537393
  misc_feature: Encodes the peptide sequence at SEQ ID NO. 65739
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (364)..(364): n is a, c, t, g, unknown, or other
  misc_feature (432)..(432): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (656)..(656): n is a, c, t, g, unknown, or other
  misc_feature (795)..(795): n is a, c, t, g, unknown, or other
nnnnnnnnnnnnnnnnnnaaaaaaaaattagggnnnnggggcgaannnnnntctactggtactccccacggtggccgccgctctattctactggatcccccgggctgcaggaattcctctcacccctagaaaaaaactcagcacaccaaggagagtacgtggaggagcagccatggcttcatcggtggccgccgcggcgagcacattcctgggcacccgcctggaggacccggcccacagaacgggcgcatcgtggcccggttcgggttcgggttgggcggcaaggcaaaccctgctcctaagaaagtggcgaaaacatcgacctcctctgaccggttttctgtggtttccccggaggcgtggnccccccaactaccttttactgtttcgatgggacggcgactaaagaggtccaaatttttttctctcttnccctaccccggggggggaggaggggggggaggtttnnncttttcaactcttcttttaaccccccaacctcaccccaaaaaaaacaaaaacactaaatatataatcctcctttacacgcctaatttaccaaatatcctccccacaatcataatttcctctattttttttaaaataacttaatacttcaactccacttttctacaccttcttccaacacatccccnccacactatatacatctccccttcacacctcccccctcaacaccaacctattctataactccttactcctcccccttccccccacacaaccccccctatttaccccccataccctttttttccccccaaccgcgccctntatctcccacccaccacaccctattg

SEQ ID NO: 65739 - protein, 77 aa, Zea mays
  misc_feature: Ceres CLONE 1537393
MASSVAAAASTFLGTRLEDPAHRTGASWPGSGSGWAARQTLLLRKWRKHRPPLTGFLWFPRRRGPPNYLLLFRWDGD

SEQ ID NO: 65740 - DNA, 631 bp, Zea mays
  misc_feature: Ceres CLONE 1537394
aaactggagctccccgcggtggcggccgctctagaatagtggatcccccgggctgcaggaattcgtctcacccctagaaaaatcatcgtcctcaccagggtacagacgtgcccctcctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctcccttggtggtcagctgaagtgcgcacaaaccggcaagtcacaatacggcaatgggcggattcccattaggagtcctccctttttatttcttttaccccttttttaacattctaatttggggtgaattggggccaggccgaaagcctagaaagacaaataaaccctaagtaattccttggtgtgaatggaattataaccttataccttttggggaaaaacaaatggtttgggcccccatgggggtaccccccacgtccccccaaaaaaaaaagcccggcctataaaaataaaaattgggttggccttttttggaaaaaaaaaaaaaaaaaaaaaaaacccgaaaaccctcccccaaaggttac

SEQ ID NO: 65741 - DNA, 615 bp, Zea mays
  misc_feature: Ceres CLONE 1537397
  misc_feature (529)..(529): n is a, c, t, g, unknown, or other
  misc_feature (591)..(591): n is a, c, t, g, unknown, or other
  misc_feature (592)..(592): n is a, c, t, g, unknown, or other
ggagctccccgcggtggcggccgctctagaactagtggatcccccgggctgcaggaattcgtctcacccctagaaaaaatttgagaatagagcggatggcatatctaattttgtctctgaaaatgggaacaaaataacagaccagaaatcaggatttagcgttggaagagatggtagaggtggcaggcaatttggtgcatttagagggaggggcagaggaaggcatcctaatcaaaatcgtggaagaggaagcaacaactggggagaaataaaatcaaacttcatgggacacaaaagttcagcatcaaagcattgcagtgatattgcagctccagcatctggaggacgccgaaagccccctccaataatttatgatgcaaatgaagttaaacagtgggtagaggcacgaaaaaagaactaccctacaagtgtcaacgtaaataagaagttgtctgagatgaaatcagataatgaaaacaaggacaaagatgcccaactgcgacgtcaggaactgaaggaagtcatagcnaagcaacaagagctgggttttgacccacctgagctaccgcctggctatctatcagaaattgnnggatcatgcattgaaaataaaat

SEQ ID NO: 65742 - DNA, 755 bp, Zea mays
  misc_feature: Ceres CLONE 1537400
  misc_feature: Encodes the peptide sequence at SEQ ID NO. 65743
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (36)..(36): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (755)..(755): n is a, c, t, g, unknown, or other
nnnnnnnnaaaataaacaagaaaagggcgaggcggnccnccnnnnnnnnnnntaaaagtgggactccccgcggtggcggccgctctacaatagtggatcccccgggctgcaggaattcgtctcacccctagaaaaaactccaaaccctcgccgactcagatccagcttcctcgcaccgccgtcgccatgccgttcactccaggcccctactctggcgtcagcaccctcgcccttgtggcgagggcgtcggcctttggtgtcggtgtcctctacgggagcatcaagctctcaatcctcaaggtcacaaaacctaaaaaggaggaagtgcatgatcatcactaaggatgacagggctgctacatgttaattcccatatatgcaaggatgttataaaattggcagtgcaccccttatccatacgtgcaatttcgtttatgatttgtggacctgtctgtaacatacctgcctgttttttttgtgttgaaataaattcctatacaatggactgaatggacatgaaaatcaggaaagtggaaaaaaccattagtaactaattgcaaagtcctttcggacgaaaaaaaaaaaataaaaccgagaccgccctcgagggtacccaaattccgcccctataaggggagtccgtaatttcccccccgcctcccactgggcccgtccgttttttcaaaccgtccttgaactggggaaaaaccccctggcggggttacccccaactcttaaatcccccctttgggcan

SEQ ID NO: 65743 - protein, 51 aa, Zea mays
  misc_feature: Ceres CLONE 1537400
MPFTPGPYSGVSTLALVARASAFGVGVLYGSIKLSILKVTKPKKEEVHDHH

SEQ ID NO: 65744 - DNA, 634 bp, Zea mays
  misc_feature: Ceres CLONE 1537406
  misc_feature: Encodes the peptide sequence at SEQ ID NO. 65745
aagctggagctccccgcggtggcggccgctctagaactagtggatcccccgggctgcaggaattcgtctcacccctagaaaaaagggcgcggcgacgacacccacagccacaggccacacgacaccaccgctcggtctcgcggcgtccgcctccacgcacgcttcctcccgcaggccatccatccgatccgatccgagcgtccaccatgtgggtgacgtcgatgccgcaagtgtgggacgaggagggcgcggcccagggcggcgcggtgaccccggcgccggccgcggccatgctgggctcgctggcggggtggctgtcccggaacgtgcagccgcagccgccgggcgcccgggtgtgctgtaccccgccccgccccgccgggggggggcccaggctcaggctccgcgacggccgccaccttcgctaatgggaaaagcgggtgcccccgaacccgggccaggttccccctccctctttttcccaagggaatttcaaagggtcccccggggagagaaagcgcccccccgccccccccacaaaatttttccccaaaaaaacttggcggctgggaaacaggggccgggggttttccaaccccgccgcccggggtaatcggggcgaaaagaacacccc

SEQ ID NO: 65745 - protein, 73 aa, Zea mays
  misc_feature: Ceres CLONE 1537406
MWVTSMPQVWDEEGAAQGGAVTPAPAAAMLGSLAGWLSRNVQPQPPGARVCCTPPRPAGGGPRLRLRDGRHLR

SEQ ID NO: 65746 - DNA, 681 bp, Zea mays
  misc_feature: Ceres CLONE 1537407
  misc_feature: SWISSPROT Homolog: EC 3.4.25.1 Proteasome endopeptidase complex
  misc_feature (383)..(383): n is a, c, t, g, unknown, or other
  misc_feature (393)..(393): n is a, c, t, g, unknown, or other
  misc_feature (681)..(681): n is a, c, t, g, unknown, or other
tggcggccgctctagaactagtggatcccccgggctgcaggaattcttctcacccctagaaaaaagcacctctctccctcgctagagcaaaaaaccttgccacgaatcgccgacactccaacccggaagaggcaacgatgttactccgcgcctcgggaatgggtgacacccaatactccttctcgcttaccactttcagcccgtcgggaaagcttgtgcaaatagagcaccccctcccggtgtccgatccgggcacacctccctatttttccccctgccaagggaggaagcctttgcccctttttttattctgcccttccatttcggggaaggacccttttttttctctccccaccccggggagaaagaaaagggggactttnctcttatttntttctccccccccccttctcccaaaaaaacaaaaaaaaaaactcccccagcgtgggcggcgacccatacctctcctcctttccaatgcgctaatatcctcataactccaacctttcccccctcacaatccgctccaccctcttccccccctctcccccccccaaatgaggctcttcccaccctttcactactccctcactaaccccttccctccctttaactcccttttcccccctatccctactttccccttccttccctcattctctccccaccctccccctttan

SEQ ID NO: 65747 - DNA, 733 bp, Zea mays
  misc_feature: Ceres CLONE 1537410
  misc_feature: SWISSPROT Homolog: EC 3.2.1.23 Beta-galactosidase
  misc_feature (11)..(11): n is a, c, t, g, unknown, or other
  misc_feature (12)..(12): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (733)..(733): n is a, c, t, g, unknown, or other
ttttccccttnnggggcgagctagtgcgtaagcaatcaatgtngtttattnnctcaaactgagactcaccgcggtggcggccgctctagactagtggatcccccgggctgcaagaattcgtctcacccctagaaaaacatttaacttcgcggcgcatgcgtcagacaccgtgatcttgcatgctaacctgctgtctttctagtacatttgatttcttcgtgcttattattgctctggtggttgtgaaaaatgcttgtcagtttagactgcagaacgaaacttattggcagacttccttttctgggcaaaataaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaccctgaatggcgaatggaaatttgtaagcgttaatatttctgttaaaattccccgttaaatttttggttaaaatcacctcatttttttttaacccaatagggccgcaaattccgccaaaatcccctttattaaatccaaaagaaattagacccccaaaataaggggtttgaagttggttggttttccaagtttttggaaaacaaaaaagaccccan

SEQ ID NO: 65748 - DNA, 637 bp, Zea mays
  misc_feature: Ceres CLONE 1537413
  misc_feature: Encodes the peptide sequence at SEQ ID NO. 65749
  misc_feature (395)..(395): n is a, c, t, g, unknown, or other
acgctggagctcaccgcggtggcggccgctctagaactagtggatcccccgggctgcaggaattcgtctcacccctagaaaaaaattggcctggctacccagacaagagagcacgcaacgcaagcaactgcgacgtctcccgcccccgccgcgccccggaccttttccgcagatattttttttatccccccacgcccccggctcgttcccttccattccaccacctctcgccagacgacgagatgtgcgaggcaccgcggctcggcaaccgcgccggcgccggcgacccggccgccgccgacgtcgacgtcgtcacgacgggcgggcgccggaggatccccgcgcattcctctgtcctggcctcggcgcccccggggctcgggaggatcctggancgccgcctccggaaggacagggagagcggcaagcccgggcggtccgtcgtccggatccgcggcgtcaccgacaacgccgccgccggcttcgtccgcctcctctacgccggcaggtgcgggcaaggaggaagatgacgacttggaggaaccccccggggcagggtgcctggtgctgggcccacccgtacccaggtgccggggcctgaagcgggggcgttgcaaggggcccccttcctgccccc

SEQ ID NO: 65749 - protein, 95 aa, Zea mays
  misc_feature: Ceres CLONE 1537413
  misc_feature (51)..(51): Xaa is any aa, unknown, or other
MCEAPRLGNRAGAGDPAAADVDVVTTGGRRRIPAHSSVLASAPPGLGRILXRRLRKDRESGKPGRSVVRIRGVTDNAAAGFVRLLYAGRCGQGGR

SEQ ID NO: 65750 - DNA, 676 bp, Zea mays
  misc_feature: Ceres CLONE 1537416
  misc_feature: Encodes the peptide sequence at SEQ ID NO. 65751
  misc_feature (475)..(475): n is a, c, t, g, unknown, or other
aagctggagctccccgcggtggcggccgctctagaactagtggatcccccgggctgcaggaattcgtctcacccctagaaaaatcccacccacaaacccttcttatcctatcgtcgcgcgcgcctgcttctcccacacactccacagcgcccgcgcaggctcgctgcaagctcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctccctttcgtgcagcccgcccagaagcacacgctgcagccgcccgccgcanccgccgaagtgccaggggaggccaagtctgtgggtttccctggaaaaataccccggcccctggccaccggctttcttccttcttccagtgggaactttccttcaaaggtcatatttaaacatcctccaacaaagaagatctaccaacctacctttccccataacccaatacttttgggggccccttgaaccccccccaagg

SEQ ID NO: 65751 - protein, 148 aa, Zea mays
  misc_feature: Ceres CLONE 1537416
  misc_feature (87)..(87): Xaa is any aa, unknown, or other
MSALGTLSGGAAGVSGLLRLRRRAAPAPAIAAPSHLPAGTVKCAAAVPDAAPIVWGRQLRPALLLPAALLPFVQPAQKHTLQPPAAXAEVPGEAKSVGFPGKIPRPLATGFLPSSSGNFPSKVIFKHPPTKKIYQPTFPHNPILLGAP

SEQ ID NO: 65752 - DNA, 652 bp, Zea mays
  misc_feature: Ceres CLONE 1537419
  misc_feature: Encodes the peptide sequence at SEQ ID NO. 65753
  misc_feature (418)..(418): n is a, c, t, g, unknown, or other
  misc_feature (462)..(462): n is a, c, t, g, unknown, or other
  misc_feature (563)..(563): n is a, c, t, g, unknown, or other
atagctggagctccccgcggtggcggccgctctagaactagtggatcccccgggctgcaggaattcgtctcacccctagaaaaaccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgccgccgccgtanggagcttgcagccgggggcggagaacctgcaggtgcaggactancagggacgctacatgtattatggtgcttacccggcttatgcctatggagcctatggtggctgggggggagtacccatacctgagccatgatggacacagancacaactgccgggaacctatgctgacatgtactatgccttatgctccatagggggtgcaacctgggggcatgaggggccaatttagggg

SEQ ID NO: 65753 - protein, 103 aa, Zea mays
  misc_feature: Ceres CLONE 1537419
  misc_feature (60)..(60): Xaa is any aa, unknown, or other
  misc_feature (74)..(74): Xaa is any aa, unknown, or other
MAAVGSLKPGMETLHVQDYKDAPPAKAAVESLQPAMESLHVQDYKDAPPAKGVAAAAAVXSLQPGAENLQVQDXQGRYMYYGAYPAYAYGAYGGWGGVPIPEP

SEQ ID NO: 65754 - DNA, 671 bp, Zea mays
  misc_feature: Ceres CLONE 1537426
  misc_feature: Encodes the peptide sequence at SEQ ID NO. 65755
  misc_feature (189)..(189): n is a, c, t, g, unknown, or other
  misc_feature (313)..(313): n is a, c, t, g, unknown, or other
  misc_feature (417)..(417): n is a, c, t, g, unknown, or other
acagctggagctccccgcggtggcggccgctctagaactagtggatcccccgggctgcaggaattcgtctcacccctagaaaaaaagctcctccgcaccaccgtacaccggacccggagcagctcgccgccgaacccagcgctgaaccgacggggagaggcgaggccgcgctttaccccgggaactacnaagcaacgacggcgggactgagcaggcggggatatgactgtgatcaaggcagctggagcggagccgtgcggagacggcggcgcgtacggcgcgaggcggcggcagtcgctgcgggcgcggtacncgtacgggttcgtcttcttcgccacaaacctgctggcctggttcgtcaggcaccccggcgccaggggcggggcgggggggttgctcaggtgcccgtccgccaancaggggactcccagggctttccggcccggaagagggcttccgggaaaccttggccttcttccaaatttttccggggggaaggttggccccaacttttgaaaacctccaaggctcctggaagctcccaaatttcggggcattccggagggttgggattccgaaaaccctctggtggatcccccggcccaacccgcccccccctttgttcccccccctacacctcttccgcccaattttttgtggttttttttttg

SEQ ID NO: 65755 - protein, 97 aa, Zea mays
  misc_feature: Ceres CLONE 1537426
  misc_feature (31)..(31): Xaa is any aa, unknown, or other
  misc_feature (65)..(65): Xaa is any aa, unknown, or other
MTVIKAAGAEPCGDGGAYGARRRQSLRARYXYGFVFFATNLLAWFVRHPGARGGAGGLLRCPSAXQGTPRAFRPGRGLPGNLGLLPNFSGGKVGPNF

SEQ ID NO: 65756 - DNA, 651 bp, Zea mays
  misc_feature: Ceres CLONE 1537427
  misc_feature: Encodes the peptide sequence at SEQ ID NO. 65757
  misc_feature (546)..(546): n is a, c, t, g, unknown, or other
catagctggagctccccgcggtggcggccgctctagaactagtggatcccccgggctgcaggaattcgtctcacccctagaaaaaacaccaccaccacctcctctcctctgcccctaagccgtccgttccggctcatccgccattttttccctgtcgcggtaagcgatagggttcggcgtccgtcttctaaatccgcccttcttcgtttcgatttttccggcgttctgggagcaagcttcagcttcatcgacggagttcttggtcttttgcggctcgacatgtctccgttccagggatacagaggcgatgcggttctctccggcgtccggtcgcggaagcgcgtgttcgcgacggcggacgcggagcccgtgacggcggctcccaagaggcacaagcgcggggatgatatgcccctggacgcgctgccggacgagtgcatcttcgaggtcctgcgccgcgtgcagggcacccacgcgcgctgcacgtcggcctgcgtctcccgtcgctggctcgggctcctcggcgggatcctggcctatgaaggngtgctggaccctggcgcccccgacgtagcggaccctaaacaggaatacctcagcgagaacaagaaggccaatttgatggaacctggaacggcaacccccccaaaa

SEQ ID NO: 65757 - protein, 124 aa, Zea mays
  misc_feature: Ceres CLONE 1537427
MSPFQGYRGDAVLSGVRSRKRVFATADAEPVTAAPKRHKRGDDMPLDALPDECIFEVLRRVQGTHARCTSACVSRRWLGLLGGILAYEGVLDPGAPDVADPKQEYLSENKKANLMEPGTATPPK

SEQ ID NO: 65758 - DNA, 817 bp, Zea mays
  misc_feature: Ceres CLONE 1537429
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (28)..(28): n is a, c, t, g, unknown, or other
  misc_feature (41)..(41): n is a, c, t, g, unknown, or other
  misc_feature (43)..(43): n is a, c, t, g, unknown, or other
  misc_feature (55)..(55): n is a, c, t, g, unknown, or other
nnnnnttttaaagggaagggatgaggantgagaacgaaaantntttataacccancctcaaactggaactccccgcggtggcggccgctctacaatagtggatcccccgggctgcaggaattcgtctcacccctagaaaaatgatctggcatcaaaaccagaaggtgaagggacgccaactacagactttagggcactttttgcacaagttaatagtcgcttctaaagacataagattgttcttgccaagaagttgagggcattctttcgtaaagcgatatgaaatgtgtgtctagtaaggttagtttcctgtttactaagttcctaatatattacagttgttccatgtagcatccttttttatctcttgctctctacgctccttttgggctttatttccctgtctataacatcggaattcctgcataatagctaaatgaaaactttcatactcaaataaaaaatttgcctcgggaaaagataaaaaaaaaaaaacgaagaatgcttccgaaggtacgccaaattttcgacccccataaatagaagttccctaaattaacacacacaacctcactggaggccggaagggttttttttaaacacatcctctggacctggaagaaaaaaacccatggggatgtttatccccacacatttaaatcctactccttccggacgcaaacatctcaccccctttttttactccacaaactaggggcgtcaaattataacacaaaagaaagacccccgcgcataacagatatcataccccctattcatcagaagaaagatttgccactaaccaccctctaaaatg

SEQ ID NO: 65759 - DNA, 650 bp, Zea mays
  misc_feature: Ceres CLONE 1537435
  misc_feature: Encodes the peptide sequence at SEQ ID NO. 65760
  misc_feature (521)..(521): n is a, c, t, g, unknown, or other
  misc_feature (582)..(582): n is a, c, t, g, unknown, or other
aaagctggagctccccgcggtggcggccgctctagaactagtggatcccccgggctgcaggaattcgtctcacccctagaaaaaacccgccgcagtccacgcgcccgcaccgcacagcgcgccgcgctcgctgccgtgcccgtgtccccttcctttcccgtttccccctccctctctctttccccacgcccgacgcccccaccactctctcgatccaaagccagatcggcacgacgagcagagggccccccggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcagggcccagatttgggacactgctggcccagaacgatatcgtgctattactagtgcgtattatcnaaggtgctttgggggcgttgccttgtatatgacctcactcgtcccctcaccttttgaaacntttaacccttggccttaaggattttaagggaccccccgatccccaaataaggtggtaaggccgggtgg

SEQ ID NO: 65760 - protein, 110 aa, Zea mays
  misc_feature: Ceres CLONE 1537435
  misc_feature (16)..(107): Pfam Name: Ras Pfam Description: Ras family
  misc_feature (85)..(85): Xaa is any aa, unknown, or other
MAAGYRAEDDYDYLFKVVLIGDSGVGKSNLLSRFTRNEFSLESKSTIGVEFATRSLQVDGKVVRAQIWDTAGPERYRAITSAYYXRCFGGVALYMTSLVPSPFETFNPWP

SEQ ID NO: 65761 - DNA, 634 bp, Zea mays
  misc_feature: Ceres CLONE 1537437
  misc_feature: Encodes the peptide sequence at SEQ ID NO. 65762
  misc_feature (597)..(597): n is a, c, t, g, unknown, or other
aagctggagctccccgcggtggcggccgctctagaactagtggatcccccgggctgcaggaattcgtctcacccctagaaaaaagtatgcttcttgcctcccgcctgcttcctccgccgccctcctccgccgcggccggttcctcctcatcctctctgagaatgaaaggtttgcctcttcgtgtttacctggatctggaggccagtaggaagccaactggttttgaggacatttttgtcggttaccatgccagtgatgatgtgcaagtaacatatgctggaaaatcatttcacaccagccgaagttaccatatatcaactgaaaagagaaacgatgcacttatctactggtcatcttcaaggtgtcttcctcatagagataagctcgcaaaagacttcctctcgctggttcctcaccattccttcggaagatgtttgaacaatgtcggcggtcctgacatggcgctatccatgtatccagtctgctccaccaacgataacggcacgccacactggtgggatcacctacactgtgcgatgtcacattacaagttcgttcttgcaatcgagaacacccagaccgaaagctacgtgaccngagagctgttctacgctttggaggctgggtcggtgcc

SEQ ID NO: 65762 - protein, 210 aa, Zea mays
  misc_feature: Ceres CLONE 1537437
  misc_feature: SWISSPROT Homolog: EC 2.4.1.214 Glycoprotein 3-alpha-L-fucosyltransferase
  misc_feature (199)..(199): Xaa is any aa, unknown, or other
AGAPRGGGRSRTSGSPGLQEFVSPLEKSMLLASRLLPPPPSSAAAGSSSSSLRMKGLPLRVYLDLEASRKPTGFEDIFVGYHASDDVQVTYAGKSFHTSRSYHISTEKRNDALIYWSSSRCLPHRDKLAKDFLSLVPHHSFGRCLNNVGGPDMALSMYPVCSTNDNGTPHWWDHLHCAMSHYKFVLAIENTQTESYVTXELFYALEAGSV

SEQ ID NO: 65763 - DNA, 688 bp, Zea mays
  misc_feature: Ceres CLONE 1537443
  misc_feature (224)..(224): n is a, c, t, g, unknown, or other
  misc_feature (301)..(301): n is a, c, t, g, unknown, or other
  misc_feature (325)..(325): n is a, c, t, g, unknown, or other
  misc_feature (345)..(345): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (436)..(436): n is a, c, t, g, unknown, or other
  misc_feature (469)..(469): n is a, c, t, g, unknown, or other
  misc_feature (484)..(484): n is a, c, t, g, unknown, or other
  misc_feature (524)..(524): n is a, c, t, g, unknown, or other
  misc_feature (561)..(561): n is a, c, t, g, unknown, or other
  misc_feature (562)..(562): n is a, c, t, g, unknown, or other
  misc_feature (602)..(602): n is a, c, t, g, unknown, or other
  misc_feature (618)..(618): n is a, c, t, g, unknown, or other
  misc_feature (620)..(620): n is a, c, t, g, unknown, or other
tccccgcggtggcggccgctctataactagtggatcccccgggctgcaggaattcctctcacccctagaaaaatctctctctctctctctcttcctgcgcccacacgcacgtttccactccgaccgggccagagccccgccgggcagtttccgttcgctgttgcgatccacctcctgcctgcacatcccctcccccgagttcgagccggagggccgaagagtanatccggcggcggccaaaggatggccctcaactgggaactgcggggttgctttttcccccaccggaggatcttcatcnccccgcctccggtttctttcccgncgatatttttcttcttttgnannnactttttttttcccccccccgggggaaaagaaaagggggnannnnnnaatacctttccccccctttccttttatctaaaatataaanaattttacaactatagtgggggggcggcggaancgagggttggccccntattacaatttggtcttcgactttaaatcacctaaacttnggttgatatacacttccgggggtttttacctctttgnngacatgactcttattttgacggtgttccttactatctttncaactcctatcatctncntccaccgtcgtcccccctacgcctaacccctcccgctccccctcttccttctgccccacccctccctg

SEQ ID NO: 65764 - DNA, 675 bp, Zea mays
  misc_feature: Ceres CLONE 1537448
  misc_feature: Translation starting site: 213
  misc_feature (654)..(654): n is a, c, t, g, unknown, or other
acagctggagctccccgcggtggcggccgctctagaactagtggatcccccgggctgcaggaattcgtctcacccctagaaaaaagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggaatcgtgggtgcggaacccgttcaccatcttcgggacggcggtggccgccgacgcgtggctggccagcgacacttcggcgttcgccaacacgcacatcgagagccgggacacggcggccgcctacctgttcagggccggcgctcccgccgggcgtcaagaagaacaacgtgacggtgaaactggacgagggcaacgtgctggtcatcgccggcaaacgcaacgtgtgcccccagaagccaaccaacgggtgcccccccatcaagcgcagccgcgccacctttcctgccagggttcaacctgcccaaggaacccgcccttcaaacggcttcagggccccccttggaacccccggcaggctcccctcttcacccggcccccaaggtcggggggcccccccccttccntaattagggtccccaaaaaag

SEQ ID NO: 65765 - DNA, 660 bp, Zea mays
  misc_feature: Ceres CLONE 1537449
  misc_feature: Encodes the peptide sequence at SEQ ID NO. 65766
aaagctggagctccccgcggtggcggccgctctagaactagtggatcccccgggctgcaggaattcgtctcacccctagaaaaaaggagatcagagccccggcgaggtcgcaccgcaccagccatcgtctccttccttccttcctatactaccatccaaccagctgcccagcgcaaggttacctgcccgacatccgacaagccagtccatccggctgcgagcaaaggtctgagatgggttccgtagacgcggcaatcgcggtgccagtgccggcggcggaggagaaggcggtggaggagaaggcggtggtgttccgttccaagctccccgacatcgagatcgacagcagcatggcactgcacacctactgcttcgggaagatgggcgaggtggcggagcgggcgtgcctgatcgacgggctgacgggcgcgtcgtacacgtacgcggaggtggagtccctgtcccggcgcgcctcgtcggggctgcgcgccatgggggtgggcaagggcgacgtgatgatgagcctgctccgcaactgccccgagttcgccttcaccttcctgggcgccgcccgcctgggcgccgccaccagcacggccaacccgttctacaccccgcacgaggtgcaccgccaggcggatgcggccggcgccaggctca

SEQ ID NO: 65766 - protein, 142 aa, Zea mays
  misc_feature: Ceres CLONE 1537449
  misc_feature: SWISSPROT Homolog: EC 6.2.1.12 4-coumarate--CoA ligase
MGSVDAAIAVPVPAAEEKAVEEKAVVFRSKLPDIEIDSSMALHTYCFGKMGEVAERACLIDGLTGASYTYAEVESLSRRASSGLRAMGVGKGDVMMSLLRNCPEFAFTFLGAARLGAATSTANPFYTPHEVHRQADAAGARL

SEQ ID NO: 65767 - DNA, 785 bp, Zea mays
  misc_feature: Ceres CLONE 1537450
  misc_feature: Encodes the peptide sequence at SEQ ID NO. 65768
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (20)..(20): n is a, c, t, g, unknown, or other
  misc_feature (21)..(21): n is a, c, t, g, unknown, or other
  misc_feature (39)..(39): n is a, c, t, g, unknown, or other
  misc_feature (44)..(44): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
nnnnnnnnnaaaaaaggttnnaattaagcgcgattttanccccnttnnttncaaagctggagctccccgcggtggcggccgctctacactagtggatcccccgggctgcaggaattcgtctcacccctagaaaaaaatgctgtccaacaccgccaggagcgccgggatcaaggccgaggtcgccatcaccatccccaaacgctgcaacctcgccgaccgccccgttggctacaagtgcggagattacaccctgccatgagcggcggtgagttctccaggccggatttgctgcatggcatgcccgagtatcagtgtatcaccgaagcgcgagcgcctcttgtgtcgagcgagtccgtgtctgtcactcagtctctatgtgttgcccataatacaccccacaagcgagtaccagacatgtgcaactcctagtagaatggtcgcgtgttatcactaggttacgcgtacctccctatatttgttgttccatttaaaggaccatacaacattgttacccctcgctttggccgaagaaaaaaaactgcgccacccccttcgctccctgacattggacccccccacaactaaaaccgacacccccccggaggtaaccccaatttcccccccaattagaggaattcagtaattaccctccgcactctacccgcgtccccgactctacctccaaatctaccatacaccctgaaaaacaaaccctgtgggatttttaccccaacccttactattcgtccctttttaaagaccaaataacaccccctttatttact

SEQ ID NO: 65768 - protein, 40 aa, Zea mays
  misc_feature: Ceres CLONE 1537450
MLSNTARSAGIKAEVAITIPKRCNLADRPVGYKCGDYTLP

SEQ ID NO: 65769 - DNA, 655 bp, Zea mays
  misc_feature: Ceres CLONE 1537452
  misc_feature (655)..(655): n is a, c, t, g, unknown, or other
aaagctggagctccccgcggtggcggccgctctagaactagtggatcccccgggctgcaggaattcgtctcacccctagaaaaaatggcgtgagcgccggggcaaggcaagtagccgctgcgcggtgctgccacctgacctgactgcggtcccggtccccggtccatccgaacgccgttacggggccgcccaccgcgacggaacggaaaggggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggacggtttcggcagcttgtcgaggagaagctttgaggtgaccctcgcaagcatttatggccttactgggcatcacaaagggaagacccagagctcatcacatgtgctcgacgactcaccttccataattcgtgaaagtcgatgggcgaatctgcctcctgaactcatccgtgatatcttacggagactggaggctgatgagagcacctggccagcgcggaagcacgtcgtttgcttcgcagctgtttgtaggacatggagagaaatgtgtaaagagattgtgttgagcccggn

SEQ ID NO: 65770 - DNA, 655 bp, Zea mays
  misc_feature: Ceres CLONE 1537453
  misc_feature: Encodes the peptide sequence at SEQ ID NO. 65771
  misc_feature (449)..(449): n is a, c, t, g, unknown, or other
atagctggagctccccgcggtggcggccgctctagaactagtggatcccccgggctgcaggaattcgtctcacccctagaaaaatgaatgtatgacgtatgaatcgctagtcaactagcgcgccggcaccgccaccgccgccgccgccagcgcgcccgtctcgcacgcgcagcacaggacgcgcgcgatcccctcgcgtccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctccggtccccctgcccgtccggcccggggggcaggctgcccccgcccccgccgccgcgatcgtacggcggcggcggcggatctggtggcgacgcccgntaatccggcggcggccaccgagataagggaatcctcaggctcttcctcgccgtgtggatcgaccgggtcgccgccgactctcacttccctttcaacgcgctcatgtaggcactcgagagctgtcaccgatgcgtgcaactcgacatacactcccgtctcgacttcggtagcaaagggctcgacttcgtcttctgaaacactctact

SEQ ID NO: 65771 - protein, 80 aa, Zea mays
  misc_feature: Ceres CLONE 1537453
MASTAFAAAKYFPAHLDSSPRIAPRRAAPTASLSFSPLSASPSSLLRLRSPCPSGPGGRLPPPPPPRSYGGGGGSGGDAR

SEQ ID NO: 65772 - DNA, 426 bp, Zea mays
  misc_feature: Ceres CLONE 1537467
gggtccgggggggcgcttgaataggatccgggctgagattctctccccctagaaaagcgaccccggtcagtcgggactacccgctgagtttaagcatataaataagcggaggagaagaaacttacgagggattcccctaagtaacggggcgagcgaaccggggagcagcccagcttgagaatcgggcggcctcgccgcccgaattgtagtctggagaggcgtcctcagcgacggaacgggcccaagttctctggaaaggggaccccttgggaagggtgaaaagcccccgtcccgggcccgggaacccccggtcgcaacccccgaaggcgccccgtccaaaccaaaatcccggggttttttttttggggaaaaaggggcaagccccccaaaaattcggggggggggggggaaaaaaacccccccccg

SEQ ID NO: 65773 - DNA, 739 bp, Zea mays
  misc_feature: Ceres CLONE 1537470
  misc_feature (1)..(1): n is a, c, t, g, unknown, or other
  misc_feature (43)..(43): n is a, c, t, g, unknown, or other
nggtttgttttttgaaatggcgctttcccaagactgccggtgnccctcccaaaaaactaatggtactcaccgcggtggcggccgctctcaactagtggatcccccgggctgcaggaagtcgtctcacccctagaaaaatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcgacagttattatcaatggcttagtctcttctagctgttctattgttcttgtatcttgagcggacaactggtttctagggcaccttgaaatctgtctacgagatctctaagaattatgagatgacatatgaccccctattgcttttgttcactttgctaaaactgaaagtccgagttcccccccaaaaaaaaaaaaaaaacgaagacgctcgaggtaccccaattcgccctatagtgagtcgtatttcccccgcctccccggggcgttcgtttttcaaacgttcctggactggggaaaaacccccgggggtttcccccaacttttattccccctttggatgaaaaattcccccccttttccacccaaggttgggggggttatataagccgcaaaaaaggggcccccgctaacccgtattctcggccccccttt

SEQ ID NO: 65774 - DNA, 659 bp, Zea mays
  misc_feature: Ceres CLONE 1537471
  misc_feature: Encodes the peptide sequence at SEQ ID NO. 65775
aaagctggagctccccgcggtggcggccgctctagaactagtggatcccccgggctgcaggaattcgtctcacccctagaaaaaaccctcataccaggcggcagcaaaatccagtgacctccccatgacagtttcatcagaagaccaagatgcctccagggaagacatccacacggctcacccgaaaatccgaagaaattgacacaagatatgaagcgccaaatgaggtatagactgaaacagaagtacttcaatgggatatctgcaaatcaagtgaggactacatcgcctatttcaagcatgtctgacaattagtggagaaagttggtggagaagttgtctgccccaaatcacaaggtacttgccattgaccattctataaattacacaggtttctttgatctgttggatatatcgtattaggtcagcctgctagctactgcaaatctttgatctggaacaacaagctatattgtttggagctatatctgtaaaacaacaacctttgatcactgtggagcttttcttgacatgtttctttgatctgaaaaacaacaattatacatatatttgtttacacagtcaaataagcattgcatgggcgaacagttttgtttggctagccaaaagtaatggaaaaagggaaatacaatgtgaca

SEQ ID NO: 65775 - protein, 34 aa, Zea mays
  misc_feature: Ceres CLONE 1537471
MKRQMRYRLKQKYFNGISANQVRTTSPISSMSDN

SEQ ID NO: 65776 - DNA, 627 bp, Zea mays
  misc_feature: Ceres CLONE 1537472
  misc_feature: SWISSPROT Homolog: EC 3.2.1.23 Beta-galactosidase
ccccgcggtggcggccgctctagaatagtggatcccccgggctgcaggaattcgtctcacccctagaaaaaacacccacaaggaaggcgacctgtactagggctagggctttccaatttggcgagggacaaaaaatgctctcgagtggtgtgttgtcaagcaaagctcctccatctgcgccctaccccgttgtgcgaactgtttggcatcaaacttgtgtggttgctatcttctatgttctgctagtttatgttcggagtccgtgggaatatactagctaattaataaaaagaaaaactgatgtgatgccataatagtataatgtcatggctttttgttatgtttggagaagtgatgttgtaagctattgattctgaataccactgcggcattgttggcatccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttccccaacagtgcgcagcctgaatggcga

SEQ ID NO: 65777 - DNA, 632 bp, Zea mays
  misc_feature: Ceres CLONE 1537477
  misc_feature (590)..(590): n is a, c, t, g, unknown, or other
ggagctccccgcggtggcggccgctctagaactagtggatcccccgggctgcaggaattcgtctcacccctagaaaaaggacggggttgacgggcgatcaagaagcctcgtggcctaggccagtggcccacattgcacatggtgggtgcgctggcttaccatctccccaagtgggagagtggacgtcataatttgtggtagagggggtacgcgttcgcgcggcccccgccaaatcttataaatttcatgtaagtccccttatctgaagggcttgaaatgttatctttatttcgccacattttataaattataatttaatttttcgctttctaagaagggataccgtaagtaatcctggactgcatttaagtttcgtaagtcgtcctggagtgcatcaaagtttatctttgtgagatgttagaaagcagtatttaaaattaggtccagttacttatgttattacaattctgaatattcgataaaaaaaaaaaaaaacgagacgctcgaggtacccaattcgccctatagtgagtcgtattacgcgcgctcactgcccgtcgtttacaacgtcgtgactgggaaaaccctgncgtaacccaacttaatcgcctgcagcaatccccctttcgcag

SEQ ID NO: 65778 - DNA, 658 bp, Zea mays
  misc_feature: Ceres CLONE 1537483
  misc_feature: Encodes the peptide sequence at SEQ ID NO. 65779
  misc_feature (367)..(367): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (543)..(543): n is a, c, t, g, unknown, or other
  misc_feature (545)..(545): n is a, c, t, g, unknown, or other
  misc_feature (548)..(548): n is a, c, t, g, unknown, or other
  misc_feature (570)..(570): n is a, c, t, g, unknown, or other
  misc_feature (595)..(595): n is a, c, t, g, unknown, or other
aaagctggagctccccgcggtggcggccgctctagaactagtggatcccccgggctgcaggaattcgtctcacccctagaaaaaattatatccaacaaccagcagtgcaacaaagcaaagatttacctgcccatcgatcatatcgtcaaactggtccggcaagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacntcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattcgnnncccncntcncccgcttgataggattaaatanaacccaacccccccccgcctttctnacaactccaagaaaagcgcaaaaaaaaaataaaaccccaacccccccgggggcacccatttcg

SEQ ID NO: 65779 - protein, 73 aa, Zea mays
  misc_feature: Ceres CLONE 1537483
  misc_feature (14)..(73): Pfam Name: potato_inhibit Pfam Description: Potato inhibitor I family
  misc_feature (65)..(65): Xaa is any aa, unknown, or other
MSSTECGGGGGGAKTSWPEVVGLSVEDAKKVILKDKPDADIVVLPVGSVVTADYRPNRVRIFVDXVAQTPHIG

SEQ ID NO: 65780 - DNA, 615 bp, Zea mays
  misc_feature: Ceres CLONE 1537489
  misc_feature: SWISSPROT Homolog: EC 3.2.1.23 Beta-galactosidase
  misc_feature (210)..(210): n is a, c, t, g, unknown, or other
  misc_feature (213)..(213): n is a, c, t, g, unknown, or other
tacccgcggtggcggccgctctagaactagtggatcccccgggctgcaggaattcgtctcacccctagaaaaaacgcagctgcgcagtgcgcacagagcgaactattctttcgccttttactaaagaataccgtgtgtgctctgcacatagcagcatacgcttatttttggaggggatccttctttttggggggccccattatacaaatnaanaaaaaaaaataaaaaaaaaaaaaaaaaaaaaaaaaaaaaaaaaaaaaaaagaaaaaattgaaaaaaaaaaaaaaaccgagacgctcgaggtacccatttcgccctatagtgagtcgaattacgcgcgctccttggccgccttttaacaacgtctagactggaaaaaccctggggttacccaatttaatccccttggagaaaatccccctttccccagttgggcgtaatagcgaaaaaaggcccccaaccaaatcccccttcccaaaaagtttgcccacccctaaatggccaattgaaaattggtaacccgttaaattttttggtaaaaattccgcggtaaaaatttttttgtaaaaaccaccctcattttttttttaaccaattagggccccaaaattccgg

SEQ ID NO: 65781 - DNA, 645 bp, Zea mays
  misc_feature: Ceres CLONE 1537492
  misc_feature (210)..(210): n is a, c, t, g, unknown, or other
  misc_feature (229)..(229): n is a, c, t, g, unknown, or other
  misc_feature (233)..(233): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (349)..(349): n is a, c, t, g, unknown, or other
  misc_feature (373)..(373): n is a, c, t, g, unknown, or other
  misc_feature (394)..(394): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (640)..(640): n is a, c, t, g, unknown, or other
tggagctccccgcggtggcggccgctctagaactagtggatcccccgggctgcaggaattcgtctcacccctagaaaaagcttgattgttccaggtattagcagtcgaccggttcctcggagcacgatgaagtttgttgctgcctacctgcttgctgtcctcgctgggaacgccagcccctccgctgacgatttgactgccattctggangtcagtttgggcctggtgnaagntttgaacaatgaaaaagnnnaatttttggggnnnnnaaaaactcctgctgtcccaactgagcgggtaggacatcaccgagctcatttgccgcgggcagggagaagtttgctttccntccccatgtgggtggcgggccggntgttccccttgtttgccggcnagccttggcaaccctggcttgccttgggccgggaaaactttggcttcccctgccaaacctttaaaaaagcacaaagaaaaaaaaaaaaaaaaaacccaaaacccccctcccagggggaaccccccaaattttccccccccctttaagggggaagcccctaattttaacncnncnaaggcccagcggggcgcggccccttttttacacaaccccccctggaattgggaaaaaaaaaacacccctggngggcg

SEQ ID NO: 65782 - DNA, 609 bp, Zea mays
  misc_feature: Ceres CLONE 1537493
  misc_feature: Encodes the peptide sequence at SEQ ID NO. 65783
agtggatcccccgggctgcaggaattcgtctcacccctagaaaaaaactttttgttcctcgcgccgccgccgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgcttttagcttttcgttcagaacttgagactcatgtgttaaactcgacttgttaaaagttttgataggctactttgtgcttgtttggaccaagctataatcccaaagattgaaatttttctcacccaaaaaaaaaaaaaaaaaacgagacgcctcaaaggttccccaatttccccccctataggtgaggtcgttaattaaggcggcgcttaacctgggcccgttcgtttttaacaaacggtcgag

SEQ ID NO: 65783 - protein, 56 aa, Zea mays; identical to SEQ ID NO: 1999
  misc_feature: Ceres CLONE 1537493
  misc_feature (3)..(56): Pfam Name: Ribosomal_S14 Pfam Description: Ribosomal protein S14p/S29e

SEQ ID NO: 65784 - DNA, 662 bp, Zea mays
  misc_feature: Ceres CLONE 1537494
  misc_feature: Encodes the peptide sequence at SEQ ID NO. 65785
atagctggagctccccgcggtggcggccgctctagaactagtggatcccccgggctgcaggaattcgtctcacccctagaaaaagtacacgatccagcccagcgccacctccgagcacctccgcgccgccatcatcgactacgtccagcgcctcttggcgtcccactccggggttcaggtctttccatttggatctgttccattgaaaacttatcttcctgacggagacattgacttgactacattcggccctgcaatttctgatgaaaaactagcaaatgaagtatgtgctattctaaaatcagaagagcataggaaagattctgaatttgatgtcaaagatgtccagtatatccatgctgaggtcaaactggtgaaatgtgtagtacagaacattatagtagatatctctgtgaatcagattgggggactctgtacactttgttttctggagaaggttgatgagaattttggaaagaaacacctcttcaaaagaagcgtaatgctgattaaagactggtgttactatgaaactcgcattcttggtgcacaccatggattgatatctacctacgctttggagattttagtgctatacattttccatatcttccataagtctttgaatggcccattagctgtcctctataggtttctcgata

SEQ ID NO: 65785 - protein, 53 aa, Zea mays
  misc_feature: Ceres CLONE 1537494
MLIKDWCYYETRILGAHHGLISTYALEILVLYIFHIFHKSLNGPLAVLYRFLD

SEQ ID NO: 65786 - DNA, 655 bp, Zea mays
  misc_feature: Ceres CLONE 1537497
  misc_feature: Encodes the peptide sequence at SEQ ID NO. 65787
aaagctggagctccccgcggtggcggccgctctagaactagtggatcccccgggctgcaggaattcgtctcacccctagaaaaaatccatcccatcgccactccactcgcactcggccaagaaagaagcggcaggtcactgcccactgctgctccaggagcgagaaaggccagccaaggagggagctttgctttcaggaggagaggagcggcgaggtgggcggcgggcgccatggccgcagcgccgcgtagtcttgtcacctgcagcggcgggggcagtagcagtagtcgcatcctgctcgccgtcttcgtggcggccgccctcttggcggccgcggccaatgcggctgtctcgtacgaccaccgctccctcgtcatcaacggccgccgccgcatcctcatctccggctctatccactacccgagaagcgcccccgagatgtggcccgggctgatccagaaggccaaggacggcggcctcgacgtcgtccagacctacgtcttctggaacgggcacgagccggcgcaggggcagtactacttcgccgaccgctacgacctcgtccgcttcgtcaagctcgtcaggcaggccggcctctacgtccacctccgcgtcggcccctacgtctgcgcggagtggaacttcggtggctttc

SEQ ID NO: 65787 - protein, 141 aa, Zea mays
  misc_feature: Ceres CLONE 1537497
  misc_feature (46)..(141): Pfam Name: Glyco_hydro_35 Pfam Description: Glycosyl hydrolases family 35
  misc_feature: SWISSPROT Homolog: EC 3.2.1.23 Beta-galactosidase
MAAAPRSLVTCSGGGSSSSRILLAVFVAAALLAAAANAAVSYDHRSLVINGRRRILISGSIHYPRSAPEMWPGLIQKAKDGGLDVVQTYVFWNGHEPAQGQYYFADRYDLVRFVKLVRQAGLYVHLRVGPYVCAEWNFGGF

SEQ ID NO: 65788 - DNA, 656 bp, Zea mays
  misc_feature: Ceres CLONE 1537510
  misc_feature: Encodes the peptide sequence at SEQ ID NO. 65789
atagctggagctccccgcggtggcggccgctctagaactagtggatcccccgggctgcaggaattcgtctcacccctagaaaaagcctccctcacgttggatttaagcagcgcagaggagagcaaccactcgcccgccgctcgcccaccacgatctccctcccctccgcacgccgcacggggcgttgcagacccagccaaaggcaagccgcgaaccggagcacgccggccggtcgcgggcgtcgtcgtcgccgcctcccgcgccgccgccctgctgctcgctcccgcattggatcgcgctacggttggcgactcggtgtggtctgctgctggtcactgcgcggctgcgcctagccggcccacgcggagacggcatcaagtttctaacaatttgaagtatcctgaaatgggcgcaagagataacggggaggggagagatgagaagagggggactggatcagattatgtacctgctagagactccttttcatcacaaggtgagtctcgggttccaaagaggctcggtaaaaaggagtcaaaagataatagcccccgaatgaccaaaagcagcgccatccgtcaagctcaaaacaagctgcaacatagaggattaaacaatgtacagaacaagcctcagaaacaaaagaaaacagttag

SEQ ID NO: 65789 - protein, 83 aa, Zea mays
  misc_feature: Ceres CLONE 1537510
MGARDNGEGRDEKRGTGSDYVPARDSFSSQGESRVPKRLGKKESKDNSPRMTKSSAIRQAQNKLQHRGLNNVQNKPQKQKKTV

SEQ ID NO: 65790 - DNA, 627 bp, Zea mays
  misc_feature: Ceres CLONE 1537511
  misc_feature: Encodes the peptide sequence at SEQ ID NO. 65791
atagctggagctccccgcggtggcggccgctctagaactagtggatcccccgggctgcaggaattcgtctcacccctagaaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcaactccgacgggaactggaggaactgagcggtggggcccgcgcggccaagttatcctgttcgctaccgtgttgtttaccctagtccagagggtttatcttcgttcgtctcatgtttgttgtt

SEQ ID NO: 65791 - protein, 115 aa, Zea mays
  misc_feature: Ceres CLONE 1537511
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGNSDGNWRN

SEQ ID NO: 65792 - DNA, 639 bp, Zea mays
  misc_feature: Ceres CLONE 1537516
  misc_feature: Translation starting site: 246
  misc_feature (451)..(451): n is a, c, t, g, unknown, or other
ggagctccccgcggtggcggccgctctagaactagtggatcccccgggctgcaggaattcgtctcacccctagaaaaaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacaagcgcatgtcccacgaggggcaccgggctgagcctcgggctcagcaacaacctgctggggtggatcctcctgggggtcttcggcctcatctggtccctctacaccatctacacctctgacctcgaccaagacgaagagtccggtggcctctcgctctaaatccacctcctctccctgtaatgatctgaatgtaaacatggtgggtgtcatncggtgtaaatttagacatggctatttgcatctaagaatcatcctctcctgtcaaaaaaaaaaaaaaaacgagacgctcggagtacccaattcgccctaaagggagtcgtattacccgcgctcattggccgtcctttttacacgtctggactgggaaaaaccttggggttaccaacttaaatcccttgc

SEQ ID NO: 65793 - DNA, 640 bp, Zea mays
  misc_feature: Ceres CLONE 1537522
  misc_feature: Encodes the peptide sequence at SEQ ID NO. 65794
tggagctccccgcggtggcggccgctctagaactagtggatcccccgggctgcaggaattcgtctcacccctagaaaaacagactgcgatcagagcagcgagagagagagagagagagagagcaactgagcaagcaagcaaggaagcaagcaagcaatcggagcgatggagcacgggtacccctgcaacggctgcggcaaggagaagcggccgccgctcaagaggggccagctcaagctgcagatcgcccaggaccctgctcggcagcctcgcgggcgccggtcgccaagaaccgggaccgtgccttcgggagataggccgcccgtgccgtggtagcaggagtagagtagtagctagctgaggacatgcgtcggtcgagtggcggcggactgtgccgtctgtacgaactgatgagcttttgtcctccctctctttctctcttttaaaaaagagcgtgttgcacaaaaaaaaaaaaaaaacgaaacgctccgagtacccatttcgccctatagggagtcgtattaccccccctcctgggccgtctttttacaacgtcctgactggaaaaaccctgtgcgttacccaatttaaatccccttggaagaaaatcccccttttccccaagtttggcaaaaaaaca

SEQ ID NO: 65794 - protein, 56 aa, Zea mays
  misc_feature: Ceres CLONE 1537522
MEHGYPCNGCGKEKRPPLKRGQLKLQIAQDPARQPRGRRSPRTGTVPSGDRPPVPW

SEQ ID NO: 65795 - DNA, 785 bp, Zea mays
  misc_feature: Ceres CLONE 1537525
  misc_feature (1)..(1): n is a, c, t, g, unknown, or other
nttctttttttctttttaactaaatcataatatcaaaaaaaactcataaaaaaacggcactacccacaaagacagccgctctaaactagtggatcccccgggctgcaggaattcgtctcacccctagaaaaacccctagaaaaaatgaccactccaatgtgaattacgatgtgtttctatctgtgtactctcaacgtagaacagaaaatgtatgtagctaaccgtggtaatgaatggaaatatgtaaatattactggcgcatacttcagatttcaagtgatttcaacactgagattgccaccccaacggttggtgataagttcacgtcagaaaaaaaaaaaaaaaaacgagacgctcgaggtacccaattcgccctatagtgagtcgtattacgcgcgctcactggccgtcgttttacaaacgtcgtgactgggaaaaccctggccgttacccaacttaaatcgccttgcagcacatcccccctttcgcccagctgggggtaaatacccaaaaaggccccgccaaccgattcgcccttcccaaacagtttgccgcaaccccttgaatgggcgaaatgggaaaattgtaaagccgttaaaaatttttggttaaaaaattccgccgttaaaaattttttggttacaaatccaacctctatatttttttttaaccccaaataaggcgccaaaaattctggccaaaaaaacccccttttaaaaaaatccaaaaagaaaataatcaaccgcaaaaaaaaggggtgttgaaaacatgtttttgtcttccag

SEQ ID NO: 65796 - DNA, 847 bp, Zea mays
  misc_feature: Ceres CLONE 1537526
  misc_feature: Translation starting site: 133
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
ggagagaagtatatctttncccccgatatattnncnngggtttcccccccaaacatggaactcaccgcggtggcggccgctctacactagtggatcccccgggctgcaggaattcgtctcacccctagaaaaatgatggagctggaagctgaagtggcaaaacttaaagagctgaatgatgaattgcagaaaaagcaggttgaaatgttggagaagcaaaagaatgaggtcctggagaggatgagacggcaagttgggccaacggcaaacagaatttgtctgcggaggacattgacagggaccatgaggagctgtacacccgtacggctgtacctattaccagtatatatgtaataagtgaaggtgaacactcaaaggccacaacttgcccggtttgacacagccatttactcctggaccctcggttctcttccggcgcgttggattggcctggttgatccccacctccctacggttcccccccccttttgcctctccccaaataatggcccatggcaccccataaccaaagctccggggccgcctatatatttcacccccatttcctccttttcctttagcgcccttctcccctggccccacgtttccccactttactttcctcagcccaacaacatcatttctcccctcccgtccttctcgggttcccccacactttgcaccgcctattttggagagcccccttatattcactatgtcgccccccaccccatggtgcccacgcctatattttacaccccctccttcatctctctacccgcgagcaacacaccaccccaggcggatgtaccccaccttcacataagaacgtgttgctgtcttagct

SEQ ID NO: 65797 - DNA, 752 bp, Zea mays
  misc_feature: Ceres CLONE 1537527
  misc_feature: Encodes the peptide sequence at SEQ ID NO. 65798
ttttattatatttattttttttatatctaattctacccgttccccaaccaataaaaaaacgggagctccccgcggtggcggccgctctagaactagtggatcccccgggctgcaggaattcgtctcacccctagaaaaaataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtccatagttcaagaagttgatactatatacttatgcttgtctctgtatagcctataagtcctaattcaaataacaggtgctgcttgcagcccttggaaatttgcggatgcggagtgaatttaccatgggatcctttgcttaaaaataaaaaattaatgtgggttatgagggaaaggtggtaattttggtgggaacaattattttgccaaacattggaggtttataaaaaaaaaaaaaaaaaaaaccaaaaacgcctctccagggaaccccaaatttttccccccttataaaaggggaggttcataatataaccgcgccccgcttctcact

SEQ ID NO: 65798 - protein, 74 aa, Zea mays; identical to SEQ ID NO: 56369
  misc_feature: Ceres CLONE 1537527

SEQ ID NO: 65799 - DNA, 770 bp, Zea mays
  misc_feature: Ceres CLONE 1537531
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
cccattgcttactttccctanaccacccaaaaannnnnnnnnnnnnnnnnnntaaatctggagctccacgcggtggcggccgctctagactagtggatcccccgggctgcaggaattcgtctcacccctagaaaaaaaaggggctctcaaagggccttccgtgacgccggggaccagcggccatgcgtctcctctcctgtcgcgctctcgtccatcacaatttgtgcaggtaaagtgtttgagaagacaaaatattattctttggggagagtgcataaatcttcgataagcgaaggaatgcagtctatcagatgatgaaaagcagaaggaatcccttctcagacagtgaaatccaaaactggtgctttcaaatatttcaagatctgatttacatacattaacatggatatttccgctgccacccccaaccgggaggggtggggtttgcatttttttacaaccaatgttccccacccgccgatctatgaattccctgtttggctgtggaaacaggtttctagcccccaaccctcttttaaccatggaacttttttaaaaccacaaaaaaagctcctcccctggtcaccttcaatcctccccggtctcaaaaatcctccccggggtattttcgcaccttgtaggcgacctttttcttctattcccccacatcaatacacatccggtaaaccgtctctcccgggtcacccccccaattctgctccccttacatccacggaccccctcgtacttaaacccggccccgcgacctg

SEQ ID NO: 65800 - DNA, 701 bp, Zea mays
  misc_feature: Ceres CLONE 1537539
  misc_feature (7)..(7): n is a, c, t, g, unknown, or other
  misc_feature (12)..(12): n is a, c, t, g, unknown, or other
  misc_feature (18)..(18): n is a, c, t, g, unknown, or other
  misc_feature (53)..(53): n is a, c, t, g, unknown, or other
ttttttnttttntttttntaattctttatttgtcctttcatatgggtatattnaaaaaatggagctccccgcggtggcggccgctctagaactagtggatcccccgggctgcaggaattcgtctcacccctagaaaaactctccctccctccctcactgcctaaaacatttttttctttgcttgaagcaagcaccttcccctttctctgcctccctctcccctccatatatacgccattgtggcgctccgctagtctcgcgcgacgcccatgggggagggggggcctgatctaatgtaggggcaggaggaagcccttccactgttccatctctttcccggagtaggtggtgggcacgacgaaggcccctcgcccccaccagattcgtgcaactcggcgcctcatccgatcagcaccggccgcccaacgcgctacagacgcgctgccgcgtcgggactctggaggacacggcggcggcttggtggattgtgggagggagggccttctcttggatttctgatgtcgaggacagggtcttgtattagctagctattcactggatgttggcgatggggacagaagagtgggagctctatccttgttcctacagcgggctcacaggtgataaagtacagggccggtctctgaaagacccaaaacgggcgaggacgaccagaaacggggcccaacgtggccagtgtc

SEQ ID NO: 65801 - DNA, 656 bp, Zea mays
  misc_feature: Ceres CLONE 1537543
  misc_feature: Encodes the peptide sequence at SEQ ID NO. 65802
  misc_feature (382)..(382): n is a, c, t, g, unknown, or other
  misc_feature (392)..(392): n is a, c, t, g, unknown, or other
  misc_feature (471)..(471): n is a, c, t, g, unknown, or other
  misc_feature (517)..(517): n is a, c, t, g, unknown, or other
  misc_feature (525)..(525): n is a, c, t, g, unknown, or other
  misc_feature (542)..(542): n is a, c, t, g, unknown, or other
  misc_feature (549)..(549): n is a, c, t, g, unknown, or other
aagctggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgcccgcagcanggagacggcngcggcgtgtcctcccggtcggctccccggcgcacgtgcggctgccgaagatcagctgcagcgccaccgaagaagtcagncggcgccgtgtcgtccgtcaccgtggagaagatgctcacggtgacngcgtccgntgaaggcgtcgccgggncatcggncagatgtacttccagcgcgccgtcgacgacatcgggcgacctcctcgggcagacgctgctgctcgagctcgtcagctccgagctcgacgcaaagtcgggcgtggaga

SEQ ID NO: 65802 - protein, 51 aa, Zea mays
  misc_feature: Ceres CLONE 1537543
  misc_feature (8)..(8): Xaa is any aa, unknown, or other
  misc_feature (14)..(14): Xaa is any aa, unknown, or other
  misc_feature (16)..(16): Xaa is any aa, unknown, or other
MLTVTASXEGVAGXSXRCTSSAPSTTSGDLLGQTLLLELVSSELDAKSGVE

SEQ ID NO: 65803 - DNA, 665 bp, Zea mays
  misc_feature: Ceres CLONE 1537546
  misc_feature: Encodes the peptide sequence at SEQ ID NO. 65804
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (25)..(25): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (54)..(54): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
ccctcttgttctnngngnnntnttntttnannctggcgccgccccgccccaacncnnnnnnnnnanttaaaactggagctccccgcggtggcggccgctctagaactagtggatcccccgggctgcaggaattcgtctcacccctagaaaaagtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaaatgaagtcgctgccgtcatttttgggtggttggaaccgggaattcagcttttttccctctcacaaagcacaaggggccaccccctggcttgttccctatttgggaaggaagttaaacaggctttaattggataatccccccatggaaccaaacgggttttccaaat

SEQ ID NO: 65804 - protein, 84 aa, Zea mays
  misc_feature: Ceres CLONE 1537546
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFSARGAVSSTQCVLTSDAGPDTLVVRTSFRRNYADPK

SEQ ID NO: 65805 - DNA, 613 bp, Zea mays
  misc_feature: Ceres CLONE 1537585
  misc_feature: Encodes the peptide sequence at SEQ ID NO. 65806
ggtggcggccgctctagaactagtggatcccccgggctgcaggaattcgtctcacccctagaaaaaaataattgacttgacctcacttcccctgtggggaggcttttcttccgatcgatcatagtatccgctgcggtgtgactgcctgccccaccccattgcgcctgcgcctcgcttcatccggtgcgctgcccacctcactcccgtcgtcctcgttctcgtcgcggagcggtgtggaggcgcgcgctcctggaaggcacggggcaagagcggaggtgagtgagcccgagccccgtggattgctggttcggtggtcggaactcgtggagtagcaagagcggcggcggttacgacatctcacgccagcacgaggacgccgaattcgcgattggcttaggcggtgtgtgtggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggaga

SEQ ID NO: 65806 - protein, 47 aa, Zea mays
  misc_feature: Ceres CLONE 1537585
MGQKDSKPSHGYGYSSYDYGSASSGYTSRNTGNSSSSYSVRYAPSSE

SEQ ID NO: 65807 - DNA, 648 bp, Zea mays
  misc_feature: Ceres CLONE 1537596
aaagctggagctccccgcggtggcggccgctctagaactagtggatcccccgggctgcaggaattcgtctcacccctaaaataactctcaccggtctcttcccgaatccgcccgccattcatgcacccttctgtgcactgatcacgccaccattagctcgcatctcacgctcgccactaccattttggtcggttcttgatgaaatcaatcgaaccgatggagtgccacctctggcttaggctgttgcattcttgatttgatctcgatgaggagaggaagcaatggctctgtcgactttctctgtcccaaggggattcctcggtgtgcctgctcatgactcccatttcacttctgcggtcgagctccatgtcgacaagctgctgccaggccaggcctatcattctcaagcctcggccgacgccggtatgcgtgtctacgtctctgtcgtctgagcgcgacgcggattactactcgcagaagccgcccacgaccgctgctggacaccatctactaccccgtccacatgaacaacctgactgtagaagagctgctgcagctggacgacgatctcccgtcctacgtaaatctgccaatctccaagacaagcagtcacctcgagtcctgacctccgagtgacggagctcaccg

SEQ ID NO: 65808 - DNA, 716 bp, Zea mays
  misc_feature: Ceres CLONE 1537599
  misc_feature: Encodes the peptide sequence at SEQ ID NO. 65809
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tttttgtcccntnnnnntnattcatcctcctcataaaatccccnnnnnnaaaaccggggctccacgcggtggcggccgctctttcctagtggatcccccgggctgcaggaattcctctcacccctagaaaaatccggaacggctgaaccgaggcgggcacgtgccaaccacgtgccttacccgccccgcccgcgtcgtccaggtccaaggtccaactcgcgacgcatctcgatggccgccaccgacgacggtgccgtggactccgcctccgccgcggccgcggccagggccgtcgaggaggcgcgcgcgctgctccccgccccggcgccggactacgacgacgaggatctcgaggagcgcgcgtacaaggcggctgagaaggtcatcgtgtccatctcgggcgggccggacccggaggacgtcgacgggaacggcgacggcgcggagctctgctcgtcctccgggtcgtccccgccgcccttctcgtggcggaagctctggctcttcacgggccccgggttcctcatgagcatcgcgttcctggacccgggcaacctcgagggcgaactccacgcgggcgccgtccccggggacacactgctgaggctgctcctgtggggccaccccccatggggcctccatcgtgccagttcctcgcccgcccgcccttcgagggtacgccacgggggccgaccacccttcgcccaagcctctga

SEQ ID NO: 65809 - protein, 161 aa, Zea mays
  misc_feature: Ceres CLONE 1537599
MAATDDGAVDSASAAAAARAVEEARALLPAPAPDYDDEDLEERAYKAAEKVIVSISGGPDPEDVDGNGDGAELCSSSGSSPPPFSWRKLWLFTGPGFLMSIAFLDPGNLEGELHAGAVPGDTLLRLLLWGHPPWGLHRASSSPARPSRVRHGGRPPFAQAS

SEQ ID NO: 65810 - DNA, 659 bp, Zea mays
  misc_feature: Ceres CLONE 1537611
  misc_feature: Encodes the peptide sequence at SEQ ID NO. 65811
  misc_feature (471)..(471): n is a, c, t, g, unknown, or other
aaagctggagctccccgcggtggcggccgctctagaactagtggatcccccgggctgcaggaattcgtctcacccctagaaaaagcaacaaagcacgcagtctcccaactggtcaaaccgctccccccaccggcccacccccaccccacccccaccgtaccccgtccccaatccgcgtgcatccgtccaccatgcctcctcccatcctcctgcccccgatcttcctcctcttcctcgtcgcccctttggcggcgccgcagcccgcgccgggatcggcggcggcgccgcaggaggacgacctgcgctgcctccgaggcgttaagcacgacctcgccgaccccaacgagcgtctcgcagactgggacttcaagaacacctcgggcggcgctgtctgcaattacaacggcatcggctgctggaacctgcaggagtcccgcgtcctctcgctctcgctctccgggttcggctcgntcggctccatcccctcctcgctccagtactgccgcgccgccaccacgctcgacctctccagcaacgcgctcgtcggcacaatcctgccagccctctgcgactggctccccttcctcgtcaccctcgacctctcctccaaccagctcaatggcccaattcccgccgagctcgccaactgccgcttcctc

SEQ ID NO: 65811 - protein, 156 aa, Zea mays
  misc_feature: Ceres CLONE 1537611
  misc_feature: SWISSPROT Homolog: EC 2.7.11.1 Non-specific serine/threonine protein kinase
  misc_feature (94)..(94): Xaa is any aa, unknown, or other
MPPPILLPPIFLLFLVAPLAAPQPAPGSAAAPQEDDLRCLRGVKHDLADPNERLADWDFKNTSGGAVCNYNGIGCWNLQESRVLSLSLSGFGSXGSIPSSLQYCRAATTLDLSSNALVGTILPALCDWLPFLVTLDLSSNQLNGPIPAELANCRFL

SEQ ID NO: 65812 - DNA, 669 bp, Zea mays
  misc_feature: Ceres CLONE 1537636
  misc_feature: Encodes the peptide sequence at SEQ ID NO. 65813
tggagctccccgcggtggcggccgctctagaactagtggatcccccgggctgcaggaattcgtctcacccctagaaaaacttttttcctgtctcctctcgctcgctctccccgtctcccgcacgcccatccgccgccgccgttcgccatgggcctcctcgactcgctctaccgcgtggtgatgcgccgcaacgccgtctatgttaccttcgtcgtcgccggtgcctttgcgggcgagcgggctgtagactacggagttcacaagatctgggagatgaacaacctcgggaaaaggtacgaagacataccagttttggggcagaggccagccgaagaatgatatactttggtcgccatttagctccggtttaaccgtttcattttcgcacaataataagctgtgtaaacttcttactctgctgctgagagctgcttcccattcattttactctgaacatgctgtgagggaatttcgtggtgcatggctgaaatctgttatatagagcatatgcaaaaaaaaaaaaaaaaacgagacgctcgaggtacccaattcgccctatagtgagtcgtattacgcgcgctcactggccgtcgttttaaacgtcgtgactgggaaaaccctggcggtacccaacttaatcgccttgaagcccttcccctttcgccagcg

SEQ ID NO: 65813 - protein, 63 aa, Zea mays
  misc_feature: Ceres CLONE 1537636
  misc_feature (4)..(58): Pfam Name: UCR_UQCRX_QCR9 Pfam Description: Ubiquinol-cytochrome C reductase, UQCRX/QCR9 like
MGLLDSLYRVVMRRNAVYVTFVVAGAFAGERAVDYGVHKIWEMNNLGKRYEDIPVLGQRPAEE

SEQ ID NO: 65814 - DNA, 696 bp, Zea mays
  misc_feature: Ceres CLONE 1537639
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
ctatttctcctggatcccccgggctgcaggaattcctctcacccctagaaaaaattccccacctcagcccaccaaatgaggtagggtttccgattgcttccgcggttcaatcaccgcccacgtagaacccctccgctccttccagctcgctctctacccgcaccagcctcgcccgcccttcgctcgccgccgccatggggaggggaaagttcacgggaaagcccaccggccgccgcaacttctccacaccggaggatatccccgctgggacgggcagtcccccctcgcaccttttttatgaaggaggacaaggaaaaaaaaaaaaaaattttttttcccccccccccccggggaaaagatagggggnnnttctttttttccctcctttttccccccccctcttttaaaaaacacaaatatttggtgcggggccggggggggggcccccgcgtaactcccctcggcgcttatccccccctttttcagcccacgggctgggtatttccgaggaaggcaaccgccggttgtgtcgctgcccccgcctaagggcatgaccccgaggagtgggaccggggatttgttcactccccatgctctctcgcttactcttcctcctgttataattctcctgtgccacctcccctcctttacgcgctcaccgcgtcctggtcgagtcctcccctatctccacctttg

SEQ ID NO: 65815 - DNA, 654 bp, Zea mays
  misc_feature: Ceres CLONE 1537643
  misc_feature: Encodes the peptide sequence at SEQ ID NO. 65816
  misc_feature (654)..(654): n is a, c, t, g, unknown, or other
tccccgcggtggcggccgctctagaactagtggatcccccgggctgcaggaattcgtctcacccctagaaaaagcctacccccgcgcaggccgcagccccaccgccgcgttccctcctccccactcgtgtgggaagctcagcacaaagttcgcgttgcgccgggcggctcgtccttcttggaaatcctcccacgcaatcgcctccccgccccgcacccgcgtgcgtgagacgccgcctcgcactgccacagtgccaccgccgccccccaccccggggcgccgatctcgcgtcgcgtcgccctggcgaggtggtggcgggaggatgggggcgtgcgtgtcgcggcccagcgcgtgcgtgggcaagccccacacgccgcggtccggcgacgccagcggccggtcgggcggcgggggtggggcgcggcggaggcgcagccgccgtgtcgggaaggggcggaggacggcgccatcgcgcgccgcgtcgatggagaccatccaggaggccgaggtgcccggttcgacgtccgccgccgcggccgatcaccggacgtacagcaaccccgcgttccaagtgtccgggaacattgaggaggcttggtacgattccttggcgatgagcgagtcggatgccgaagacgatttccacagcgtgcn

SEQ ID NO: 65816 - protein, 110 aa, Zea mays
  misc_feature: Ceres CLONE 1537643
MGACVSRPSACVGKPHTPRSGDASGRSGGGGGARRRRSRRVGKGRRTAPSRAASMETIQEAEVPGSTSAAAADHRTYSNPAFQVSGNIEEAWYDSLAMSESDAEDDFHSV

SEQ ID NO: 65817 - DNA, 820 bp, Zea mays
  misc_feature: Ceres CLONE 1537645
  misc_feature (7)..(7): n is a, c, t, g, unknown, or other
  misc_feature (8)..(8): n is a, c, t, g, unknown, or other
  misc_feature (12)..(12): n is a, c, t, g, unknown, or other
  misc_feature (25)..(25): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (115)..(115): n is a, c, t, g, unknown, or other
ttttttnncccnttttttctccccntcccccaaccnnnnnnnnnaaaannnnnnaagaccgggagctccccgcggtggcggccgctctaaactagtggatccccccgggctgcangaattcgtctcacccctagaaaacaggacaaagagggcatccccccagaccagcagcgtctgatcttcgctggcaagcagctggaggatggccgcaccctagcagactacaacatccagaaggagagcactctccacctggtgctccgcctccgcggtggtcaataagcccatgggtcatttaagctgctgctgtacctgggtatctgcgtcctctggggccctctggcgcccctctatagggatgtcctcctcttataaacctctgggggtttgggtgcccaaaaaaaaaaaaaaaaatattttctccccccccccccccgggggggggggggggcggatcccaattttacccccttcttcccctccccccccgtgttttataatcatccccttcccggccatacaatccttaggccgtcttccccccatctttaaactcctccctttagacggccccttccccctcccttttcctcccgctccggggtgttatattatcggaaagggaggtctcgggcccccgagcccgcccccgttccctcgactcggctgcctccacttttctccttaaaggctaaaaaattcccattcttctctcccccctcctctgttgtttcgtgaccacatctcccccccccctacgcccctccgttcgcacccctgtctgacctctccccctcctgctcagtttatgacgtcaaag

SEQ ID NO: 65818 - DNA, 667 bp, Zea mays
  misc_feature: Ceres CLONE 1537649
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaccctagaaaaaagtaatcccatgtactctctttttgagcaagctcttgcgtaaactagtgatgtataatttgtactactagtaagaaactgcagtagccgctgctaatggatcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaag

SEQ ID NO: 65819 - DNA, 727 bp, Zea mays
  misc_feature: Ceres CLONE 1537656
  misc_feature: SWISSPROT Homolog: EC 1.11.1.6 Catalase
  misc_feature (641)..(641): n is a, c, t, g, unknown, or other
  misc_feature (655)..(655): n is a, c, t, g, unknown, or other
  misc_feature (663)..(663): n is a, c, t, g, unknown, or other
  misc_feature (672)..(672): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
gcggtggcggccgctctagaactagtggatcccccgggctgcaggaattcgtctcacccctagaaaacccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagctttctggaccaccaacttcctgcgggccccccctctggatagaaaacaactctgccctcaccgtcggacagcgaggtccaatccctccttggaggattatcatctaatcgaaaaaaaaatttggccctttttcaaaaaaaaacgtttttttgttcccccccccttatgttttgattcacccggggagaacacccaccccccccaggggttcccgggttcttttgggggaccccacgcgcccgaggttttctctcactcttccccgaaagggggcgggaatatatttttccccccgcgcgaccttcggggggggcagacaaaaacaccgagaaagacctgttgtgtgggggccgtttacgttctcgtctcccggattaataattttcttgtaagaantgatgaggagcgcnccgtcatnctccggggncttcatatcataggatcagnnnnnnccccccaagggggggatttatactccttgg

SEQ ID NO: 65820 - DNA, 662 bp, Zea mays
  misc_feature: Ceres CLONE 1537660
  misc_feature: SWISSPROT Homolog: EC 3.2.1.23 Beta-galactosidase
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (411)..(411): n is a, c, t, g, unknown, or other
ggagctccccgcggtggcggccgctctatactagtggatcccccgggctgcaggaattcgtctcacccctagaaaaattaataatactaagacatcgatgttctcctgtttcttgagcatgactggttgcagtggaacctggaaactaagttatatgatgtgtaatttagttggttaaattatatgaatttatatagtttatttggttcctggctcnnnnnnnaaaaaaaaaaaaaaaaaaaaaaaaaaaaaaaattaaaaaaaaaaaaaaaaccgagacgctcgaggtacccaattcgccctatagtgagtcgtattacgcgcgctcactggccgtcgttttacaacgtcgtgactggaaaaaccctggcgttacccaacttaatcgccttgcagcacatccccctttcnccagctggcgtaatagcgaaaaggcccgcaccgatcgcccttcccaacagttgcgcagccaggaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtgga

SEQ ID NO: 65821 - DNA, 804 bp, Zea mays
  misc_feature: Ceres CLONE 1537662
  misc_feature (1)..(1): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ncccctccccctncccnngtcccgcgtggcgtcttcnntnnccttttnnnnnctaaactggagctccccgcggtggcggccgctctttactagtggatcccccgggctgcaggagttcgtctcacccctagaaaaagattgtttatgcccttcgttatgtttagttagcattgatcggctgtgtcgatcgttgttgtcgtggtggctgattctatacggaccttggagtgtggggttcaagtttgttgtgggtgtggtacggttggttgtttaaaaaaaaaacaaaacgctagacgctccaggtatccccttctcccgattctgattccgatcgcgcgcggtcagtggccgtcgttttacaacgtcgggaatggcaaaaccctgccgttacccaacggatttggccttgaatcacattccccctttcttcaggttgtgggaataaaggaaaaggtccggtccgcatttcccccccccccaaccactgcctcaaccgggaatgggaaaatgggaacatggtaaaccattttagattttgagtttcaagtttcccgtttttaagttttttgccaaaataaatgttcttttattctttatcgccgtataatgcccgataataggtccccgttttccctttttctttacccatagagactgtgaaccgggggttacggggtgtaagggtctcggtttcagaaagtgggaaacccgcattccctcactataatgggagagcccgggtatcccaacccgggccgcagggcgccagatataccctctccgtaaatgtgggcgaatggaacc

SEQ ID NO: 65822 - DNA, 828 bp, Zea mays
  misc_feature: Ceres CLONE 1537663
aaacagtattaccccggttaccgaccatctggtgaggcaggggacaaaaccacaaaactacaactccccgcggtggcggccgctctagaactagtggatcccccgggctgcaggaattcgtctcacccctagaaaaaccccttattttcctgcccacatacaaatgcttcgggcattagcgatcctcctcctcgttctccttccccttctccctcctctgggtctgggtgcgccctcccctgctccacttctccggcgctgacatgacgaccgcggcgtactctcggtcgtccgagctgccgagcggcaagcggcggctgcccccgcgtctcatgctggggttcgcgtcctagatcgagccccagaagctgggcgtcggcctcatcgacagctgctgcctcgcgctcatcgcatacgtctcgctcgccaagctctttgccatctactcccctggctttttccccccccggcgcgcaaacctgtccgggcctcaatgctgctgaatcgcgactccggacctacgtccatacccttccctgtcaggcagactataaaaccgactcccgccaccggggaagacgtctacgcccaccagccggcccactggctcggtttgatttcccgctctaaatttagcctccgaaggcctacacccgtaggtatacgcaaagaagcctcagccctcgccttccttaaaaccatgtcactcgctacttacgcacgaggttcaactggctgcgctattggccatcgccgtccctaacgccccggcgtcctttagaccacccccttatcttatcggcaccccccactgtccgtaatgtcgcg

SEQ ID NO: 65823 - DNA, 816 bp, Zea mays
  misc_feature: Ceres CLONE 1537664
  misc_feature: Encodes the peptide sequence at SEQ ID NO. 65824
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (816)..(816): n is a, c, t, g, unknown, or other
tttttttttttttttattnnnnnannnnaggnnnnnncccatttnnnttaatactggagctccccgcggtggcggccgctctatactagtggatcccccgggctgcaggaattcgtctcacccctagaaaaacacgcacctagggttttcgcgccgccgccgcagccgcaacaatgccgtcgcacaagaccttccggatcaagaagaagcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctggaagctagcaaagtgatgctgtgatgcttttatgaagattctgatgagtggtgaccgttaagagaaaattggcagtactgggttgggacccccaaattcctggcagcattgctatgcctaggtaacgaaacccctttatctttaaaaaacaaaaaaaaaaacggagacggctcgaaggtaacccaaattccgcccctaaatggggaggcccgaatttaccgcgggccccccctgggcccgccggtttttacaacccgcctggagctggggaaaaacccccggggggtttgccccaactttaagctcccccttggcagcgacaaacccccccctttttccccccgccgggggggttaaataatgcccaaaaaaagggcccagcacgccggattcgccctctttcccaaaaan

SEQ ID NO: 65824 - protein, 35 aa, Zea mays
  misc_feature: Ceres CLONE 1537664
  misc_feature (1)..(35): Pfam Name: Ribosomal_L39 Pfam Description: Ribosomal L39 protein
MRQNRPIPYWIRMRTDNTIRYNAKRRHWRRTKLGF

SEQ ID NO: 65825 - DNA, 733 bp, Zea mays
  misc_feature: Ceres CLONE 1537665
  misc_feature: Encodes the peptide sequence at SEQ ID NO. 65826
  misc_feature (733)..(733): n is a, c, t, g, unknown, or other
tccccgcggtggcggccgctctataactagtggatcccccgggctgcaggaattcgtctcacccctagaaaaactatgctggtggaggcgttcgcgggcaacgtcacgcagaaggtgccgttcgattccacggggaaaggcgggttcaagacggcggcgttcaggttcgtggccggcggcgtccgcacccgcctcaccttctacagctcctactaccacaccaaggtcaccgacggcgtctcgctctgcggccccgtgctggaccaggtcaaggttgtgcctgtcaaggcgtagtgaaatgaatcgtgagagcgccgagtgacggtctgctctgctcgtcgtctgtagctgtgctcgtcgtgatttggcgtggtgggttgtgaaagtgtggtcgatttctggacccttcggaatctgatcgtggtgtgctgtgcggtgcgatgtgctgtaacgaaaatttggttgccatcctcctgttcactcccccctttggaatttggcgttttccaatccgggtattgaaggtttttattaggaaacaaaaaaaaaaaaaaaccgaaacccctccaaggtaacccaatttcgccccttatattgaagtccgtatttcccccccgccccacttgggcccgtcggttttttctaccccccccgggtacgggggaaaaaccccctgggcggtttacccccatcttttatctcgccctttggaaggcaatattccccacctttn

SEQ ID NO: 65826 - protein, 72 aa, Zea mays
  misc_feature: Ceres CLONE 1537665
MLVEAFAGNVTQKVPFDSTGKGGFKTAAFRFVAGGVRTRLTFYSSYYHTKVTDGVSLCGPVLDQVKVVPVKA

SEQ ID NO: 65827 - DNA, 666 bp, Zea mays
  misc_feature: Ceres CLONE 1537670
  misc_feature: Encodes the peptide sequence at SEQ ID NO. 65828
ccccgcggtggcggccgctctagaactagtggatcccccgggctgcaggaattcgtctcacccctagaaaaaaagcccaacgggactaccccatctcgtcgtgtcatccactccgccgacacaggcgctcagctccgcaacgccgccggaaatggtcgccgccaccgccaccgccatggccaccgctgcatcgccgctactcaacgggacccgaatacctgcgcggctccgccatcgaggactcatcgtgcgctgcgctgctgtggcgggcggcgcggcccaggcaccggcttccaccggcgcgcggctgtccacggactgcatcctggtgggcagaggcatcagtggcctctgcaccgcgcaggcgctggccacgcggcacagcgtcggggacatgcttgtcacggaggcccgcgcccgcaccggcggcaacattaccaccgtcgagcgccccaaggaagggtacctctgggaggagggtcccaacagcttccagccctccgaccccgttctcaccatgggcgaggacagcggactgaaggatgacttggttattggggacccaaacacgccgcgtttcgtgctgtgagaggggaagctgaggcccttgccatccaagtccgccgacctcgcgttcttcgatctcatgagcatcccatggaagct

SEQ ID NO: 65828 - protein, 145 aa, Zea mays
  misc_feature: Ceres CLONE 1537670
  misc_feature: SWISSPROT Homolog: EC 1.3.3.4 Protoporphyrinogen oxidase
MVAATATAMATAASPLLNGTRIPARLRHRGLIVRCAAVAGGAAQAPASTGARLSTDCILVGRGISGLCTAQALATRHSVGDMLVTEARARTGGNITTVERPKEGYLWEEGPNSFQPSDPVLTMGEDSGLKDDLVIGDPNTPRFVL

SEQ ID NO: 65829 - DNA, 690 bp, Zea mays
  misc_feature: Ceres CLONE 1537672
  misc_feature: Encodes the peptide sequence at SEQ ID NO. 65830
aagctggagctccccgcggtggcggccgctctagaactagtggatcccccgggctgcaggaattcgtctcacccctagaaaaaaagcgtagccagagcagcaaaccacccccctcctcgcccgttcgcttcctcatggagccgctgccgtcggcgacggccgccggcgtgggggggcctgggcccgggtaccccgagtccacggagtcttctccacgcagccggggtggggattcgtgggacgagcccttaccgtcctccgcggcggctgcggccgctgctgccggcggtgggggccggctccgcctgatgtgcagcttcgggggacggatcgtcccgcgcccgaccgataagtcgctctgctaccttggcggggagaccaggatcgtggccgtggaccggcacgcttccctcgccgacgtccacgcgcgcctctcgcggtcgctgctgggcggccgccccttcacgctcaagtatcagctacccaacgaggacctggactccctcatctccgtctctacggacgaggacctcgacaacctcgtcgacgagtacgaccgcatcgctgcgacctcctccggcggaggatcctcgcgcacctcccggatccgactcttcctcttcccgccaagcccgagtcctcgtcctcgctcggctccctgctcgacgactcttcaagtccgagcactgg

SEQ ID NO: 65830 - protein, 185 aa, Zea mays
  misc_feature: Ceres CLONE 1537672
  misc_feature (70)..(165): Pfam Name: PB1 Pfam Description: PB1 domain
MEPLPSATAAGVGGPGPGYPESTESSPRSRGGDSWDEPLPSSAAAAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGGGSSRTSRIRLFLFPPSPSPRPRSAPCSTTLQVRAL

SEQ ID NO: 65831 - DNA, 690 bp, Zea mays
  misc_feature: Ceres CLONE 1537674
  misc_feature: Encodes the peptide sequence at SEQ ID NO. 65832
aagctggagctccccgcggtggcggccgctctagaactagtggatcccccgggctgcaggaattcgtctcacccctagaaaaaaaccaaccaaccctccttggctggactggacccccaacccaacaacagcagcaggaacaggaaaaagaaaaaactctctcccattcccatctcgcctcccacctcctccgcctcgccgccgcggcaggcaccgccaccaatcttctcttccgccccctcgttcgttcgctcgctcgctcgccaggagatcgactcgaggcgaggccatgaagtacgtgctggtgaccggcggcgtggtgagcgggctcgggaagggcgtgacggccagcagcatcggcgtcgtgctcaaggcctgcggcctccgcgtcacgtctatcaagatcgatccacaccgcaacaccgatgccggaaccatgtccccattcgagcacggcgaagtgtttgttttggacgatggtggtgaggtggacttggaccttggaaactatgagagatttctggacatcaagttgactcgtgacaacaacataaccacggggaagatataccagtctgttattgacaaggaacgtagaggagattacctaggaaaaactgttcaggtcgtgccccacatcacagatgaaatacaagattggattcaacgtgtgggcaatgatccagttga

SEQ ID NO: 65832 - protein, 133 aa, Zea mays
  misc_feature: Ceres CLONE 1537674
  misc_feature (1)..(133): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTSIKIDPHRNTDAGTMSPFEHGEVFVLDDGGEVDLDLGNYERFLDIKLTRDNNITTGKIYQSVIDKERRGDYLGKTVQVVPHITDEIQDWIQRVGNDPV

SEQ ID NO: 65833 - DNA, 685 bp, Zea mays
  misc_feature: Ceres CLONE 1537675
  misc_feature: Translation starting site: 518
agtggatcccccgggctgcaggaattcgtctcacccctagaaaaaagctgaaactgaagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccccaccccatctccatcgccatcggggctcgccgtgcggctcctcgcgccgcggcccgtcgaaggttagcccgcaggcgtgggagctcctctccatcttcctctccacaatcgcgggggctggtgcttggaccctctcccagtcggggcaatgggccttcccacggggttaaacagccgccgtttacaactaggcacgcttctcctttcaccgggccgcctttcttccgcccttacacaaagagaaggtaaatactgggcattcatccggacagatttcctctacttctttccgcccgggcggggttttccttcaaag

SEQ ID NO: 65834 - DNA, 852 bp, Zea mays
  misc_feature: Ceres CLONE 1537676
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (258)..(258): n is a, c, t, g, unknown, or other
  misc_feature (259)..(259): n is a, c, t, g, unknown, or other
tattgaggagaccaaagccccccccctctcactaaaatannnncctctttnnnataaactggagctccccgcggtggcggccgctctttaactagtggatcccccgggctgcaggaattcgtctcacccctagaaaattagggtttcacctctataaatatctttgtaagccgcaggagatatccatctctctattgtaaatctcctgcgatctgtaaccacccaaaaatagtgagaagttgccaacaggctcttttnnagaaaaaaaaacataaaaaaaataaaaaagggagattattaaagaccacgcgagggtttatggttgtggttttcgttccctgctggaccttctttgtggtgggtcttcccggcgttgcctctccgattagatggctatataatgtgagcgagcttgcatcactcctgttacgtttcactaaggtataaaaagaacttccgcaacctaattctcccattctccccattctttcccccccccccccagtgctgggactcaattgtgttggccttatcttatcaataacgacatattggcatcgcggtagttggttccgacagcggaaaattttctgcgcccatctgtaaatatcgtatatgaccaaattcgcaatgttataatgctgcttctttgaaattttcagtatccgggaataagcgcactccgaacccagtatgttacccctcgcctcttgcctctctcctcaccgaatacaaacaatatcccccgagctcttatctcctggaggctagccaatatcttccggcttttctaatcttaaattccctttactcaccgcccccttttactcctttatgttgggaaagcctcaa

SEQ ID NO: 65835 - DNA, 654 bp, Zea mays
  misc_feature: Ceres CLONE 1537679
  misc_feature: Encodes the peptide sequence at SEQ ID NO. 65836
ccccgcggtggcggccgctctagaactagtggatcccccgggctgcaggaattcgtctcacccctagaaaaaaccctttccgcctcggcacctccccacccctctcgccttcgcttcgtcggcacggcgagccccacgccgccgatcggggcgccgccagcggcggcggcgcccgatccgatggaagcggaggtggggccgcccaatcccccgcggccggagccagccggatcggagcccgacgacgagcgcctctccccgcctcctcctgctcctgctccgccgtctccgcccccgcctcctcccgccgccaggctgccgccgcgcccaccgcctccgcgggcttctcgctgcaggctccagctccggcgccggcggacgcaaacggcagctccgacatgaaaaggacgaggaaggccgaagacggagacgggtgcaagacctgcagctgcaagaagtccaagtgcctcagagctttactgcgtgtgctttgcttctgggttacattgtactgaatcatgtggatgtcaaccttgtcataacgcgccacagttgcgaagaactctgcggatggcaacagttttacctctgagacctgtcgaaacattctaagctggccaagatatactggaacaaggcataatgtctcctatg

SEQ ID NO: 65836 - protein, 73 aa, Zea mays
  misc_feature: Ceres CLONE 1537679
MEAEVGPPNPPRPEPAGSEPDDERLSPPPPAPAPPSPPPPPPAARLPPRPPPPRASRCRLQLRRRRTQTAAPT

SEQ ID NO: 65837 - DNA, 676 bp, Zea mays
  misc_feature: Ceres CLONE 1537680
tgtggatcccccgggctgcaggaattcgtctcacccctagaaaaattttgggggcaggcgtgggtgcggcatgagctttgaactatgtaatactgttgtactgccaatttaccattttgttggtaaatgaaagcacacttgtcaaaaaggtatgcggtatgccataccatcactgcatcgtttagagtgaaatgcctctaaacttttcctgcattctcttgtagctctatgaactcatggaatggtcattcgttattttttttcttcacttttttaaaaaaaaaaaaaaaaacaagacgctcgaggtaccccattcccccctaagtgagtcttattacgcgcgctcactggacctcttttttaaacgccttgacccccaaaaaccctggcgttacccaacttaatccccttgcaaaaaattcccccttttccccagcttgggaaattaccaaaaaagcccccaaccaatcggcccttccccaaaattttgccgcaccctgaaatggccaaaagaaaatttgcaaacgtttataatttttgttaaaatttcccgttaaaatttttggtaaattcaccctccttttttttaaccaaaaaggcccaaaaattcggcaaaatccccttttaaaaacaaaaaaaaaaaaaaccccgaaaattgggtttgaattgttttttt

SEQ ID NO: 65838 - DNA, 776 bp, Zea mays
  misc_feature: Ceres CLONE 1537683
ccgcgcgcgataaaaggaagaagggaccctattttccaacatcccaaacacaaaactggaactccccgcggtggcggccgcttttcaatagtggatcccccgggctgctgtatccgacacacccctagaaaaacagagcagccacttggatccggtgctcagtggaacagctagctatagcctgtagctagcagctagcttcagtcacaggccggacggtcggctcacacacagctagccgccgccgccgctagcttagccaccagtagtccgatctgatctacaggcaaggggcaacaagctagctagccgcgcgccggcgccatgatgaacctgaacctgaagcagcctctggtgctgcccttgcaccacagcaatgtcgtcggctcgcgcctgtcgtcgttgtcgccctcgggcagccgccgccagcaggaggaccggcggcggtgtgtcccccccctccagctcccgtgggaacgtgcggctgccgaagatcatgctgcacccccaccgaaggaggttagccggcaccggtgtcgtccgctcaccggggtagagggatgcttcacggagaacagccctccgagggaaggcgcccccgggccaatcggccagaatgtaccttcccggcgcgtctctttgtaaggaagaacaggcgaaacctcctttcgggaaagaacatctggtgtgcctccgagctttcgttcagcctcccgaaagctctcaacgcaaaaactctcggcccgtatcgaaagaaacaaacactcggattgacg

SEQ ID NO: 65839 - DNA, 676 bp, Zea mays
  misc_feature: Ceres CLONE 1537685
  misc_feature: Encodes the peptide sequence at SEQ ID NO. 65840
acccgcggtggcggccgctctagaactagtggatcccccgggctgcaggaattcgtctcacccctagaaaaagatggctgatgccttcgccgccgtcttcgcctgccgctgccgctgctactactagttgccttgctcgcttccccccctctcgccccagccgcttccgccctctcccttccgtttccttcccaactcccaattcccaaccctggatccaaatcccaagctatcccggaaccgatacggaggggcgcaagcaattattagctggctagcccggcctgtagctccgagatcatgaagcgcgagtaccaaaacgccggcgggagcgacggctacatgggctcctccaaggacaagtcgatgggcggcagcggcggcgggggcaggggagcaggaggaggaggtggacgagctgctggcggcgctcgggtacaaggtgcgttcgtcggatatggcggacgtcgcgcagaagctagagcagctcgagatggccatggggatgggcggcgcctgccccaccgctgatgacgggttcgtctcgcacctcgccacggacaccgtgcactacaatccctccgacctgtcgtcctgggtcgagagcatgctgtccgagctcaacgcgcccccgccgccgctcccgctcgcgacgccggcaccaaggctcgcgtcc

SEQ ID NO: 65840 - protein, 73 aa, Zea mays
  misc_feature: Ceres CLONE 1537685
  misc_feature: The sequence is a functional homolog of SEQ ID NO 1 in US patent 7268272
  misc_feature: The sequence is a functional homolog of SEQ ID NO 68 in the 10/666,642 US patent application
  misc_feature: The sequence is a functional homolog of SEQ ID NO 216 in the 10/412,699 US patent application
  misc_feature: The sequence is a functional homolog of SEQ ID NO 435 in the 11/479,226 US patent application
  misc_feature: The sequence is a functional homolog of SEQ ID NO 218 in the 10/412,699 US patent application
  misc_feature: The sequence is a functional homolog of SEQ ID NO 2290 in the 10/374,780 US patent application
  misc_feature: The sequence is a functional homolog of SEQ ID NO 439 in the 11/479,226 US patent application
  misc_feature: The sequence is a functional homolog of SEQ ID NO 784 in the 10/225,066 US patent application
MADVAQKLEQLEMAMGMGGACPTADDGFVSHLATDTVHYNPSDLSSWVESMLSELNAPPPPLPLATPAPRLAS

SEQ ID NO: 65841 - DNA, 691 bp, Zea mays
  misc_feature: Ceres CLONE 1537689
ggatcccccgggctgcaggaattcgtctcacccctagaaaaacccctttttccccttcacagccccgtactactatccccgctaccgctagccgccgcgctgctcatctggtggtggcacgcctcgctccaccccatccgccgccgccggctcctcctctagctccctccttaccccgagctttaagctcgtgctacctgcctaccctatccttatggagacagagagagagggggagaaggtttcggtcggccggtcgggggctcttcgatctacgcggctgcctcccccgtttttcggtggggactccgatcgctttccgggcatggggggcgcgtaagaaaaccaacgggcccccggggccggtggggtctttgccccggcatcgggccccgggtggggggttccgggcccccaaggccaggttgcccctggcggggggaaaaaaacaaaataattcccgtcaaaaaaatttgtccctaggaatttccccacccaaggggggggtgggggttgaaaaaaacctttttgtttttctttcccatttccccccaaaagagagggggggtttttaaaacaaaacaccccgccaaagatggtggccccctccccccacaaaaaagggtctataaacaccccccccgggtattttgagaaactttttttggagccacacccccaccggtttgtt

SEQ ID NO: 65842 - DNA, 685 bp, Zea mays
  misc_feature: Ceres CLONE 1537691
  misc_feature (374)..(374): n is a, c, t, g, unknown, or other
gctctttactactggatcccccgggctgcaggaattcttctcacccctagaaaatgacacccgactacgatgcccttgatgtggccaacaaaattggcatcatctaagttaataggcaactggattcgacatctatgtcctactagttctgagcataccaacagatttttctatgttactagtaattttgtttgtcatattgggttgtttttttgcaactaagtcttgttcgcagtcgcagactacatatgcctgtattgagttcctggttgccaaattaaccatcttgaactgtcattattccactttaaaaaaaacaaaaaaaaaatttttttcccccccctccgaggggggggggggggccctttactgantcccaattacccccccccccttggccggcatttttaaaacttcatcgactgggaaacgcgctggccttaccccaaccttatcccccctggcaacccatcccccctttccccccaattgggcggtaatagtcaaaaaaggcccgcccccgaattccccctttccccaacatttggtccaccccggaaatggccaaatcggaatttttaatcccttctgtatttttgtgaatatttccccgctcacaattcccgttcaatcctccccctttctttttatcccatagtgctcaaatgcggtctcgattccttga

SEQ ID NO: 65843 - DNA, 680 bp, Zea mays
  misc_feature: Ceres CLONE 1537692
  misc_feature: Encodes the peptide sequence at SEQ ID NO. 65844
tccccgcggtggcggccgctctagaactagtggatcccccgggctgcaggaattcgtctcacccctagaaaaaacggcatgacgcccctcccggtcccagtcgtcgatcaaaattgttagcgataactcaccgtcaccgtgctcaaactcaaagcctcgatatatacgctcgagacagcgcgcgcaagctcagagtgcgcctctccttattgctcaccccaaagcaaagcaagcacgaagaaatgggcgagataggcacggaccaccgcggcctagtagccgaggcctaggccggcggcagcggcaaggaggagggcatggtcctcggcgacgaggaggaggaggaggagacttcgccggtggagcaggtgcggctgacggtgccgtcgacggacgaccccccactgccggtgtggacgttctggatgtggagcatcgggctgctgtcgtgcgcgctcatgagcttcctcaaccagttcttctcgtaccggaccgagccgctgatcgtgacgcagatcacggtgcaggtggcgtcgctggcgctgggccacttcatggcccgcgcgctgcctcgcgccaggttcagggcgcccgccctgcttggccagtcgggagtggagcctcaacccggggccctttaacaacagggagcacggggtccatctccatcttcgccaacg

SEQ ID NO: 65844 - protein, 107 aa, Zea mays
  misc_feature: Ceres CLONE 1537692
MVLGDEEEEEETSPVEQVRLTVPSTDDPPLPVWTFWMWSIGLLSCALMSFLNQFFSYRTEPLIVTQITVQVASLALGHFMARALPRARFRAPALLGQSGVEPQPGAL

SEQ ID NO: 65845 - DNA, 665 bp, Zea mays
  misc_feature: Ceres CLONE 1537694
  misc_feature: Encodes the peptide sequence at SEQ ID NO. 65846
ggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccgtgtcgtccgtcaccgtggagaggatgctcacggtgacggcgtcggtggaggcgtcgccggccatcgggcagatgtacttccagcgcgccgtcgacgacatcggcgacctcctcggcaagacgctgctgctcgagctcgtcagctccgagctcgacgcaaagtcgggcgtggagaagacccgggtgacggcgtacgcgcaataaaa

SEQ ID NO: 65846 - protein, 135 aa, Zea mays
  misc_feature: Ceres CLONE 1537694
  misc_feature: SWISSPROT Homolog: EC 1.13.11.12 Lipoxygenase
MMNLNLKQPLVLPAHHSNVVGSRLSSSSPSAAAASRRTGGGVSSRSGSRRHVRLPRISCSATEEVSGAVSSVTVERMLTVTASVEASPAIGQMYFQRAVDDIGDLLGKTLLLELVSSELDAKSGVEKTRVTAYAQ

SEQ ID NO: 65847 - DNA, 867 bp, Zea mays
  misc_feature: Ceres CLONE 1537695
  misc_feature: Encodes the peptide sequence at SEQ ID NO. 65848
ataacaaataagaccccaaccccttttgcatgggaccaccgcgccaaaaaaatactatccacagctccacggggaggcggccgctctttcctagtggatccccgggctgcagttttcgtctccccctagaaaaacccctttttccccttcacagccccgtactactatccccgctaccgctagccgccgcgctgctcatctggcggcggatcgcctccctccccccatccgccgccgccggctcctcctctagctccctccttaccccgagctttaagctcgtgctacctgtctacctatccttatggagatagatacagaggggagaacgttcggtcggtcagacgggggctctcggatctcgccccttcctcccccggttctccttgggatctctgctcgcttctcgcaattggtctcccccgacaacccccctgatcccccaacggctataccgcggcccacccccctttttgggtaaacggattgcctgcatccggactctcagttaaaccgttcaaacccccttgcgagtgacgtcgcgacaataacgggaaatcacgcacatagcaagaataatttggttactggggcaatttccgaaaacctcccaatgagagctttgtgttttccacaccagaaaaccccggttatgcatacgggcgcacaatttacctgccccatagcaccagactccgctatttaaacaaaatcacaccccggctttgaaggccgcttggaaaactccaccgtaatgcaaaatggcgcttatatctccaccaaggacccagtttcggcgactttgaaaatgggtcacataaaccagtaaagcttatttctttacactacccgattcttctttttggg

SEQ ID NO: 65848 - protein, 58 aa, Zea mays
  misc_feature: Ceres CLONE 1537695
MEIDTEGRTFGRSDGGSRISPLPPPVLLGISARFSQLVSPDNPPDPPTAIPRPTPLFG

SEQ ID NO: 65849 - DNA, 694 bp, Zea mays
  misc_feature: Ceres CLONE 1537696
ggcggccgctctatactagtggatcccccgggctgcaggaattcgtctcacccctagaaaaatttcatttccgatgtttccgaaataccgatatcgtttccgtttccggagttaccgttttcgattttgtttccgataaaaatatgataacggtaatggttttagtgtttaccgaccgttttcatccctctcgggcgagccgtgacatcgtcttctgtccgaggttggcctcgggccagctgtgactgcgtctgcctgtctcagggttggcctccttctcacccagcgtggacttggtcgaggtttgtgggccttgccttaggtaccccgttcctgggtacacgacagattttgtggttgagatcatttgacaacagagaaaacatgccccccccttatgcattttcggtttaggggtgtttatatgtcatatcttgcacccaatgtatgcctgcctaaatagaacccttttatgcttgttcaagaaatccttcgcctcatttgcataaattaagggcaaaacttaactagttggggattgttcatgcgctaggggcctcccggaagtacctgttttaaaatagattttttccacacccccttaattggtaatcaagggggcataaaccccctttgttctttttatggaagccaatgtaatggcccaaaaaggaacgggaccctaaagaagggg

SEQ ID NO: 65850 - DNA, 661 bp, Zea mays
  misc_feature: Ceres CLONE 1537699
  misc_feature: Encodes the peptide sequence at SEQ ID NO. 65851
tccccgcggtggcggccgctctagaactagtggatcccccgggctgcaggaattcgtctcacccctagaaaaaatttgggggctctaaaatagcctcaccctcctcgtgccttatcttcatctcacctgctctttctcctccgtgctgatcggcagtctctaagctttgcaacaactgatagccgaattccgcgcgccggtccctaaaaaaatgcaagtactaggaagtagataagatgcatttccctgtaatttttcgttattatatatactcagcacgggaaggaggggagacactctgttcaaccaccagccgagttcgcagcggcactccagggtccaggcccagcagcctcttcggctcttcgttgggggtgcgtggacaccggaaattgcctcggggattgcgttcctgatctaagcccggcatgaagggctgctcagagcgtttgctgctcctgctgctgctggcatcgtcgttgttactgtccgtcgtggttgccgcgcagcagacttgccctgccgacctcgacagcaaatgcgacggtggcgcgcctgatgactgggagggggaattcttccccggcgtcccgaaaatcaagtatgagggtccaacaagcaagaaccctcttgcttataagtggtataacaaggaggaagt

SEQ ID NO: 65851 - protein, 77 aa, Zea mays
  misc_feature: Ceres CLONE 1537699
  misc_feature: SWISSPROT Homolog: EC 5.3.1.5 Xylose isomerase
MKGCSERLLLLLLLASSLLLSVVVAAQQTCPADLDSKCDGGAPDDWEGEFFPGVPKIKYEGPTSKNPLAYKWYNKEE

SEQ ID NO: 65852 - DNA, 663 bp, Zea mays
  misc_feature: Ceres CLONE 1537700
  misc_feature: Encodes the peptide sequence at SEQ ID NO. 65853
tacccgcggtggcggccgctctagaactagtggatcccccgggctgcaggaattcgtctcacccctagaaaaacctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagacctcgtcaccaccctgtccatggagaacggcggcggcggccaccacggcccctgcacgctcctctccatggacccgtccggccacctcttcgcgc

SEQ ID NO: 65853 - protein, 35 aa, Zea mays
  misc_feature: Ceres CLONE 1537700
MGEDLVTTLSMENGGGGHHGPCTLLSMDPSGHLFA

SEQ ID NO: 65854 - DNA, 742 bp, Zea mays
  misc_feature: Ceres CLONE 1537705
  misc_feature: Encodes the peptide sequence at SEQ ID NO. 65855
tccccgcggtggcggccgctctagaactagtggatcccccgggctgcaggaattcgtctcacccctagaaaaaacccatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgcccgaccacaacaatgcgatcccctgagggctgagccccaagaagctcaaagaatggtgcttttttggggatgtccttgaggggcagcttcaggaggccgattggtcacccccccatggggttggaatttgccctccccccctaagcccttggggctctgggaaatttgtggaggggtaaaactccggtgagcttcccccttttaaggggacctaaaaatttccctgagtatcccgccgcgtttacagggaaaacctctttggggaaaaagggccccccaacaaaaaacttttttttctttgagccggggactttgtgaggccgctttaaagaggcctccctccccccg

SEQ ID NO: 65855 - protein, 78 aa, Zea mays
  misc_feature: Ceres CLONE 1537705
  misc_feature: SWISSPROT Homolog: EC 2.4.1.13 Sucrose synthase
MGEGAGDRVLSRLHSVRERIGDSLSAHPNELVAVFTRLKNLGKGMLQPHQIIARPQQCDPLRAEPQEAQRMVLFWGCP

SEQ ID NO: 65856 - DNA, 665 bp, Zea mays
  misc_feature: Ceres CLONE 1537708
  misc_feature: Encodes the peptide sequence at SEQ ID NO. 65857
tcaccgcggtggcggccgctctagaactagtggatcccccgggctgcaggaattcgtctcacccctagaaaaattaacgtgtcttccttctctctccggcgtcgcgtcgtgtccctccttcctccatctccatttccggctttccgccaccaccccccctctctctctcttcttcttcttcttcaatcctccctccccgcgctggagttggagggagaggggagaagctttccggcgccgacgccgacgccgacgcggacccggcgccgacacgatccggtggatcaagtgcatcacacctgtagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctat

SEQ ID NO: 65857 - protein, 101 aa, Zea mays
  misc_feature: Ceres CLONE 1537708
  misc_feature: SWISSPROT Homolog: EC 2.7.11.1 Non-specific serine/threonine protein kinase
MASVGVARSSLGFQNGTSSSSDPDRLPNELGSMSIRDDKDVEDIVVNGNGAEPGHIIVTSIDGRNGQAKQTISYMAERVVGHGSFGTVFQAKCLETGETVA

SEQ ID NO: 65858 - DNA, 885 bp, Zea mays
  misc_feature: Ceres CLONE 1537711
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tgctctctccgtctctctttnnnntttntttttttnnnnaaaaatannnnnnnnnaaagtaggactccccgcggtggcggccgctctagaactagtggatcccccgggctgcaggaatgcgtctcacccctagaaaaacagtggacgtggtgcccgggcaccatcagcggccgctgctatggcaaagtgagttcttggtagctatgagtcggtagtagtttagttttgtggccaccatcacggttgaccaaaagagtggtgtggtgattcgagttcatgtgaggattatgaacaaaagtcaggtcataaattgatgcttccttgttttgtgggaaggcaaatcactggtggatatcggggtactaatttgtagaatattacttctgtttgagaatgtcctaaataaagtctggggcttcgggtgattttttgctcccctctgcttggagggggggggggggggggttttttttgaatattgccctgccttttcccctcccccccacaggtgggtaaatatagggaatctgttagtcgacaattgggggcagtgtacttggtatacacctcggagaggtttctctgaggataacccccacactctcccgcccacaacaggatgaaaggccgcaagttatgcgcgcatcatttgttatttatgaacctgctctggtgttattataaaatgggccgatatacggcgagaacacaacccccggagcgctagagcggccgaacagataagaagcgtgtcgtgagataattcgtggggcggcggcatttcccccccacccgcgcggggtaacaaagcgtcacgaagaagctgacgggaggtggacatcgggcttatttagcatgtgttatggcgttttaccgaagacaggg

SEQ ID NO: 65859 - DNA, 668 bp, Zea mays
  misc_feature: Ceres CLONE 1537713
  misc_feature: Translation starting site: 232
  misc_feature: SWISSPROT Homolog: EC 3.2.1.4 Cellulase
gcggtggcggccgctcttcactagtggatcccccgggctgcaggaattcgtctcacccctagaaaaaccccagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccccccaagaagaagaagcggtacgtcgacctcggctgcctcgtcgtcgaccgcaaggtcttcatgtggaccgtcgggcccgtcctcggcctcgggggctccatcggcttcgtcatcatgatcgtcaagctcgtcccgcaaaagtggccccccgccgccgccgcccgaccaggacacgcaggcgctgcccaagggggctcctgtttcttaaagccgcagcgatccggcccgctggcaaaagcccaatggcttgagcttggagggggcacctcctgccttg

SEQ ID NO: 65860 - DNA, 2140 bp, Zea mays
  misc_feature: Ceres CLONE 1537717
  misc_feature: Encodes the peptide sequence at SEQ ID NO. 65861
actctttgcttgcgtgtattccccgtcctttttagcggcttctccgactccttccgatcctctcgcctcgtctccgtcgtcagtcgcctagctagcttccctcacaagcagcaaggcgggagcgaacacgccggcgaccgttagctcgacgcctcgaccgacctccgcgccgtcgctccgcccttgcaaagccgcagccgcgcgcttttatgctcgcggcagctcggtttgtggtctctactagcggtatcctctcgccctcggacctttctgcgaaagcgaagattccggtatggaggtggaggcgacgcccacgacggccgtgtcatcttccggcgtggccgcgcagctgccgccgcccggcccgcccgccaagaaaaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagctccaccggcggggccacaacctgccgtggaagctgcggcagcggagcggcaaggaggtccggaagcgggtgtacgtgtgcccggagcccagctgcgtgcaccacgacccgtcgcgcgcgctcggcgacctcaccgggatcaagaagcacttctgccgcaagcacggcgagaagaagtggaagtgcgacaagtgctccaagaagtacgccgtgcagtcggactggaaggcgcacgtcaagacctgcggctcccgcgagtaccgctgcgattgcggcaccctcttctcccggagggacagcttcatcacccaccgcgccttctgtgacgcgcttgccgaagagagcgccaaggcgcgggcggaggcgccttccgcggaggatgggagctcggcagccgccgtggttccgccaccggcacccccgcctgcgccggcgccactgcgacagcaaccgcccccgcctgcgccgcatcatgcggagccacgtaatgagactgacacgaatgcgactgaggccgtccagttcgcgccgccgcctccgccaccgccgccgcctccgccaccgccgccgccgcagttacaggtaccggtgctttcgcaagcttcggtgagcgctgctgccaacgttggcgccagcagcagcagcagcagcgtcgcggggacgtcgcagagcctgctcggcggtatgttcgcgccgtcgtcgatggcgtcagcgccgcagtacgcggacctcggcggccggccggagcgcgcccatcccgccaagcccccgccgctgtgcctcgccacggacgcatcgtcgtcgatcttctcggcggcgccggcggtgaccgccgagcgccagcagttcgcgccgccgcctccgtccccgtccccgtccgcacacatgtcggccaccgcgctgctgcagaaggccgcgcagatgggcgccacctcgtcgagctcctcgttcctgcgcgggctgggcctggacgtctcctcgtcgtcgccgggcgcctcgtcgtcaggccagcagcaccagcaccaggaggccatgcgggtgtcactcccggacgcctcgctgcagcaatggccgccgcggctggagctggagccggcgccaatgctgtcggccgggctcggccttgggctgccgtacgactccaccggggctcaggtgagcctgccggagctcatgatgggccagtcgtctctgttcagcgggaagccggcgacgctggacttcctggggctcgggatgagcccgtcgggcgcgtcggcaggacgaggcctccccgcgttcgtccagcccatcggcggcatggccgggaccggggccggcgcagccgagacgttcggcgccgggcgtggcgcgcaggcaacgccgtgggagaggaatccgagtagctcgccgatcctgtaactaaaaacttggatagcaatgcaagtagtttggattgaaccccaggcgctgtgattttgggcaaaaggaagaggaaacagtagacgccaggttcgattagcagctacgtagtcttatgttgcactgccggttcttgctgttcttttgtttctcttagctcggtacgaagaaactcactcactctcctacaagaatgctgctttgcacttgcttcaaaaaaaaaaaaaa

SEQ ID NO: 65861 - protein, 539 aa, Zea mays
  misc_feature: Ceres CLONE 1537717
  misc_feature (57)..(79): Pfam Name: zf-C2H2 Pfam Description: Zinc finger, C2H2 type
MEVEATPTTAVSSSGVAAQLPPPGPPAKKKRALPGMPDPDAEVIALSPKTLLATNRFVCEICNKGFQRDQNLQLHRRGHNLPWKLRQRSGKEVRKRVYVCPEPSCVHHDPSRALGDLTGIKKHFCRKHGEKKWKCDKCSKKYAVQSDWKAHVKTCGSREYRCDCGTLFSRRDSFITHRAFCDALAEESAKARAEAPSAEDGSSAAAVVPPPAPPPAPAPLRQQPPPPAPHHAEPRNETDTNATEAVQFAPPPPPPPPPPPPPPPQLQVPVLSQASVSAAANVGASSSSSSVAGTSQSLLGGMFAPSSMASAPQYADLGGRPERAHPAKPPPLCLATDASSSIFSAAPAVTAERQQFAPPPPSPSPSAHMSATALLQKAAQMGATSSSSSFLRGLGLDVSSSSPGASSSGQQHQHQEAMRVSLPDASLQQWPPRLELEPAPMLSAGLGLGLPYDSTGAQVSLPELMMGQSSLFSGKPATLDFLGLGMSPSGASAGRGLPAFVQPIGGMAGTGAGAAETFGAGRGAQATPWERNPSSSPIL

SEQ ID NO: 65862 - DNA, 670 bp, Zea mays
  misc_feature: Ceres CLONE 1537718
  misc_feature: Encodes the peptide sequence at SEQ ID NO. 65863
ggcggccgctctcaactagtggatcccccgggctgcaggaattcgtctcacccctagaaaacgacaaactgccgcgaactctcccggcctcacactccttgcgcccgccgcggcagatgccgctcaccggcattgccctcacgcctctcctcgtctcacctctcgcgccttccccgcgccgtagccgtgtagccacttccgccgcgagaaggccaagggctctccagcgagctcggtgctcggctacagccgcttccggtgaagccggtgagctgtcgcgcgcgacactgctatggagggcggcgaagctacccatctactccgtagcgctaataccactcacagtgagttgtttcaagccaggcccacttaatgcgacgtacccccgaccagaccaaaattttaaccctttttccctttgcaattcagaactggatacctagaagttgtttcgggattgggattgctatgactatacacatttcgcgtttgtgtatggttgcaggtagggagcgcttctgcttattatcatgcaggcttattctttaccaagcggctattttgttctcctgacagcagcagccctcgggatcccttgggctcaatctcaaggaaaaaatgatttttttttaaaaaaaaaaaatgggaaggttattttttaacgccaagg

SEQ ID NO: 65863 - protein, 108 aa, Zea mays
  misc_feature: Ceres CLONE 1537718
MPLTGIALTPLLVSPLAPSPRRSRVATSAARRPRALQRARCSATAASGEAGELSRATLLWRAAKLPIYSVALIPLTVSCFKPGPLNATYPRPDQNFNPFSLCNSELDT

SEQ ID NO: 65864 - DNA, 674 bp, Zea mays
  misc_feature: Ceres CLONE 1537723
  misc_feature: Encodes the peptide sequence at SEQ ID NO. 65865
  misc_feature (519)..(519): n is a, c, t, g, unknown, or other
  misc_feature (674)..(674): n is a, c, t, g, unknown, or other
tccccgcggtggcggccgctctagaactagtggatcccccgggctgcaggaattcgtctcacccctagaaaaaatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaaggatggtgcttttgaggatgtcctgagggcagctcaggaggcgattgtcatccccccatgggttgcacttgccatccgccctangcctggtgtctgggagtatgtgagggtcaacgtcagtgagctcgctgtttgagacctgagagttcctgagtacctgcagttcagggaacagcttgtggaaaaaagccccaaccacaactttgtttcttgacctggattttaaccatttcaaggcn

SEQ ID NO: 65865 - protein, 112 aa, Zea mays
  misc_feature: Ceres CLONE 1537723
  misc_feature: SWISSPROT Homolog: EC 2.4.1.13 Sucrose synthase
  misc_feature (96)..(96): Xaa is any aa, unknown, or other
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPXPGVWEYVRVNVSELAV

SEQ ID NO: 65866 - DNA, 628 bp, Zea mays
  misc_feature: Ceres CLONE 1537724
  misc_feature: Encodes the peptide sequence at SEQ ID NO. 65867
ggatcccccgggctgcaggaattcgtctcacccctagaaaaacccgaacaccctactcgttctcccccatcggcgccgctacgaccagcgtttgagccactcgccgccgcgcacgatcctccacgccttgctccagtcctcgtcggcacgcctccttcccaaccctaaccctagcactagcagtcagtcgagcggcggcaagtcaagggtctgtcgagcgggccggcggcgaagaagtgtctagcgaggcgagtcaggtgcagggggacccacccgcagcggtggcgtgaagcgcgtttgactggatcgaccaggttggcggctaaacagaggaggttgcttgtttgttttctccgtccggctgcggttttccttggactggatcgatcagatttgccggcggcggcagcggtcccccggcaaaggcgtgaggatccctgccgggatggaggtgccgtggctgctgctggtgcacgggtcagtgacggcgctggtggtggtgtcgttcctctgcgggcaatggaccatcttcgagggcccttcatccaaaacatcaaccacttccccacctttgggggcctacaataccctcctgcggtttgggcagccttggttgcggccctggggc

SEQ ID NO: 65867 - protein, 61 aa, Zea mays
  misc_feature: Ceres CLONE 1537724
MEVPWLLLVHGSVTALVVVSFLCGQWTIFEGPSSKTSTTSPPLGAYNTLLRFGQPWLRPWG

SEQ ID NO: 65868 - DNA, 656 bp, Zea mays
  misc_feature: Ceres CLONE 1537728
  misc_feature: Encodes the peptide sequence at SEQ ID NO. 65869
  misc_feature (557)..(557): n is a, c, t, g, unknown, or other
  misc_feature (563)..(563): n is a, c, t, g, unknown, or other
  misc_feature (582)..(582): n is a, c, t, g, unknown, or other
  misc_feature (656)..(656): n is a, c, t, g, unknown, or other
tccccgcggtggcggccgctctagaactagtggatcccccgggctgcaggaattcgtctcacccctagaaaaaacttgcctccatccactggcactgatccaccacatcccacgccgagcgcgacgccagcagcaggctagctccgctgtccgctccgccgctcactagctgctggaccgcgcctccctccatcgcgccggcgcgcgcgcctaactagcggagccgccttttcatggtccccgccgtggtcgggacgagatgcctcgcctcgcattcctccgccgctccctccccgcgaggcttctcgcgcgagcgtgtggtggtggtgggtggtggagaccaggggagcccggaccaggtggcgcgggacgaggaggccggaggcagcggcggaatgagcgggcggtcgtcggcgggtgggccgtccggcggggagtgctacgcgtgcacgcagcccggggtgccggcgttccactccacgacgtgcgaccaggtgcactcgccggactgggacgccgacgcggggtcctcgctcgtgccggtcccaggccaggcncaggcngcggctgccgccggcggcncccccgcaacggcacgcggcgcggttggctgtttggggcccgtgcctgacccgcggagcaagcgcgtgccacgn

SEQ ID NO: 65869 - protein, 141 aa, Zea mays
  misc_feature: Ceres CLONE 1537728
  misc_feature (117)..(117): Xaa is any aa, unknown, or other
MVPAVVGTRCLASHSSAAPSPRGFSRERVVVVGGGDQGSPDQVARDEEAGGSGGMSGRSSAGGPSGGECYACTQPGVPAFHSTTCDQVHSPDWDADAGSSLVPVPGQAQAAAAAGGXPATARGAVGCLGPVPDPRSKRVPR

SEQ ID NO: 65870 - DNA, 679 bp, Zea mays
  misc_feature: Ceres CLONE 1537731
  misc_feature: Encodes the peptide sequence at SEQ ID NO. 65871
tccccgcggtggcggccgctctagaactagtggatcccccgggctgcaggaattcgtctcacccctagaaaaagagaagtcttcccctcgcctcgtctccgcccaaacaaacatcacccgaagccgcgtggagccatcatccatatcggagccagcgcgccgggtgatgctgttccggccacgaaagtagccgtcttgcaccccgaaccaagagccatggcggacgatggcgaggagaagctgctcgcaacggtgcatcatatcgtgcacacgctggggagcagcgacacaatgacggaggacatcctcaaggtcttctccaactacgacggccgcctctcgctcgacaagctctacgccgcgcgcgcggcggcagcggccgctgcgtccggtggtggcggaggaggaggatgacgaggagggggaggaatcgtacgggagcaggtcgatgacaacggttcctatgatgcgaccgcctcccattgggagacgttatgacgcatggatctatgcgttgcgtcagcttggttgaggctaacaataatttcgctggacagtctcatcttggagctaggtggactttgggatggcttcaaactggggcagacccccagctaaacggcaacagccgtttcccagcacgcccggcccacaaccctctactggggcctccaggggg

SEQ ID NO: 65871 - protein, 65 aa, Zea mays
  misc_feature: Ceres CLONE 1537731
MADDGEEKLLATVHHIVHTLGSSDTMTEDILKVFSNYDGRLSLDKLYAARAAAAAAASGGGGGGG

SEQ ID NO: 65872 - DNA, 658 bp, Zea mays
  misc_feature: Ceres CLONE 1537732
  misc_feature: Encodes the peptide sequence at SEQ ID NO. 65873
ggatcccccgggctgcaggaattcgtctcacccctagaaaaaaaactcgtgttcgttctgagcgcacacactcactacgtgatctcccccaaatccagaccgtctgcagctccgcttcaagatggagatctttgtgaaaaccctgaccggcaagactatcaccctcgaggtggagtcgtctgacacccttgacaacgttaatgcccagatccacgacaaggagggcatccccccagaccagcagcggctcatcttcactaggtaacagcttgaggacgggcgcacgcttgctgactacaccttgccgaaggatagcaccctccaccttgtgctccgcctcagggggaggcatgcagatcttttgtgaaaacccccaccggcaatactatcaccgcttcaggtggagtcctcttacacgattgacaaagttcaagggctaagatccacggaccaggaggggcttcccttccagaaccgcaatcggcttcattctttttgctgggaaaacaggttttggggacgggcggacacctttgccggacttaaaaccttccctgaaaggaggacgccccctcccacttgggtggctgccgccttccgggggacggccttgcagaattttttcctggaaaaaaccctttaaccgggcataaaactt

SEQ ID NO: 65873 - protein, 47 aa, Zea mays
  misc_feature: Ceres CLONE 1537732
MEIFVKTLTGKTITLEVESSDTLDNVNAQIHDKEGIPPDQQRLIFTR

SEQ ID NO: 65874 - DNA, 664 bp, Zea mays
  misc_feature: Ceres CLONE 1537738
  misc_feature: Translation starting site: 195
  misc_feature: SWISSPROT Homolog: EC 5.2.1.8 Peptidylprolyl isomerase
  misc_feature (478)..(478): n is a, c, t, g, unknown, or other
  misc_feature (480)..(480): n is a, c, t, g, unknown, or other
ggagctccccgcggtggcggccgctctagaactagtggatcccccgggctgcaggaattcgtctcacccctagaaaaaatcatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggacgtcggcaaggaggggctcaagaagaagctgctcaaggagggcgagggctgggagactcccgaggtcggcgacgaagttgaagtgcattacacgggcacgctccttgatgggacaaaattcgactcaagccgtgatcgtggagaacccttcaagctcaatcttggacnangtcaagtgataaagcgctgggatcaaggaatcacgaccatgatgaagggagaaatgctatttttaccattcctccagagctggcttatggagcatctggttcaccctcaactatgccacccattgcaaacctgcagtttgatgttgagctgctttcatggaccagtgtcaaagacctttgcaag

SEQ ID NO: 65875 - DNA, 594 bp, Zea mays
  misc_feature: Ceres CLONE 1537739
  misc_feature: Encodes the peptide sequence at SEQ ID NO. 65876
ggcggccgctctagaatagtggatcccccgggctgcaggaattcgtctcacccctagaaaaagctgctattcccgcttctcgtgcggcggtggcccagccaaaggtcagccggggcgcttgacgcggtgaatcctcttcctcgtccgatatcgagcggagcaaggtcatgggctaccaggtggctgacttggcaccgccgccgtgcgatcgctcctcctccgccttatcgtcgccctcgacctcctagcggccgttgcccgccttcctcgtatgcggctgcggatgctcctggtctctcgagatcccgggcacccgtaaactgggaaaccggcgtgatggtgcggcgcccgcgcccggctcggactcccctaggtgcgcgctgagccctagtttgcatggtatgggtggcggggacccagacttcatgaatcaggatccaggagctcgctgccgcggctggggtgcagcccgcctgccccgcgggttgcggctggtccgcgaccgtagatctgagagcgagcaacgtccggctgcctctgtcattgccgatgctgaagcggacaaagcagcttcagcatgcgcatctgcttgct

SEQ ID NO: 65876 - protein, 64 aa, Zea mays
  misc_feature: Ceres CLONE 1537739
MGGGDPDFMNQDPGARCRGWGAARLPRGLRLVRDRRSESEQRPAASVIADAEADKAASACASAC

SEQ ID NO: 65877 - DNA, 640 bp, Zea mays
  misc_feature: Ceres CLONE 1537740
  misc_feature: Encodes the peptide sequence at SEQ ID NO. 65878
gcggtggcggccgctctagaactagtggatcccccgggctgcaggaattcgtctcacccctagaaaaaaaccagaaaccataggcatcggccttgggcgccacacgatttccggcagcatcaacaaccgttcaggctttactccatagtccatacaaatatttatacggcccttaccgcctcgagcctataaaagcgccgcgcctcgcccctgcacagctcacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgagggaggtggtggtggacgcggcggctcggtgccggtgccggtggcggcgcgacagcggtggcggcggccctgccggggccgaggggcctgcccgtggtcgggagcatgtggctcatgacgggactggcgcaccgcaagctcgcggcggcagcggggagcct

SEQ ID NO: 65878 - protein, 54 aa, Zea mays
  misc_feature: Ceres CLONE 1537740
MATPDDRGSWLLYLSLAAKCAGEQPYRLAGFLAVCAVAFVVTCLLHWCFPGGPA

SEQ ID NO: 65879 - DNA, 689 bp, Zea mays
  misc_feature: Ceres CLONE 1537744
  misc_feature: SWISSPROT Homolog: EC 3.2.1.21 Beta-glucosidase
  misc_feature (138)..(138): n is a, c, t, g, unknown, or other
  misc_feature (160)..(160): n is a, c, t, g, unknown, or other
  misc_feature (230)..(230): n is a, c, t, g, unknown, or other
  misc_feature (233)..(233): n is a, c, t, g, unknown, or other
gcggtggcggccgctctataactagtggatcccccgggctgcaggaattcgtctcacccctagaaaaaaagactcaatacacaagcagagctcaaacaattcttgcttcccgctagctagctcgcaagaaataatggntccacttcttcttgcttctcgnacagcctgtcgtcctggccttacaagccgccatgcccatgataatggccggcacggcctgtcttcttcanaancaggaagtcgtactaagcgaagccgtagccttagcttgaggccacgagctgaaaagacgacgacgggcggtgggggtcatgttgtgagcaaaaacctgaccccctggcaaatccccaggagggagtggttcccccctagctttatctttggtgctgccacttcagcaaaccaaattgaagggggctggaaacaaaggtggaaggggccaagcacttgggacaactcctggcacaaccatccggaatgaataccgcaaggaaccaatggggaattttggaaaaaaacccctactatccggtaagggagagaactccaaattcctaaagaaaatggggatggacccccccagggttcccccctcctttggccccaaaatatttccaaaagggacacccccggggagggctttacccccaaagggcctccagacttccaaaaaaaccttaaacactttt

SEQ ID NO: 65880 - DNA, 629 bp, Zea mays
  misc_feature: Ceres CLONE 1537748
  misc_feature: Encodes the peptide sequence at SEQ ID NO. 65881
gcggtggcggccgctctatactagtggatcccccgggctgcaggaattcgtctcacccctagaaaaagctctctctctctctcttttcacccaagcaagaacagagcccaagaggcctcaaaagaaccactgctcttcctccgcatagctcgtcgccctctctctcctatcagtcctcccagctccagctaccacagcagccctctcgcttaaaggaggagggagaagggggcgaggcgagcaatgtctgagcagcagcagccattgccgcagcctcggagcagcatgcgggaggcgctggagaaggaggacaaggagaaggcggctgcggcggcggcggccaaggagaaggcggcagtccccaagaacggcaacggctacggcggcaagaatggcagcggcgccggcagcggcaacggcggagcgcccccgcagtccggggaagagacggcccgcgagatccaggtggtcagggaggggcgtacgccccagacgggcgcgcccgcctacgtcatacccgaggagccgcgggccggggtcgaacctctcgggtgggaaatctaggggttccggttctaattcataaccacctgggtggtggcggtcctttccaggcaattaaaaccagg

SEQ ID NO: 65881 - protein, 106 aa, Zea mays
  misc_feature: Ceres CLONE 1537748
MSEQQQPLPQPRSSMREALEKEDKEKAAAAAAAKEKAAVPKNGNGYGGKNGSGAGSGNGGAPPQSGEETAREIQVVREGRTPQTGAPAYVIPEEPRAGVEPLGWEI

SEQ ID NO: 65882 - DNA, 617 bp, Zea mays
  misc_feature: Ceres CLONE 1537749
  misc_feature: Encodes the peptide sequence at SEQ ID NO. 65883
  misc_feature (411)..(411): n is a, c, t, g, unknown, or other
  misc_feature (445)..(445): n is a, c, t, g, unknown, or other
  misc_feature (451)..(451): n is a, c, t, g, unknown, or other
  misc_feature (517)..(517): n is a, c, t, g, unknown, or other
  misc_feature (529)..(529): n is a, c, t, g, unknown, or other
  misc_feature (557)..(557): n is a, c, t, g, unknown, or other
gcggtggcggccgctctataactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccantcccgtgacggtggcagtggcagctgtggctacngcggcngtcgcggcggcagcggctatggtggcgggcgccgtgacggcggttatggcggccgtggcggctacngcggtcggcccnagggtgggtggcggcggctaccgaggcngtggcggctacggcggtccgccccaggttggtggtggcggcttacggcggcggcggcgct

SEQ ID NO: 65883 - protein, 153 aa, Zea mays
  misc_feature: Ceres CLONE 1537749
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (85)..(85): Xaa is any aa, unknown, or other
  misc_feature (97)..(97): Xaa is any aa, unknown, or other
  misc_feature (99)..(99): Xaa is any aa, unknown, or other
  misc_feature (121)..(121): Xaa is any aa, unknown, or other
  misc_feature (125)..(125): Xaa is any aa, unknown, or other
  misc_feature (134)..(134): Xaa is any aa, unknown, or other
MAAADVEYRCFVGGLAWATSNESLENAFASYGEILDSKVITDRETGRSRGFGFVTFSSENSMLDAIENMNGKELDGRNITVNQAXSRDGGSGSCGYXGXRGGSGYGGGRRDGGYGGRGGYXGRPXGGWRRLPRXWRLRRSAPGWWWRLTAAAA

SEQ ID NO: 65884 - DNA, 663 bp, Zea mays
  misc_feature: Ceres CLONE 1537751
  misc_feature: Encodes the peptide sequence at SEQ ID NO. 65885
  misc_feature (387)..(387): n is a, c, t, g, unknown, or other
  misc_feature (537)..(537): n is a, c, t, g, unknown, or other
tccccgcggtggcggccgctctagaactagtggatcccccgggctgcaggaattcgtctcacccctagaaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacacgaggagatgcgggggtcactganggctgctctttccccaggagggagactagagcggatgtggtcttcaggttttggtcttggccgatactaccggcaggactggcctttaaccaagaattttccctaagttgtcccccaacagctattggtggcaggttggccccttccaantttaaacggggttggggttgggggtgggatgaaaccaagggccctttagaattaaaattaagagggctggggcttcggacctttttacccccccgggggccccccggccggttccccggggccctg

SEQ ID NO: 65885 - protein, 169 aa, Zea mays
  misc_feature: Ceres CLONE 1537751
  misc_feature (30)..(84): Pfam Name: Ribosomal_S27e Pfam Description: Ribosomal protein S27
  misc_feature (77)..(77): Xaa is any aa, unknown, or other
  misc_feature (127)..(127): Xaa is any aa, unknown, or other
MVLQNDIDLLNPPAELEKLKHKKKRLVQSPNSFFMDVKCQGCFSITTVFSHSQTVVVCPGCQTVLCQPTRGDAGVTXGCSFPRRETRADVVFRFWSWPILPAGLAFNQEFSLSCPPTAIGGRLAPSXFKRGWGWGWDETKGPLELKLRGLGLRTFLPPRGPPGRFPGAL

SEQ ID NO: 65886 - DNA, 642 bp, Zea mays
  misc_feature: Ceres CLONE 1537754
  misc_feature: Encodes the peptide sequence at SEQ ID NO. 65887
tccccgcggtggcggccgctctataactagtggatcccccgggctgcaggaattcgtctcacccctagaaaaaaccccgcgctccatgtgatgtgtagtgttttctccctctgctttccccactcgtccgctcctgcttcccgccgccatcgcccatgacgccggcggcaccggcatccgccgcggacgcgcttgcgcatatcctgcaggacctcctgccttcggttctgctggccgcggcgtcggtcatggcgctccactcgcggtggcgcgcgctccaggcctccctcctcgcgttgcagtcctcgctcgtctccgcgcccgcctccgccccgtcccacccgctcttcgacaacctggtggccgcgcttctcccagccctccgttccctccacgcgctctctgtcctgtgccaggaccctgggctcaccggggggcggctgcggctactgagcgaccttgacgtggtggcctcgtcgctctcgctcctactgcacgacctctcgctgctccttcgctcgaggctgctctccgtctactccgagctgtccattcccctgacatcgtactgcaggtgcctgcgtcaggcggtccgctcgcagacgatgcctcttcgtccgtgacgcctttggcagcctccaa

SEQ ID NO: 65887 - protein, 155 aa, Zea mays
  misc_feature: Ceres CLONE 1537754
MTPAAPASAADALAHILQDLLPSVLLAAASVMALHSRWRALQASLLALQSSLVSAPASAPSHPLFDNLVAALLPALRSLHALSVLCQDPGLTGGRLRLLSDLDVVASSLSLLLHDLSLLLRSRLLSVYSELSIPLTSYCRCLRQAVRSQTMPLRP

SEQ ID NO: 65888 - DNA, 661 bp, Zea mays
  misc_feature: Ceres CLONE 1537755
  misc_feature: Translation starting site: 146
tccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgcaggcggcgtgccgctgcctcaagagcctcgccaacagcgtcaagagcgtcaacatgggcacggtcgccaccatccccggcaagtgcggcgtctccgtcggattccccatcagcatgtccaccgactgcaacaagatcagcttagttacgaccaccaacctaataagcctacggaacgtacccgacgttccgcgcccttgcccgattgattaaccccggggaaaaataaaataaaccccccttttttgcccggaaccacctggctttatttttccgacccttttttttc

SEQ ID NO: 65889 - DNA, 658 bp, Zea mays
  misc_feature: Ceres CLONE 1537756
  misc_feature: SWISSPROT Homolog: EC 3.2.1.23 Beta-galactosidase
tccccgcggtggcggccgctctagaactagtggatcccccgggctgcaggaattcgtctcacccctagaaaaagtgaccgcttctctccttgcccagctgcctctgcgcgccgagttgttttggtgctctacggtgaggactgcctcaaggatccggctgccgacacgctgctctcctcgtcctcctatgcccctccccgtggctggattcctagtgattggacgaactctgaaactcagtgaggttacgaggatctgaagttcatcctgtcacctggaatctcaagtgccaggtcaagaacaggtaccgcatgatgaggcgcttggaggatgctgtgacgagttcatgagaggtctaggctgtcgtctcccagtcaactttgggttgctggaccgttgtctccttataatgtaattgtttattttgtacagaacttctattatatagtaaagttgtgacattcgatccaaaaaaaaaaaaaaaaaaacgagacgctcgaggtacccaattcgccctatagtgagtcgtattacgcgcgctcactggccgtcgttttacaacgtcgtgactggaaaaaccctggcgttacccaacttaatcgtcttgcaacacatccccctttcgccagctggcgtaatagcagagagccccccacga

SEQ ID NO: 65890 - DNA, 625 bp, Zea mays
  misc_feature: Ceres CLONE 1537757
  misc_feature: Encodes the peptide sequence at SEQ ID NO. 65891
  misc_feature (40)..(40): n is a, c, t, g, unknown, or other
ccccgcggtggcggccgctctagaactagtggatcccccngggctgcaggaaattcgtctcacccctagaaaaaatcgttgcttcagatatgtgaaagttttggctttccatgtagcgacacaattgggatgtaggccatttctgaaacagaccgctgtttgcaggtggtgctgtttgggacttgattaccagctgtgcccttagttttaacggaggggtggttataaattttgtccttctatatctgtatgtgctaagttgctcctagtccgtgagagctttctacattaagctatttttgtatgttatgtaaccagtttctattagagtgcagtttgtaacatttagaacatgtacaccaattttgtgactgtttaaacaagtgagggaagctttaaaaacttcctcccggaggattcccggattaaaaaaaatttgcccccaaaatccatttcccaaaaaaaaaaaaaaaaccggaaccccccgggggcccccttttccccccttaaagagagccctttattccccgcccccccgtgggccctcttttttcaaaaccccggggcagggggaaaaacccccggggttttccccacaatttataccccttgggagaaaaatccc

SEQ ID NO: 65891 - protein, 67 aa, Zea mays
  misc_feature: Ceres CLONE 1537757
PAVAAALELVDPPGLQEIRLTPRKNRCFRYVKVLAFHVATQLGCRPFLKQTAVCRWCCLGLDYQLCP

SEQ ID NO: 65892 - DNA, 539 bp, Zea mays
  misc_feature: Ceres CLONE 1537759
cgcggtggcggccgctcttatcagtggatcccccgggctgcagattcgtctcacccctagaaaaatgtatttgaggagggggtggacgtggtacgtggaactatggaagttatcacagcggagtttggcttagaaactttgtcgatgctttgagtctgagacacatttctgtcaaattttgagaacattcctagggacgagctaagttaccggagcctgatttttgttggaattttgcatgcaatgtttaaaaaccgactatattgcaatggccaataggatatactcctggtcagtgtgtagtgtttggctttctaatactaactctactgtgttgctaactctgtacacgagcgccggggacccatccccttagcggtcgtgtaccactctccggcggtagtgtatacgcggcccggaaaccctggtttacaaacttatgggatgaccgatccccctttctcaacgggtgaaaaaaaaaagcttccacccgttgccctttccaaaaatggcccccccgattggccaatgcaaattgt

SEQ ID NO: 65893 - DNA, 696 bp, Zea mays
  misc_feature: Ceres CLONE 1537763
  misc_feature: Encodes the peptide sequence at SEQ ID NO. 65894
  misc_feature (397)..(397): n is a, c, t, g, unknown, or other
tttctggggctccccgcggtggcggccgctctagaactagtggatcccccgggctgcaggaattcgtctcacccctagaaaaatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcatcgccaaggacattggtttcatcaagtaccgttgaagaggccactgtgctgctgtggagaacttcctacatcaaatttatggccccttcattagggcgcggggggggatgcnctttagctttttgttcaaaacttgagactcatgtgttaaactcgacttgttaaagttttgatggctactttgtgcttgttggaccagctataatcaaaagattgaaaattttctcaaaaaaaaaaaaaaaaacgagacgcctcgaagttacccaaattccccttttaagtgagtcggtatttacgccgccgctcaccggggccgtccgttgtaccaaacgtgcggggctcggggcaaaaccccgtcgggcttaccccagccgttaattggcgcctttgggtgcgcccttcgcccctttt

SEQ ID NO: 65894 - protein, 56 aa, Zea mays
  misc_feature: Ceres CLONE 1537763
  misc_feature (3)..(56): Pfam Name: Ribosomal_S14 Pfam Description: Ribosomal protein S14p/S29e
MGHSNVWNSHPKNYGPGSRVCRVCANPHGLIRKYGLMCCRQCFRSIAKDIGFIKYR

SEQ ID NO: 65895 - DNA, 613 bp, Zea mays
  misc_feature: Ceres CLONE 1537773
cgctctagaactagtggatcccccgggctgcaggaattcgtctcacccctagaaaaacaagaacggtgagaagaaggactctgtgattggagccgtgccagaaagtaccctcgtcacctgcgttgacaagtatgttggtgggaggtgaaatatcaacctgaggcaactagcatgggtgggtatgggtataccgttcttattgaactgctgttgagtagctgtatgcacataataatcatgattttcactccgataaatgcgatttaaagatggcaaatcatccagatgaaaggttgtttctggtctagcttcatgccccatgtttcattcatctgctaatacgtatggagctagtgacccttatctgactctccatctgattttgatgagttcacggataaagagctgtggctaaatgctatgtgtaatgttgtgttggtgatagtacgtgtaactgtatattgccggtgatttttgcggctattggttaatgctgctcagggagtcagggtgcatgcgacccactagtagtgagcccatgtgttaatggaaaatccatttcccttttttccaacatcataactggcaagacgctcgaggtacccaattcgcc

SEQ ID NO: 65896 - DNA, 642 bp, Zea mays
  misc_feature: Ceres CLONE 1537783
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (400)..(400): n is a, c, t, g, unknown, or other
  misc_feature (403)..(403): n is a, c, t, g, unknown, or other
  misc_feature (411)..(411): n is a, c, t, g, unknown, or other
  misc_feature (430)..(430): n is a, c, t, g, unknown, or other
  misc_feature (455)..(455): n is a, c, t, g, unknown, or other
ggcggccgctctagaactagtggatcccccgggctgcaggaattcgtctcacccctagaaaaaacatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaaggtacatctttattggtgtgtagataaagctgggaatatttccatgatgcgactgtagacatataatacagcaattcatttggaaagaccaaaaacgtatttaccccccccccccccaaaannnnnnaaannannaanagnccatgttngaaaaaaactgatattgtnaaagctgtagcgcaacgtatcttcncaaaaaaaaaaaataaaacgagacgtccgaggtacccaattcgcccctaagtggggcgttttacgggcgctcatgggcgcgcgtttgacaagggcgtgactgggaaaaccccgggggttacccaaattaagtgctttgaaaacttcccccttttcgcagggtggggaaaattccaaaaaggccgccc

SEQ ID NO: 65897 - DNA, 714 bp, Zea mays
  misc_feature: Ceres CLONE 1537784
gcggtggcggccgctctagtctagtggatcccccgggctgcaggaatttgtctcacccctagaaagcgggcgtggtggtggtgggtgctttgactgcaggcctcggcacggtaggcacaaatcattttggccgctgcgtcgcgttgggagcagtattctactgtgcctgcgtcccgacaagcgaaaagaagagacgggggagggtgggagaacggataccgaaaggggtaggagagtgagcagccagagaacagggaggtagagaggaggaggaggtagaaggcgaaagaaggggaaccaaatcttggactggaacacatagatttctttggtggaggaaggaggagggcaacaataggaggttacaggtagcccaatagatctactgctgttgaggcaccccatgccaagctgagttgctggcgcgttggctttcctttaaagatgggcttcagctgggggttgccctttctggggacaagaaacatccaccgccccccagccttggtggccggaaagtgtgccaggatccccttgcacggagcttaagatttggagcattattaagggaggtttgaagcccacccctctttactatgtggaaaaaggaaccggaaaaactggggcccccaaagtttgccccccccctccctgggggggcgaaaaaatggggcccaaccgccaaacgagagcgcttgggggcctcatttggct

SEQ ID NO: 65898 - DNA, 687 bp, Zea mays
  misc_feature: Ceres CLONE 1537795
  misc_feature: Encodes the peptide sequence at SEQ ID NO. 65899
  misc_feature (423)..(423): n is a, c, t, g, unknown, or other
  misc_feature (526)..(526): n is a, c, t, g, unknown, or other
tccccgcggtggcggccgctctatactagtggatcccccgggctgcaggaattcgtctcacccctagaaaaagccacacaacacaaatcacaaaatgcggtcgctccacctctccccggcgccaccaaggccgcccctcccgacgctgaggcggcggccggcgccgaagccccacttctccgctcccagtcgtggggctgctgtcggtggtacctcattctattccgccggccgaatctctttgccgcgccacctcgccgccgcggctccagaggctggggcggcggcatccggtcctcctgaccccagccctctctccgcggaggccgaggccgaacgcgccaagctggctcaggttagcaaaaagctagagaaaacagcacggcatttcaagaatgtgggcacccctggggtctggtcccnagtggtgtgtacggtcgtttcggccgggatcctgtcgttctctgcggtcgctacagggaatgtaacagctcctttcacatcagtgcgactgcggttggcatcntcggggccttcatctggggtcttcgggccttttggttacatcccccttttcgaaagggcttaaaaaaacaccaaacatcccttttaagggtccctccccgggcccaatggtggcaaaatccggaaaaaaaatatccggcttaaacttttgtggaaaggggg

SEQ ID NO: 65899 - protein, 164 aa, Zea mays
  misc_feature: Ceres CLONE 1537795
  misc_feature (110)..(110): Xaa is any aa, unknown, or other
MRSLHLSPAPPRPPLPTLRRRPAPKPHFSAPSRGAAVGGTSFYSAGRISLPRHLAAAAPEAGAAASGPPDPSPLSAEAEAERAKLAQVSKKLEKTARHFKNVGTPGVWSXVVCTVVSAGILSFSAVATGNVTAPFTSVRLRLASSGPSSGVFGPFGYIPLFERA

SEQ ID NO: 65900 - DNA, 675 bp, Zea mays
  misc_feature: Ceres CLONE 1537797
  misc_feature: Encodes the peptide sequence at SEQ ID NO. 65901
  misc_feature (558)..(558): n is a, c, t, g, unknown, or other
aagctggagctccccgcggtggcggccgctctagaactagtggatcccccgggctgcaggaattcgtctcacccctagaaaaactgcgccaacaagttcagtcagatactgaacacggtgccatgatcaagaacctgatgcacgaagggaagctcgtgccgtccgacatcatcgtcaggctcctgctcacggccatgctccagagcggaaacgacaggttcctcgtcgacggattccctcgaaacgaggagaaccgccgagcgtacgagagcattattggcattgagcctgagttggtgctgttcatcgactgcccaagggaggagctggagcggcgcatcctgcaccgcgatcagggaagagacgacgacaacgtcgacactataaggaagcggtttcaggttttccacgactccactctaccctgttgtctgtactacgacagaatggggaggtccgacgggtcgatggcgccaatctgctgatgcgttctttcgagatgtgaaggctatatttactcagctactgaccactccggcaaggcaaggtggcaatgcnagcaacaagcggagcaatccgccgctttgttcagtgctccaggatgaacaacctacctcccgcctcccataaaaaaaggaggatttccaaaaacccccccttgcggggcctatgggg

SEQ ID NO: 65901 - protein, 160 aa, Zea mays
  misc_feature: Ceres CLONE 1537797
  misc_feature (12)..(151): Pfam Name: ADK Pfam Description: Adenylate kinase
  misc_feature: SWISSPROT Homolog: EC 2.7.4.3 Adenylate kinase
AGAPRGGGRSRTSGSPGLQEFVSPLEKLRQQVQSDTEHGAMIKNLMHEGKLVPSDIIVRLLLTAMLQSGNDRFLVDGFPRNEENRRAYESIIGIEPELVLFIDCPREELERRILHRDQGRDDDNVDTIRKRFQVFHDSTLPCCLYYDRMGRSDGSMAPIC

SEQ ID NO: 65902 - DNA, 607 bp, Zea mays
  misc_feature: Ceres CLONE 1537799
  misc_feature: Encodes the peptide sequence at SEQ ID NO. 65903
  misc_feature (607)..(607): n is a, c, t, g, unknown, or other
tctagaactagtggatcccccgggctgcaggaattcgtctcacccctagaaaaagtatgcacacaaacccatcgcagggcattctcgagcatagcttctctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtattgactccatagcagcggatctgaaggagaacaagatgaccatcataggcgagatggatgcagtagcgattgccaagaagtttacgaccattggaaagagagggagggtgtctgttggacctgcaaaaaaagaaaagaaggaagaaaagaaagaggagaaaaaggaggaaaagaaagaagagacagaagaggagaagaaagaagagaagaaagaagagaaaaaaaaaaaaaaaacgagacgctccagggaccccattccccctatagtgaagcgtattacccgcgctcactggccgccgttttacaacgtcctgactgggaaaacccctggcgttacccaacctaatcgccttgcn

SEQ ID NO: 65903 - protein, 151 aa, Zea mays
  misc_feature: Ceres CLONE 1537799
  misc_feature (8)..(69): Pfam Name: HMA Pfam Description: Heavy-metal-associated domain
MAQQQKVVVRVPTMTDDKIKQKAIEAVADIYGIDSIAADLKENKMTIIGEMDAVAIAKKFTTIGKRGRVSVGPAKKEKKEEKKEEKKEEKKEETEEEKKEEKKEEKKKKKTRRSRDPIPPIVKRITRAHWPPFYNVLTGKTPGVTQPNRLA

SEQ ID NO: 65904 - DNA, 659 bp, Zea mays
  misc_feature: Ceres CLONE 1537800
  misc_feature: Translation starting site: 206
  misc_feature (339)..(339): n is a, c, t, g, unknown, or other
  misc_feature (368)..(368): n is a, c, t, g, unknown, or other
gcggtggcggccgctctatactagtggatcccccgggctgcaggaattcgtctcacccctagaaaaactcctctatcttcgcatctggcacgagcagccaagcaaataaaagtagagcggcgagcgacgaccggcctgggccaccctttcggccgagcgtagccgagcaggtcgtcgtcgtcgtcgcagcaccccgccggctagcatggccacgaggaggcagtggtggtggtggtgcctgctgctgctggcggcgtggtgctgcgccgcggccgcgcagtcgccgccggcggcggacccgctgcagagcaagtgccaggggacttcgggaagctgacngactgcatggactacgcgacggggcacgncgggtcgcccctcgtccacctggctgcgcgacccctgcgacccggaagaagggcgccccgaaggcttctgctacatcatccagcaggtggcccccggggcccaacccaggggcaattccttcggccttgggcttcaaacgaattatgggggttccccgcgcgctgtgaacctccccaaattccaaagttttggtttttggattaccctggttgaaaccggaagaccggggtttttggggaaataacccccttttttcccaaagcctcttaaaaaaaaaaccccctcccccc

SEQ ID NO: 65905 - DNA, 640 bp, Zea mays
  misc_feature: Ceres CLONE 1537803
  misc_feature: Encodes the peptide sequence at SEQ ID NO. 65906
ggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcaaagtctgtcgactgttacgtatacaaatctatatatcaaataaagacggcgccgtacgtgtataaaaaaaaaaaaaaaaacgagacgctcgaggtacccaattcgccctatagtgagtcgtattacgcgc

SEQ ID NO: 65906 - protein, 90 aa, Zea mays; identical to SEQ ID NO: 53771
  misc_feature: Ceres CLONE 1537803

SEQ ID NO: 65907 - DNA, 776 bp, Zea mays
  misc_feature: Ceres CLONE 1537804
  misc_feature (1)..(1): n is a, c, t, g, unknown, or other
  misc_feature (21)..(21): n is a, c, t, g, unknown, or other
  misc_feature (38)..(38): n is a, c, t, g, unknown, or other
  misc_feature (40)..(40): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (54)..(54): n is a, c, t, g, unknown, or other
  misc_feature (56)..(56): n is a, c, t, g, unknown, or other
nttttcacaccccccccctgnttaaggataataaaatntntttggcccnncncntngtgtgttctcgtggggagggacgctcgctccctagtggatcccccgggctgcaggatctcctctcacccctagaaaaaaacaaccagtgcaaggtggtccgtggaccgatttctctgtcgctggccctggttctcgccatacgtctactaccgcaaggacctcttcgtcccgtgtgtggacaccgacttcccgaccggcgagtacccatggtggaaggcatgacgatgatcctgaaccagccgtgctctgtgctcacacctgagacctatgtatgcctcctttccttgtgatgaggaaataggtttgcgttttttctccgtgggcgttgttcctacaaagacacttgctctttgtttctctccatatatacacactgtgtgaaacaagatcacctgtttatcatgtctcccttatattaccttttgaacactgtggctgggaggctccaaaaatacaaaaagctcgaggtagccaattcaccccaataatttaaaataaataaaaaaaaacccacaccgctcagaggtacccaatatatcccccttattggggaaacgctattagccgctaccctcaacttgaaccgaccgttttataacaaaagttcccccccattgaaaaaaaaaccctgggtataataccacaaaacatatataccccccatttggaaacaccccattctcctcctttttatggtctcgatctagggcctggtaaat

SEQ ID NO: 65908 - DNA, 658 bp, Zea mays
  misc_feature: Ceres CLONE 1537808
  misc_feature: Translation starting site: 132
  misc_feature (442)..(442): n is a, c, t, g, unknown, or other
  misc_feature (448)..(448): n is a, c, t, g, unknown, or other
  misc_feature (535)..(535): n is a, c, t, g, unknown, or other
  misc_feature (554)..(554): n is a, c, t, g, unknown, or other
ggagctccccgcggtggcggccgctctagaactagtggatcccccgggctgcaggaattcgtctcacccctagaaaaaaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgtgagtctttcgctgtctgtctatgttcacttataactgtgatacgtacgaggagaaaaatttaatggaggctcgaagctgaccacgacgaagcggccgcgacgacttgcaggctccccggcgacnttcggntcgacccgctggggctgggcaaggacccccgcgtccctcagtggtacggggaggcggagctgatccaacgggcgtggggcgatggcngccgtgcttggcatcttcntggggcaggcctggagcggcttccccgtggttccgaggccgggccgaaacccaagcgcattccggcccttttccctttggttccctgtctggcccccaacctcc

SEQ ID NO: 65909 - DNA, 761 bp, Zea mays
  misc_feature: Ceres CLONE 1537809
  misc_feature: Encodes the peptide sequence at SEQ ID NO. 65910
actacctacttccccactctcctccgcgaaaaggtatttttattccccaataacactggggctccccgcggtggcggccgctctagaactagtggatcccccgggctgcaggaattcgtctcacccctagaaaaaggcccctctgccttttccttttccttccccgctttctccttccttcctccccactccccgctcccctcgcccagccactggccatgtcggtggagacggagcggagctccaccgagtcctccggggcttccgggctcgacttcgaggacaccgcgctcacgctcaccctccgcctcccgggctccgcgccttccgccgccgccgccgccgcggcctccctgtccctctcctcctcgtcgtcctccgccttccccgaccccgaccgcaagcgcgcgtcctccgacgccgaccccggccgctcctccccgctcgccgagtcctcccccactgcatcggcacccaaggctcgtgtggtgggctggcccccggtgaggtcctaccacaagaacacgctcgcctacgccgcgggctccagcaaggccgcccaagttccccaagggtggcagtctcacggcccgctcttaccttggcgaaaggtggaatctcccgggcgtacacctggctaacaacaaggttgctcacccgccgcttcccggacaaggtttctttctccccttttccacccctcagggaaatttccgccctcacgaactattaggcaacccttggtgggtaaccccccctaa

SEQ ID NO: 65910 - protein, 140 aa, Zea mays
  misc_feature: Ceres CLONE 1537809
MSVETERSSTESSGASGLDFEDTALTLTLRLPGSAPSAAAAAAASLSLSSSSSSAFPDPDRKRASSDADPGRSSPLAESSPTASAPKARVVGWPPVRSYHKNTLAYAAGSSKAAQVPQGWQSHGPLLPWRKVESPGRTPG

SEQ ID NO: 65911 - DNA, 870 bp, Zea mays
  misc_feature: Ceres CLONE 1537816
  misc_feature: Encodes the peptide sequence at SEQ ID NO. 65912
tggcggtggtttccctctcctttgttttcgggagggccgcgctccagttttttaattatactggagctcaccgcggtggcggccgctctagactagtggatcccccgggctgcaggaattcgtctcacccctagaaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagcccgccgtgtccgtgcagctcggccaccacggccaactgcgtttactgcgataaccacccgggcgctctctccgactccagggtcgttccggggttaccgccccaccggcgctttcgccttgacctaaacgggggtggttgggacgcaaccttctgctcccgtcttgagctccggcccggtccggggattgtataacgcctcagcgggccgccccatccgcaggctgccttctttacgtcttatctccggcggcccgtgaaaaagaataagtggcgatctaatttatctcccgcggatttccctcgcgcccttcgcatttatttgcttccgggctcctggcgattaaaccgttgtacccgccttccgccgcggctcgccgccgcattattcaacccggcgccccgctgataattttttctttccctcggactcgccgcctcgttagatgcccatagcgcgggaggatgtttgccccgcgttttactttccggccgg

SEQ ID NO: 65912 - protein, 59 aa, Zea mays
  misc_feature: Ceres CLONE 1537816
MLAVFSGQVVEVPAELVAAGSRTPSPKTKASQLVGRFLAASEPAVSVQLGHHGQLRLLR

SEQ ID NO: 65913 - DNA, 686 bp, Zea mays
  misc_feature: Ceres CLONE 1537817
  misc_feature: Encodes the peptide sequence at SEQ ID NO. 65914
  misc_feature (399)..(399): n is a, c, t, g, unknown, or other
  misc_feature (507)..(507): n is a, c, t, g, unknown, or other
  misc_feature (632)..(632): n is a, c, t, g, unknown, or other
  misc_feature (637)..(637): n is a, c, t, g, unknown, or other
tccccgcggtggcggccgctctatactagtggatcccccgggctgcaggaattcgtctcacccctagaaaaaaagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaangactgcgcggagctggcgcgcgacgcggaggagcggctgctgcagtccgcggcagagatggagcggatgggccgtgccggcacaccgcgcttcgcttggtccctcagncacgtccagacctgggccagcgccgcgctcaccgacacctccacctgcctcgactccctcgcccagcagtcccgcggtgggcaggacagcgacgacgccgtcagggtgaagaggagggtggtggncgtcncgccagtcaccagcacgggctcgggctcgtcacaggcttcggccggcgc

SEQ ID NO: 65914 - protein, 195 aa, Zea mays
  misc_feature: Ceres CLONE 1537817
  misc_feature (35)..(189): Pfam Name: PMEI Pfam Description: Plant invertase/pectin methylesterase inhibitor
  misc_feature: SWISSPROT Homolog: EC 3.1.1.11 Pectinesterase
  misc_feature (100)..(100): Xaa is any aa, unknown, or other
  misc_feature (136)..(136): Xaa is any aa, unknown, or other
  misc_feature (178)..(178): Xaa is any aa, unknown, or other
  misc_feature (180)..(180): Xaa is any aa, unknown, or other
MSLPRRRHLVLLACLLVFLVFAASASTSSAEVAPSVAVDFVRRSCRSTEYPRVCESTLVPCAAGVGRSPRLLARAALVVGADRARNCSSYIRGGGGGAMXDCAELARDAEERLLQSAAEMERMGRAGTPRFAWSLXHVQTWASAALTDTSTCLDSLAQQSRGGQDSDDAVRVKRRVVXVXPVTSTGSGSSQASAG

SEQ ID NO: 65915 - DNA, 660 bp, Zea mays
  misc_feature: Ceres CLONE 1537818
  misc_feature: Encodes the peptide sequence at SEQ ID NO. 65916
ctccccgcggtggcggccgctctagaactagtggatcccccgggctgcaggaattcgtctcacccctagaaaaaatcccttcgcccgccgcaccatggaagccctcgcctcggcgcctcgggcgctcttcccgcgcgcgtgcccagtcgcgacgccggccggcccggcccggcgccgcaccgccgctcctcacatctgcagggcctccgcggcggctggggaggagacgccgccgccgccggccgctcccaagaagatcctcaagaagaagcccgtctactcgatgaagaaagggcagattgtgcgcgtggacaaggagaagtacctgaacagcatcaattatctgtcagttggacacccgcccttctacaaggggctggactacatataccaagaccgcggcgaggtcttggatatcaggaacttcgaaacaggagaatacgccctgatcgcttgggtggggatcccgacgccaccggcatggctaccaacctacatgctcatcaagtcggacaagctcgactacgagaggatatgatggccggccggccggccggccggcggccttgcagggcaccgtagcgccgccgccgaattcatgcttcatttcgcatcaggagtcggccaatcaggacgcaccttgttgttgacttgttgtag

SEQ ID NO: 65916 - protein, 147 aa, Zea mays
  misc_feature: Ceres CLONE 1537818
MEALASAPRALFPRACPVATPAGPARRRTAAPHICRASAAAGEETPPPPAAPKKILKKKPVYSMKKGQIVRVDKEKYLNSINYLSVGHPPFYKGLDYIYQDRGEVLDIRNFETGEYALIAWVGIPTPPAWLPTYMLIKSDKLDYERI

SEQ ID NO: 65917 - DNA, 1769 bp, Zea mays
  misc_feature: Ceres CLONE 1537819
  misc_feature: Encodes the peptide sequence at SEQ ID NO. 65918
ctgagacgaggactcctttcccttctgtcatctgagactcggaagcctcggccgccgccgttaccacctccttgcgccatggcggagaagtcgccggcagccgacgtggaagccggtctccttgcccacctcaactcagcgggagaggtccccgactcacgctctttcgcttcctccctcggcgtctcccacctcgaacttgagggcgtcatcaagagcctctcagctttccgcatcgtcgacagcacagacatcatcaaggagacatgggtgctcaccgaggaggccaagggctacgccgccaagggctcccccgaggcacagctcgtcgccgcaatttcaccggagggtgcctctaaggacgcactcaaggcaatattgggagatgctttcgatgttggcatgaaggcagcctcgaggaacaagtggatagggttcgagaaggggaataaggacttagtccttaggaaggttgagagcgtaaaggatgagctgcaagagcagcttagaagactagagaatggggaggttgtttctgataaagtgatcgatgatttgaagagaaggaaacttattacgaaagagaaatcaatttggtactctctaaagaaggggtctgagtttgttgtaaagagaaaaacgttggctactgatgtgacaacagaacaccttaggagtggtgactggaaggaccttgaattcaaagactataattatggagctcaaggtcaacctatagccaaaggttatgttcagcctttgatggaggttcgtgaggcaatcgagaacatctttattatgatgggattcactgagatgccaaccaacaatttcgtcgaaagcagcttctggaatttcgatgcactgtttcagcctcaacagcatcctgctcgggattcacatgatacatttttcctgaaagctccagcaactacaaaacagttgcctgacgactatcttgagaaagtaaagcaagttcatcagtctggcggttatggctccaaaggatatggttatgattggaaacgggatgaagcggagaagaatcttctccgtactcatacaactgctgtttccacgagaatgttatacaagcttgctcaggagaaaccttttactccaaagaggtattactccattgatcgtgttttccgcaatgaagctgttgaccggactcatcttgctgaattccaccagatagagggacttatctgtgattatggtttgacacttggtgatctgattggtgtattggaggatttcttctcaagtctaggcatgtccaagctgcgtttcaagcctgcctacaatccatatactgaacccagcatggaaattttcagttaccatgatggtttgaagaaatgggtggaagttggtaattcaggcatgttcaggccagagatgttgcttcccatgggactgccagaaggtgttaatgttattgcatggggtctttcacttgaaaggccaacgatgatcctttatggtatcgacaacataagggacctgtttggaccaaaggttgatttcaacctcatcaagagcaacccactatgccgattgggactgtagtgactagtgaggtacagggactctgaatcttgatcacaatgtgccaaagaatttgttttccttttttgttgttgtgctcccttgaagtttgaacaccgattcatgtacctctggttatgtctcaagaaaaccgctcatgatcggccatgttcaggtcctgaaatccctactaattctaaaaaaaaaaaaaaaaa

SEQ ID NO: 65918 - protein, 498 aa, Zea mays
  misc_feature: Ceres CLONE 1537819
  misc_feature (210)..(491): Pfam Name: tRNA-synt_2d Pfam Description: tRNA synthetases class II core domain (F)
  misc_feature: SWISSPROT Homolog: EC 6.1.1.20 Phenylalanine--tRNA ligase
MAEKSPAADVEAGLLAHLNSAGEVPDSRSFASSLGVSHLELEGVIKSLSAFRIVDSTDIIKETWVLTEEAKGYAAKGSPEAQLVAAISPEGASKDALKAILGDAFDVGMKAASRNKWIGFEKGNKDLVLRKVESVKDELQEQLRRLENGEVVSDKVIDDLKRRKLITKEKSIWYSLKKGSEFVVKRKTLATDVTTEHLRSGDWKDLEFKDYNYGAQGQPIAKGYVQPLMEVREAIENIFIMMGFTEMPTNNFVESSFWNFDALFQPQQHPARDSHDTFFLKAPATTKQLPDDYLEKVKQVHQSGGYGSKGYGYDWKRDEAEKNLLRTHTTAVSTRMLYKLAQEKPFTPKRYYSIDRVFRNEAVDRTHLAEFHQIEGLICDYGLTLGDLIGVLEDFFSSLGMSKLRFKPAYNPYTEPSMEIFSYHDGLKKWVEVGNSGMFRPEMLLPMGLPEGVNVIAWGLSLERPTMILYGIDNIRDLFGPKVDFNLIKSNPLCRLGL

SEQ ID NO: 65919 - DNA, 893 bp, Zea mays
  misc_feature: Ceres CLONE 1537822
  misc_feature: Encodes the peptide sequence at SEQ ID NO. 65920
  misc_feature (33)..(33): n is a, c, t, g, unknown, or other
  misc_feature (893)..(893): n is a, c, t, g, unknown, or other
aacaaccgcaaacccacaaaccaaccccctgcncccccaaccacaaccaaaaaacaactcatccaagaggcggccgctctagaatagtggatcccccgggctgcaggagttcgtctcacccctagaaaaagaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttccacaacttcaccgccaatgttgtggttgacagggaccactgtcaatttggggtctgtggggatgccgcatggcctagacggattaccatacaactgaagtctgtttgcgcctatatagagtgcctggatgggttttctcgcatcggccttttttttgttatgctgccccccccaaaaattgtgaatgaaattggcatcctaacggaaagtgcggggacccccgtaaatttaaacggccctttatgcgtctcctctggccgaggacccccataaattaccccccagtgtagggcgccagaaacccttcgcattccccggcggtgtactggattaaacgccgagccttattgttatgatacatcacccaccatgtgaggtttgcctcccccaatttgtcccccacgacccctcgggcgtacaaacatctatccgataagccccaattatagggggttcgcccccaccccctcccgctaaataagcgcgcttcccccacccccccttttctaaacactaagccaccccggattctcttgccccaccccccatatttatacgggatcagtccctcccccccn

SEQ ID NO: 65920 - protein, 130 aa, Zea mays
  misc_feature: Ceres CLONE 1537822
  misc_feature (8)..(103): Pfam Name: Ras Pfam Description: Ras family
MSASRFIKCVTVGDGAVGKTCMLISYTSNTFPTDYVPTVFHNFTANVVVDRDHCQFGVCGDAAWPRRITIQLKSVCAYIECLDGFSRIGLFFVMLPPPKIVNEIGILTESAGTPVNLNGPLCVSSGRGPP

SEQ ID NO: 65921 - DNA, 795 bp, Zea mays
  misc_feature: Ceres CLONE 1537824
  misc_feature: Encodes the peptide sequence at SEQ ID NO. 65922
  misc_feature (43)..(43): n is a, c, t, g, unknown, or other
  misc_feature (54)..(54): n is a, c, t, g, unknown, or other
cctcggtgtgcatccccctctcccccccctccttgtagcgacnccccctccccnttcaaactcgggctccccacggtggcggccgctctataactagtggatcccccgggctgcaggagttcgtctcacccctagaaaagactacgtctctccctgactcggcttctctttttcggcggcgacggctggtcgagttgcggcgctctgttcagtgttcattgtgcccttcgccacgacgattatcctccagtagtaagtcaccatgtcttcgtccatgcaatcttcataccttcctgctacccctgagtccgtagccaaggctcaggaggccaaggacgcttctgagtccatctcaatcctccaccgcgtgcttgaggatccttcttcctctgcggatgcactgagagtaaaagagcttgccctcaccaatctcccaaactacctcacaaaaggagaacagacccccaaccgcgctccgaaccttattgaccccagcccaggccccctttttttggcatcggatccccccaatgctcaaatacttcccccaaccattgggccgccggcttcacctgaatgcccctttggcccaagggagcccttggaaacattctaccacctcctgaaatacctccttggtgccccaggaaaaacggtatgaaattgtgacccccctttcctcgaataacacgagacctcttcccccctggcctggcggtggttggaaaaacccagagggcgagcgcgagtcccctttttggtttggggaaaatctccgcggcggtttctcctgcg

SEQ ID NO: 65922 - protein, 132 aa, Zea mays
  misc_feature: Ceres CLONE 1537824
MSSSMQSSYLPATPESVAKAQEAKDASESISILHRVLEDPSSSADALRVKELALTNLPNYLTKGEQTPNRAPNLIDPSPGPLFLASDPPNAQILPPTIGPPASPECPFGPREPLETFYHLLKYLLGAPGKTV

SEQ ID NO: 65923 - DNA, 759 bp, Zea mays
  misc_feature: Ceres CLONE 1537830
  misc_feature: Encodes the peptide sequence at SEQ ID NO. 65924
  misc_feature (34)..(34): n is a, c, t, g, unknown, or other
  misc_feature (698)..(698): n is a, c, t, g, unknown, or other
tgtctttccgcaacttacaacaatccccgttccnccgccctattttaaaactggagtccacgcggggggggccgctcttaactagtggatcccccgggctgcaggatttcgtctcacccctagaaaagctccattgctcgcctcgggtcagcccctgagcagggagtggatttttccgctgtacccatgattaagttgcatttggagtctgggaaggatgccttctcccacatggttggggatgccaaggagaagaatactgaagttcactgagactgtggaacttcccattggtctgaagaattatgatccacccaaggacaagcgtttcattggctctgttaagttgccccatatccctcgtcccatgatgaaggtgtgcatgcttggcgatgcccaccatgttgaggatgccgataagatgggacttgactccatggatgttgaggctcccaccaccatgaacaagaacaagaagcttgttaagaggcttgccaagaagtaccatgctttcttggcatcctaggccatcatcatgcagattccacgtctccttggtcctggtctcaactaggcaggcgagttcccgaccctggttactcatcagtgaatccctcgaatccaaggtgaatcgagactaatgcaacccgtcaagtttccagcttcaggaaggctctttttgcatggggcgttgcccnttcggccacttttgcccatggtaggaccaagccgattcctggctaaacattccaggatgag

SEQ ID NO: 65924 - protein, 102 aa, Zea mays
  misc_feature: Ceres CLONE 1537830
MPSPTWLGMPRRRILKFTETVELPIGLKNYDPPKDKRFIGSVKLPHIPRPMMKVCMLGDAHHVEDADKMGLDSMDVEAPTTMNKNKKLVKRLAKKYHAFLAS

SEQ ID NO: 65925 - DNA, 672 bp, Zea mays
  misc_feature: Ceres CLONE 1537832
  misc_feature: Encodes the peptide sequence at SEQ ID NO. 65926
tccccgcggtggcggccgctctagattagtggatcccccgggctgcaggaattcgtctcacccctagaaaaagattgcccctgctattggaccaaagatgggtcttaacttcagtgtactcaacacattcggagtcccagggctgaggggggcgactaccaagcaggtttatgagcggcatttcgcgaacaaggaaaccaaggagttcaaagatttccacattgcctacgtcgagttctgcaagtatttcaacacagtgatgcccggtcaggattttgacactccatctactacagagattcagaaattctttgaagacgagtggaagccggagaagaacgaggaggagaggaagaggaaagtcctggagttcatgaggaaggaggtgagggaggccaaggtgccaccacagcttcttcatcgcggcggggctggcggtgccggttgccgccgtcatcggcaagaggggcagcgggcagatcccctacctgaagagcgtgaggctggacctgtcccccacgtcgtgttcgtgcccgtcgtgacgctgctcggcatcatgggcgcccacgccgtgacaaataaccacaagagcgctaccgcccaggagaccaggaccctcaccaggagggaaaaaaaaaggagaccattaaccccccggggggggcaccaccc

SEQ ID NO: 65926 - protein, 191 aa, Zea mays
  misc_feature: Ceres CLONE 1537832
MGLNFSVLNTFGVPGLRGATTKQVYERHFANKETKEFKDFHIAYVEFCKYFNTVMPGQDFDTPSTTEIQKFFEDEWKPEKNEEERKRKVLEFMRKEVREAKVPPQLLHRGGAGGAGCRRHRQEGQRADPLPEEREAGPVPHVVFVPVVTLLGIMGAHAVTNNHKSATAQETRTLTRREKKRRPLTPRGGHH

SEQ ID NO: 65927 - DNA, 758 bp, Zea mays
  misc_feature: Ceres CLONE 1537834
  misc_feature: Encodes the peptide sequence at SEQ ID NO. 65928
  misc_feature (749)..(749): n is a, c, t, g, unknown, or other
cggcagttgttttcccccttttccccgcacctagcttccgcccccctcccctccctatcacacacacccccccggtggcggccgctttttaactaatggatcccccgggctgcaggtattcgtctcacccctagaaaaaaaaaggtccaaagccaacccgtactaatccgagatccccaaccatggccgtcggcgacgtggagacggcggcgccgctgctgcccccgccggcgtctgccctggcggacgagccctccgcgggcccgcctccagacgaccggctcggcatcggctacctcatcttcttcaccctgggcgccggcttcctgctcccctggaacgcgttcatcaccgccgtcgactacttcgacttcctctacccgggggcccccgtcgaccgcgtgttctccatatcctacatggtctccgccttactgcccctgctcgttattgtgctcttccccccccagtccagcgcccccatccgcatcaacacggggctcactctcttcacgctcacgctcgtgctcgtgcccccattggacccccatctacgtcaatgggagggccgggtctgtaccgagcgctactatgtgactgtccgcccccccagcttctgatgcggggtacgccgaacgcgctccgtgcaaggtaggcgttcaccgggccttcgtcgcgtgaacctgcccctaaacggttccatcgccaggacggtttccactcccgggaacccaaccgctacccaaggnaggggcctt

SEQ ID NO: 65928 - protein, 145 aa, Zea mays
  misc_feature: Ceres CLONE 1537834
MAVGDVETAAPLLPPPASALADEPSAGPPPDDRLGIGYLIFFTLGAGFLLPWNAFITAVDYFDFLYPGAPVDRVFSISYMVSALLPLLVIVLFPPQSSAPIRINTGLTLFTLTLVLVPPLDPHLRQWEGRVCTERYYVTVRPPSF

SEQ ID NO: 65929 - DNA, 690 bp, Zea mays
  misc_feature: Ceres CLONE 1537835
  misc_feature: Encodes the peptide sequence at SEQ ID NO. 65930
  misc_feature (430)..(430): n is a, c, t, g, unknown, or other
aagctggagctcaccgcggtggcggccgctctagaactagtggatcccccgggctgcaggaattcgtctcacccctagaaaaaatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaagtccagaggtttttggctttataacttacacctcttctgaagaggcttcngctgccatcactgccatggatggaaagactctgcaaggaacgaacatccggttaatcatgctaaccaaaggaaaggtggcttccccaacaaccggggttaatggtgtggccgctaaggggggggggggggggtgggcaagggtggggggggctttgggggccgccaatggggggggaacccggggcaatgggggccccccaaagggtacatttgtggcgccccccggaaatttggggcacccccccaaaagggttggtgg

SEQ ID NO: 65930 - protein, 82 aa, Zea mays
  misc_feature: Ceres CLONE 1537835
  misc_feature: SWISSPROT Homolog: EC 5.2.1.8 Peptidylprolyl isomerase
MMLANKLGGLLKNATSSNMSVYQAIRCMSSSKLFVGGLSYGTDDHSLRDEFAKYGQVIEAKIILDRESGKSRGFWLYNLHLF

SEQ ID NO: 65931 - DNA, 643 bp, Zea mays
  misc_feature: Ceres CLONE 1537836
  misc_feature: Encodes the peptide sequence at SEQ ID NO. 65932
ctgaaggaattcgtctcacccctagaaaaaactcgcccccggcctcctcccgcctcccagatctcgctcgctcggcgccagttgcctcgcagtttggatcatctcatacctcggcgaagatgagggagatcctgcacatccagggagggcaatgtggcaaccagattggcgccaagttctgggaggtggtgtgcgatgaacatggcattgaccctaccgggcggtacactggcaattccgaccttcagttggagcgtgttaatgtctactacaatgaagcctcctgcggacgctttgttccccgcgctgttctcatggatcttgagcctgggacaatggacagtggccggaccccaccctatgggcaaaatcttcccccctgacaactttttgttcggggcaatctggggccggcaaaaattgggctaagggaccaccccccgagggccgctgaagctcattgacccccgttcctgaatctgtgaagaaaggaaacttaaaaactttgaacttgctttgcagggtttccaaggttagcccccccccccttgggaggggggaacccgaatcctggaataagggaaaccccttcgtgaaatctcaaaaaaatctgggggaaaaagaatcccccttacaccgtttt

SEQ ID NO: 65932 - protein, 87 aa, Zea mays
  misc_feature: Ceres CLONE 1537836
MREILHIQGGQCGNQIGAKFWEVVCDEHGIDPTGRYTGNSDLQLERVNVYYNEASCGRFVPRAVLMDLEPGTMDSGRTPPYGQNLPP

SEQ ID NO: 65933 - DNA, 662 bp, Zea mays
  misc_feature: Ceres CLONE 1537843
  misc_feature: Encodes the peptide sequence at SEQ ID NO. 65934
  misc_feature (399)..(399): n is a, c, t, g, unknown, or other
  misc_feature (662)..(662): n is a, c, t, g, unknown, or other
tggcggccgctctagaactagtggatcccccgggctgcaggaattcgtctcacccctagaaaaattcatccggccaccaccgctctaactactcttcaagagacgacgaccaacaggcacgtcgatcgtcttccggcgagggcgacggaaggatgtccggcggcgagagtggtccggcagcggcggcggcggccgttccgttgctgcaggcgccggaggggaggacgacgaagtactacgagggatgccccgggtgccggctggacgaggccaacaagactaggaccggcgtcccctacctcaatttcttctacatctgggtcgtctgcctcgccgccgcactgccggtccagtcactgttcccttatctatacttcatgatcagggacttcccccccnccaaagaggagcaagacattgggttttatgctggttttgttggggctacctatttccttggaagggccatcagcgccgtgccatggggcatgttcgctgacaagtatggaagggagccatgcattgtgatcagcatcctctcagtgattgtgttcaacacactgtttggacttagcacaacttactggatggccattgtgactaggggattactttggttgctatgtggcatacttggacccatcaggcctatgcttcagaan

SEQ ID NO: 65934 - protein, 169 aa, Zea mays
  misc_feature: Ceres CLONE 1537843
  misc_feature (83)..(83): Xaa is any aa, unknown, or other
MSGGESGPAAAAAAVPLLQAPEGRTTKYYEGCPGCRLDEANKTRTGVPYLNFFYIWVVCLAAALPVQSLFPYLYFMIRDFPPXKEEQDIGFYAGFVGATYFLGRAISAVPWGMFADKYGREPCIVISILSVIVFNTLFGLSTTYWMAIVTRGLLWLLCGILGPIRPMLQ

SEQ ID NO: 65935 - DNA, 743 bp, Zea mays
  misc_feature: Ceres CLONE 1537845
  misc_feature: Encodes the peptide sequence at SEQ ID NO. 65936
  misc_feature (743)..(743): n is a, c, t, g, unknown, or other
gcggtggcggccgctctagaactagtggatcccccgggctgcaggaattcgtctcacccctagaaaaagcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgccgtcgccgaacgcgggctcttcgaccggcccgcgctctccgggtccccgggcttcacccaggagacgctcaacctgttcttttggggatgggcccgcccggccatgaaagggaggcccccccccccccccttcaaaaaattccttttaccccgaaagagcccgtttttggtgggaaaccgaaccccttggggaaaacaagtgttctggggcccaaatgggggggatatagaggaggggttcttcaccacatcccgggttgggggggtttaccccggactttctttttttttctttggggcccccagcgcaaaaaaaaatgggggaatttctttttcccgggggggcccggaaacctccccagccaatacaaaatgtgggttttttttttctccaaaggagaaacacaagggggcggggcgcaccccccctgaaggggggggtttgggagaaaacattgttttn

SEQ ID NO: 65936 - protein, 208 aa, Zea mays
  misc_feature: Ceres CLONE 1537845
  misc_feature (10)..(117): Pfam Name: DUF1969 Pfam Description: Domain of unknown function (DUF1969)
  misc_feature: SWISSPROT Homolog: EC 3.7.1.2 Fumarylacetoacetase
MAEPSQQLRSFVEVPAGSHFPIQNLPFGVFRRRGVQAQAPRPAVAIGDFALDLAAVAERGLFDRPALSGSPGFTQETLNLFFWGWARPAMKGRPPPPPFKKFLLPRKSPFLVGNRTPWGKQVFWGPNGGDIEEGFFTTSRVGGVYPGLSFFFFGAPSAKKNGGISFSRGGPETSPANTKCGFFFSPKEKHKGAGRTPPEGGGLGENIV

SEQ ID NO: 65937 - DNA, 670 bp, Zea mays
  misc_feature: Ceres CLONE 1537846
  misc_feature: Encodes the peptide sequence at SEQ ID NO. 65938
tccccgcggtggcggccgctctagaactagtggatcccccgggctgcaggaattcgtctcacccctagaaaaatccatccatccatagatccctcacctcactcactcgtgaagaaccagagaacccacccaccctccttcatctcctacatccacatctatccaagaaggccatgggcgacgccgtggagcacctcaagagcgggttccagaagttcaagaccgaggtgtatgacaagaagccggagctgttcgagcctctcaaggccggtcaggcccccaagtacatggtgttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctcaaggtggaggtcctcgtggtcatcggccacagctgctgcggtggcatccgggcgctgctctccctccaggacggtgcacccgacaacttccacttcgtcgagaactgggtcaagatcggcttccctgccaaggtcaaggtgaagaaagagcacgcctccgtgcccttcgatgaccagtgctccatcctggagaaggaggccgtgaacgtgtccctgga

SEQ ID NO: 65938 - protein, 165 aa, Zea mays
  misc_feature: Ceres CLONE 1537846
  misc_feature (31)..(165): Pfam Name: Pro_CA Pfam Description: Carbonic anhydrase
  misc_feature: SWISSPROT Homolog: EC 4.2.1.1 Carbonate dehydratase
MGDAVEHLKSGFQKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKVKVKKEHASVPFDDQCSILEKEAVNVSL

SEQ ID NO: 65939 - DNA, 810 bp, Zea mays
  misc_feature: Ceres CLONE 1537847
  misc_feature: Encodes the peptide sequence at SEQ ID NO. 65940
cctcttttttcttccccccgatttccccggggtttgcttcttcacaccacaaaaaaaatatactccaccgcggtggcggccgctcatcactagtggatcccccgggctgcatgtttcgtctcacccctagaaaaatttccttcctcctcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcgtaccggaagaaggcgctcgagagccgcaagatcatcttcgcccgcgcccagcagtactccaaggagtaccccgcccaggagaaggagcttgtgcatctcaagcgtgaggcccggttgaagggcgggttctatgtgagccctgaggttaagcttctgcctcgtggttcccattccgagggtaccaattgccatgcaaccccaggaccccaccaagatcttggcacccccctgtgaattgagggattatttccccccgggtggtctcccctcaaggggcctaataaggggaaatcaaattaaaaagaccttagaacaggggagggagacctataatagtttgcgagacggggattaccccccaaccctgaaagtaacccaatgtagggggagtttggacacttccatttagccacggtttatctcggtaaaaccttgaaacaagatccaaaagaaaattctcaacttgatgtcaacgaaaaaggatgtgcacattgcggggggagg

SEQ ID NO: 65940 - protein, 112 aa, Zea mays
  misc_feature: Ceres CLONE 1537847
  misc_feature (14)..(84): Pfam Name: Ribosomal_L30_N Pfam Description: Ribosomal L30 N-terminal domain
MSAAEAKAAAVPESVLRKRKREEQWAADKKEKALAYRKKALESRKIIFARAQQYSKEYPAQEKELVHLKREARLKGGFYVSPEVKLLPRGSHSEGTNCHATPGPHQDLGTPL

SEQ ID NO: 65941 - DNA, 798 bp, Zea mays
  misc_feature: Ceres CLONE 1537848
  misc_feature: Encodes the peptide sequence at SEQ ID NO. 65942
ccttctttttgggcccccctctcccccctttatcagtgccccccctcctcctctaataactggcgctccccgcggtggcggccgctctagaactagtggatcccccgggctgcaggaattcgtctcacccctagaaaaaaaggtcagatgggacaaaaaaaaaatcgcgccgagtaccagagcgacgctacgcggcgtgacttctcccgaaacctccacatacccaaacccaccgaccgccgcctaggcttccacctctcccgctcaaactccggccactgaggtcgaacccgagcccgcgccgcagcggcacgatggtgaacgacgccgcggcgatggccgtcgtgagggcggcgcgcccagccctccgtggcgcccacgatggcgtcgccttcgccgcccacgccgccttcctcgccgatgggcactcgctccgcgccgtcggccctgtcatgctcgccaaccccccgcccttaggttatgatgagggtgggggattgatgggtgggcaccccatggagaacttcgcccgcccttttttttctatcattggaggcagaaggggcccgaaaaaaaaaggggtactttgggaaaatgtcctgggcgaaccagagaaagaaacttcggcaatagagggtcctggggatcttttgagggcacacaaaaatagagcccccttttctatttcatccccggaattagttggcaaaaaaaatcttattttggttcagaaggagcgcgccccaaaaggaattttttggggggtatttgtgctacccacaaaatttttttccgggg

SEQ ID NO: 65942 - protein, 161 aa, Zea mays
  misc_feature: Ceres CLONE 1537848
MVNDAAAMAVVRAARPALRGAHDGVAFAAHAAFLADGHSLRAVGPVMLANPPPLGYDEGGGLMGGHPMENFARPFFSIIGGRRGPKKKGVLWENVLGEPEKETSAIEGPGDLLRAHKNRAPFSISSPELVGKKNLILVQKERAPKGIFWGVFVLPTKFFSG

SEQ ID NO: 65943 - DNA, 634 bp, Zea mays
  misc_feature: Ceres CLONE 1537849
  misc_feature: Translation starting site: 129
ggatccccagggctgcaggaaatcgtctcacccctagaaaaagacgtccccatttccaagctcctcctcgcgattccaatccacgcacgcctcctccgcttccgcctcgctcaggattatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgcggcagttcctcaagtccccacacaagactattgttgtgcagcccatgcttgtagctgaaaccagcgaggctgctgctgtattccccaaggccaaggaaggcccagaccggtgcgcggcctgcaggaagcgtgttgggctgacgggatttagctgccgatgcgggaacatgtactggtcggtgcaccgctactccgaccaacatgactgtcagttcgactatcggactgcagcaagggacgcgattgccaaagccaatcctgtggtgagggcggagaaactca

SEQ ID NO: 65944 - DNA, 685 bp, Zea mays
  misc_feature: Ceres CLONE 1537850
  misc_feature: Encodes the peptide sequence at SEQ ID NO. 65945
  misc_feature (387)..(387): n is a, c, t, g, unknown, or other
ccgcggtggcggccgctctataactagtggatcccccgggctgcaggaattcgtctcacccctagaaaaagcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgggagacacagcccgtcggccagttccgcgacgccgccgacgcatcgctaccgaacggccccatcgagccggccacgccactctccgaggtgcgcngcgaaccctacccactgcctgccggctttcgagtgggctcactggcgacctcgatgacgacgcgctcctcgccgacttctattcggtggctcgcccaccactacttcggaggatgaccagaacttgttccggtttaaatactccccgggccttcctccggtgggggttaaagccgccggccctttttccgggggctggacaattggggtttcccccaagggaatcccaaaaaccttttcgcctttatttctgggggccccgccccccaacccgctctgggaaaaaatttttcccaagg

SEQ ID NO: 65945 - protein, 119 aa, Zea mays
  misc_feature: Ceres CLONE 1537850
  misc_feature: SWISSPROT Homolog: EC 2.3.1.97 Glycylpeptide N-tetradecanoyltransferase
  misc_feature (82)..(82): Xaa is any aa, unknown, or other
MAAPNSNDAASASGTGPAGEEDISIEALARRVQEHMTLNSNPAARRHKFWETQPVGQFRDAADASLPNGPIEPATPLSEVRXEPYPLPAGFRVGSLATSMTTRSSPTSIRWLAHHYFGG

SEQ ID NO: 65946 - DNA, 678 bp, Zea mays
  misc_feature: Ceres CLONE 1537853
  misc_feature: Encodes the peptide sequence at SEQ ID NO. 65947
  misc_feature (390)..(390): n is a, c, t, g, unknown, or other
  misc_feature (391)..(391): n is a, c, t, g, unknown, or other
  misc_feature (424)..(424): n is a, c, t, g, unknown, or other
  misc_feature (427)..(427): n is a, c, t, g, unknown, or other
ggcggccgctctataactagtggatcccccgggctgcaggaattcgtctcacccctagaaaaaatatcaaagaccagaaagctcaaaccaagaccggcgtgcgcggacgaagcacagatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcgggcactcctttctcaaatggcgggcttccnntcgcgcagtgtatctcttgatatggaattcgancanttgaaagacaacatgctgacgggctccctgggtccctaccttttccttcccccgcccaaagggggcgttttcccggaaccaagggaaggggggggaaaagggatggcaatttttgggtgtttttggggggctttttttcccccccccctttccaggtggggtggaggctcccgggggccccaaccccggcccacgggggggccccccctcgggttttggggaaattttgggggggaacctcttgtggtttt

SEQ ID NO: 65947 - protein, 76 aa, Zea mays
  misc_feature: Ceres CLONE 1537853
  misc_feature (66)..(66): Xaa is any aa, unknown, or other
MGKGFASYLAMKTGPEGGDAAAAQQALIDADLRELGVAARKLANHAFVLGGGLGFGHSFLKWRASXRAVYLLIWNS

SEQ ID NO: 65948 - DNA, 897 bp, Zea mays
  misc_feature: Ceres CLONE 1537854
  misc_feature (36)..(36): n is a, c, t, g, unknown, or other
  misc_feature (485)..(485): n is a, c, t, g, unknown, or other
  misc_feature (873)..(873): n is a, c, t, g, unknown, or other
  misc_feature (897)..(897): n is a, c, t, g, unknown, or other
ccggcgggcgagtatcggctcttccccccgccatancaccccccccccctcaaaaataaaactccccgcggtggcggccgctcttcactagtggatcccccgggctgcaggaattcgtctcacccctagaaaaaatccgcatccgcataaatcccagtcaaattgaacgagagcgccactcccctctgctaatcccaatcaactcgaagcaagcatggccatggcggccgtgggcgtgggcggcgcagtggcgttcctcctcccgaagcgacggcagggcgccctcccctggagatgagggcggcggcggacgcccgtgacggtgcgcccgtcctacaaggtcggattgggcctgatcgctaccaatgtggggatcgacgcctacaaccgatccggaaacggggaagtctgtcgccggtgaacatggatccggttccccgcagggtcggtaactgtgtgtgatcctacatcccacccacaggccnctaaattgattgggtaccaaccgcacgccccatgggatgggggtaccacccggggcccgggacgccgtaggcaaccagggctctttttattagtatcggggatatttgtgtgccccacctcctgggtgtataaagggccttggtgttctcccctgattcttcttggggggtcaaccctggggcgaaaaagggtgatgagggcatcaaatcacgccgggtgaaaaaaaatctatacacaaagttcctttaggctgtggcacccctccggaattttcccccctatatcgtttttttaaagggaagaggggggagcccacctttacatggaagtgggtccccgaggaacgctctctccccacctaataaggagggtttcgtcaggggggtncccttcaacggaggggcgcccctn

SEQ ID NO: 65949 - DNA, 664 bp, Zea mays
  misc_feature: Ceres CLONE 1537864
  misc_feature: Encodes the peptide sequence at SEQ ID NO. 65950
ctccccgcggtggcggccgctctagaactagtggatcccccgggctgcaggaattcgtctcacccctagaaaaaattttgcatgcctatgacgagaatcatcacttttggagcatgggtgttttgtgtacatataaccaaactgctaaaatatttgcagttatgtatatgtttaagcgatccctgaccaactcttcaattatgccactaatgtactaaataaatatgtacgaccatatcggttgactcaacagcttctgttagcgctagaattatcatctctgtacactatgagttttttaaacgctaaagttttgttaaatttggttttgcactaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacaataggccgaaatcggcaaaatcccttataaa

SEQ ID NO: 65950 - protein, 34 aa, Zea mays
  misc_feature: Ceres CLONE 1537864
MGVLCTYNQTAKIFAVMYMFKRSLTNSSIMPLMY

SEQ ID NO: 65951 - DNA, 650 bp, Zea mays
  misc_feature: Ceres CLONE 1537865
  misc_feature: Translation starting site: 247
gcggtggcggccgctctagaactagtggatcccccgggctgcaggaattcgtctcacccctagaaaaatcaattgctggaagtcaaatacaagaacaccacatcgtcatcctctcacctgcctcgcactccattggatttgggggagctcggggggcgcgggccactgatgatccccggaacgagcaccgatccgtaggcgaggaaactccaccgggtacccggcccgggagcgcggagcacggcgatggcaggcgccggagcagaggccaatggcgccaggaacaagtacgcgggtctcgatcggagcgaggagagacagactgagtctaggacggaccggcggaggaggccgttggcgcccgagatcgagagggggagaatggagcggttcgtgtacgcctgcgcggtcttcgcctccctgcacgccgtcctgctcggctaccatgtggcgtaatgagctgcgcgatcatcttcatgctgaaagacctccacataaccgagttgcggcaagaaatcctaataggctggctgaaccgtgggctcactcttgggaaaccctttcacggggagcaaacgtctgaccgcatttggccgaataatggaccaatgggccctcgcggtgcaaatggtcgtttccacaaagggcca

SEQ ID NO: 65952 - DNA, 631 bp, Zea mays
  misc_feature: Ceres CLONE 1537869
tggagctcaccgcggtggcggccgctctagaactagtggatcccccgggctgcaggaattcgtctcacccctagaaaaatactactcccattgtgactgggcggcgcactccgccgcgcgttggtgatgttccttgacggttgatcatgcggcatgtccgccatgtgtcaacgtgcagagcgtggagggtaagactgtggacctctatgtccccaggaagtgctcggccacaaacaggatcatcactgccaaggaccatgcctctgtccagatcaaccttggccacttggatgcgaatggcctgtatgatggtcacttcacaacgtttgctctctctgggtttgtccgtgctcagggagacgcagacagctccctggacaggctgtggcagaagaaatacgctgatatcaagcagtagattttacatctaggtttcccaagaaattgacactgccatagctatgttttgaatcatgtcactagatgcaaaggtcgtgatttcacctggaacattcaatctgaagatttagtaaccttgctgggtttcttacaacaaaaagaaaaaaaacgaaacgctcctggtaccccaatccgcccaaccgggagtccggagaacgcgcgctccccggcc

SEQ ID NO: 65953 - DNA, 663 bp, Zea mays
  misc_feature: Ceres CLONE 1537881
  misc_feature: SWISSPROT Homolog: EC 3.2.1.23 Beta-galactosidase
ctccccgcggtggcggccgctctagaactagtggatcccccgggctgcaggaattcgtctcacccctagaaaaaagtttgaacattacaaatagcataagggcctctagccgggttggttaggtagtctgagtagcacttcctcatgtcctgtgtgtgggagcgaatgtcagactgtggttaaaaaaatatcccatcgtttgtcccacgccaaagtacaggtctaaagcttagtctcagtcgcggtcattctcatatgggttttgatgctgctgcgtatgagttgggtagggtttagaggttttctcgacctgagtgaggtctttttaaacagaactccaaaggctgtcttacccgcaaaaaaaaaaaaaaaaacgagacgctcgaggtacccaattcgccctatagtgagtcgtattacgcgcgctcactggccgtcgttttgcatcgtcgtgactgggaaaaccctggcgttactcaacttaatcgccttgcagcacatccccctttcgcatgctggcgtaatagctaagaggcccgcaccgatcgcccttcccaacagttgcgcaccctgtatggcgaatggacattgtaagcgtaaatcttttgtaaaaattcgcgttaaactttttggtaaatcaactcatttttttaacccaaaagc

SEQ ID NO: 65954 - DNA, 593 bp, Zea mays
  misc_feature: Ceres CLONE 1537888
  misc_feature (279)..(279): n is a, c, t, g, unknown, or other
  misc_feature (335)..(335): n is a, c, t, g, unknown, or other
ggagctcaccgcggtggcggccgctctagaactagtggatcccccgggctgcaggaattcgtctcacccctagaaaaataaaacctatgcttcctgccaacggagtgactccatggcctgtgctgggacacctgtgagatgacgtgatcgagctagtagtacaagtacaactgccccagcccacgttgccacggcgggcatattatgcgatgccagcagcagatgtactactggctgctttgtatttgaactacacacttgtgaagaccttgtagttangacctgatctagttatgccccttctgtgtatccccatgctatattttatttcctgnatccctatgtcatccatcttgggtgctggaagttgtaaatgattggaatcctccgtacccatggggactatgggagggggggaggtatttgaccttttccccctaaatccattgcccaaaaggggaacctttactttaaaaaaaaaaaaaaaacgggaccccccggggacccccatttccccccttaagggggggctattttacccgggcgctcctggggccgggttttttcacacccccgtgacggggaaaaacccc

SEQ ID NO: 65955 - DNA, 693 bp, Zea mays
  misc_feature: Ceres CLONE 1537892
  misc_feature: Translation starting site: 174
  misc_feature: Pfam Name: Barwin Pfam Description: Barwin family
  misc_feature (344)..(344): n is a, c, t, g, unknown, or other
  misc_feature (518)..(518): n is a, c, t, g, unknown, or other
  misc_feature (571)..(571): n is a, c, t, g, unknown, or other
  misc_feature (575)..(575): n is a, c, t, g, unknown, or other
  misc_feature (576)..(576): n is a, c, t, g, unknown, or other
  misc_feature (616)..(616): n is a, c, t, g, unknown, or other
tggagctcaccgcggtggcggccgctctagaactagtggatcccccgggctgcaggaattcgtctcacccctagaaaaaaagtagcagctacatacgtcctcctccattaatattggcagcaagctaggatcatcagcatctgagcttattattactaaatcgatcggttgccatggcggggatgagagtcggcaagctggcgcttgctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgngacgccagcaagccgctgtcgtggcgcatgaagtacggctggacggccttctgcgggcccgccggccccaccggccaggccgcgtgcgggcagtgtctcctggtgaccacacggcgacgggggcgtccatcacggtgaggatcgtggaacagtgcagcaacggcggctggaccntgactacgacacggcgttcaggccatcgacaacaacgggacagggcttcaggncggnnccactcaccgtcaactaacagttcgtcaactgcggcgacnactgaactgaagaattatccccctgggcatgcccctatggtactagcccctttattcccggagtttttgggttggga

SEQ ID NO: 65956 - DNA, 654 bp, Zea mays
  misc_feature: Ceres CLONE 1537899
  misc_feature: SWISSPROT Homolog: EC 3.2.1.23 Beta-galactosidase
  misc_feature (654)..(654): n is a, c, t, g, unknown, or other
tccccgcggtggcggccgctctagaactagtggatcccccgggctgcaggaattcgtctcacccctagaaaaatcgccttcgcaatatagatgcaaaggtttggttgatgatgctaagaaaattggctggtaattattttgtactgaattttcccttagaattaaatatagatggctagtgtctagtggtgatatgatgggattcgtctgtattattcttccaaacagtggggggcaaaagaaagagagcaagcattgctgtctatcctgtattttgcattcatcatgcccctatgatggcttttggcacttagtccaggggaaatgtataattcaacacaaatacattctgtaccggcacaatccataattaaggaacatgtagcattatcagattaaggcctccttcgtggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatggaaattgtaagcgtn

SEQ ID NO: 65957 - DNA, 633 bp, Zea mays
  misc_feature: Ceres CLONE 1537902
ctccccgcggtggcggccgctctagaactagtggatcccccgggctgcaggaattcgtctcacccctagaaaaataagtatctatggattgaagcgaattatcaggcacacaagctgtactttgtcatgtccctttgagtacgcatcagtgtcatgcaggtggtaatgtcttgtagtggtccgtttaggcggtgtagtcatgggaacgcgacatcagatacctggtttcttttgattgtgatgttatcttgcattattgcacctgtaggatttgttgaagctcatattttccagggttttggatcttttgtgctagtcttaagtctttgtgtatgcaggcgtggagctaggattatgatataaggggtcaactaattcatcaatactatatgatgttatcaagctttgcgcagactgaatggcaaaaagaaaaattgtaaacgttaatattttgttaaaattcgcgttaaatttttgttaaatcagctcatttttttaacctttaggccgaaaacggcggaaacccttagaaaccccaaattccccctaaaatagggttaattgccgccccacttggcaaccgttttcaccattaaagaccgggaaaaacccggtctaacccacaaaaaaccc

SEQ ID NO: 65958 - DNA, 684 bp, Zea mays
  misc_feature: Ceres CLONE 1537908
  misc_feature: Encodes the peptide sequence at SEQ ID NO. 65959
  misc_feature (448)..(448): n is a, c, t, g, unknown, or other
ggagctccccgcggtggcggccgctctagaactagtggatcccccgggctgcaggaattcgtctcacccctagaaaagctcttctcgccaatcacaaaaaccctaagcgccgccggacaattcgttgctcgcgatcctcgcttcgggatccggaagagatggccaagtcgaagaaccacacggcgcacaaccagtcgtacaaggcgcacaagaacggcatcaagaagcccaagcgccaccggcagacctccaccaaggggatggaccccaagttcctgaggaacctgaggtattcaaggaagggcaacaagaagagtggtgaggctgaggagtaggaaggaaagcatggttgtgttttctatgttttagctcagttgtaaggtggaactaaatgggtgtatctgatggcaaggaccttttgctccgaaatgtttttatgataatcatngtttgaagagttacgggttactttctaaaaaaaaaaaaaaacgagacgctcgaggtacccaatcgccttatagtgagtcgtattacgcgcgctcactgggcgtcgtttttacacgtcgtgactgggaaaaccctggcgtaccccactaatcgcctttgaagccaatcccctttcgccagctggggtaataaccaaaaggcccccccaatcgcctttccaaatttgccagccctgaa

SEQ ID NO: 65959 - protein, 58 aa, Zea mays; identical to SEQ ID NO: 1725
  misc_feature: Ceres CLONE 1537908
  misc_feature (3)..(42): Pfam Name: Ribosomal_L29e Pfam Description: Ribosomal L29e protein family

SEQ ID NO: 65960 - DNA, 659 bp, Zea mays
  misc_feature: Ceres CLONE 1537911
acccgcggtggcggccgctctagaactagtggatcccccgggctgcaggaattcgtctcacccctagaaaaatgtgaagtaataaaaaatatttagaccaaagaccgtttggccctgttttatagaaatcaagctatgtttgattgtccgagagggagacatccacacccagctcgagtcaagaaaagggaggccaaaaaagctgcactgaagccctggtggcctaggaagaaattctgttaaatttgatctatgtttgccgaccctgccgggtgcccttctccccctctggggagagatataccccgcctgccactgcagctttattttatgttcctgctgcgggaaaaacccgggggcgacccgctcaaggcaccctgtcccccctccccctagccccattgggcgcaatcacaaaaaggccctaaacaacgccctgaccgaaaaaaccctgaccttacccggctaaggcaacttgcagcccttccccttttcgcaaactggcgtaaaaactatgaggcccgcacccattttcttacccaaaggggcgaaacccgaaaagccccttggaaatcgaaagactcccccgaaaggggggggccgcgttacccttttgggaaaacagctccttttttaaaccagtgggcctcaatcggcaa

SEQ ID NO: 65961 - DNA, 639 bp, Zea mays
  misc_feature: Ceres CLONE 1537914
  misc_feature: Encodes the peptide sequence at SEQ ID NO. 65962
tggagctcaccgcggtggcggccgctctagaactagtggatcccccgggctgcaggaattcgtctcacccctagaaaaaatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccatcgtcgcctaaaataaaaaaaaaaaaaaaacgagacgctcgaggtacccaattcgccctatagtgagtcgtattacgcgcgctcactggccgtcgttttacaacgtcgtgact

SEQ ID NO: 65962 - protein, 63 aa, Zea mays; identical to SEQ ID NO: 8705
  misc_feature: Ceres CLONE 1537914

SEQ ID NO: 65963 - DNA, 674 bp, Zea mays
  misc_feature: Ceres CLONE 1537916
  misc_feature: Encodes the peptide sequence at SEQ ID NO. 65964
  misc_feature (420)..(420): n is a, c, t, g, unknown, or other
  misc_feature (421)..(421): n is a, c, t, g, unknown, or other
ggagctccccgcggtggcggccgctctagactagtggatcccccgggctgcaggaattcgtctcacccctagaaaaaaaaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaaaccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgcccatgtatgaatctagtccttcctttnnctgtatctccatgtgacgcggcgtgtgcgtcccctcatgtgtgatgatgccggatgaatactacaattaagacgttgttgcggaaaaaaaaaaaaaaacgagacgctccgagtacccaattccccttaaaagtgagtcgtattacgcccgctacacgggccgtcgtttttacaacgtctggactgggaaaaccctgggcgttacccaacttaatccgccttggagaaattccccccttttccccgctggggaa

SEQ ID NO: 65964 - protein, 63 aa, Zea mays; identical to SEQ ID NO: 28299
  misc_feature: Ceres CLONE 1537916

SEQ ID NO: 65965 - DNA, 637 bp, Zea mays
  misc_feature: Ceres CLONE 1537920
  misc_feature: Encodes the peptide sequence at SEQ ID NO. 65966
agctccccgcggtggcggccgctctagaactagtggatcccccgggctgcaggaattcgtctcacccctagaaaaaatccaagctcgaagcaaggagatctatgctccaggcagcgtcgcgacagaatgagctagtgagtagcacgacaacaaccatggcttccctgaaggcacgcgaagcccagcggagttgccgcgcagggcaaggagccggcgcccaagctcagcgagacggccacgaacccgtccgccgccaagagcggcggcgttaacaacgctgagcataagccccgggaaaccaaaaggaaggtgaagagcatcaaacatgcggcggcggccaaaaagtgacgtacagtacgagtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgaacaaaaaaagaatcacgagacgctcgaggtacccgattctccctatagtgagtcgtattacgcgcgctcactggccgtcgttttacaacgtcgtgactgggaaaaccctggcgttcccaactctg

SEQ ID NO: 65966 - protein, 39 aa, Zea mays
  misc_feature: Ceres CLONE 1537920
MRRRPKSDVQYEWSVMELPCMSESMPCYESSPSFLVSSM

SEQ ID NO: 65967 - DNA, 556 bp, Zea mays
  misc_feature: Ceres CLONE 1537929
  misc_feature: SWISSPROT Homolog: EC 2.5.1.54 3-deoxy-7-phosphoheptulonate synthase
ccccgcggtggcggccgctctagaatagtggatcccccgggctgcaggaattcgtctcacccctagaaaaaagaggagagagtcgctctgcactgcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcgtgcacgttcctcccgctgaagaggcgcaccatctcccgcatccacgccgccgacccgtctaagaacaacgggcccgccgtccccgcggtccgcggcgctaatcatctgcctctgcggggccacccccgaaaagaatcggccgcccccggtaagttgggccgcccaacacctgaaacccaaaaaggccctccatctcccaaaattcccaaaccccgggggacctggaaacgggggcccaaaaaaccacagaaaacttccccccccggggggggttttcccccgaaaaaaggcccccccccctccaagaaaggcgcg

SEQ ID NO: 65968 - DNA, 628 bp, Zea mays
  misc_feature: Ceres CLONE 1537937
  misc_feature: Encodes the peptide sequence at SEQ ID NO. 65969
  misc_feature (589)..(589): n is a, c, t, g, unknown, or other
tccccgcggtggcggccgctctagaactagtggatcccccgggctgcaggaattcgtctcacccctagaaaaagcctcctgtcgctcgctctccctgtctcccgcacgccgacccgcagccgccgccgttcgccatggggtttcactcgacgcagctctaccgtgtggtgatgcgccgcaacgccgtctacgttaccttcgtcgtcgccggcgctttcgcgggcgagcgggcggtggactacggcgttcacaagatctgggagatgaacaacctcggggaaaaaggtacgaagacatatcgggttttggggcagaggccccagcttgaggaaatgataaaatttttgggtcaacccagtttttgctttcgggttttgaacccgtttttcatttttgggccccaggttaattaaaaccaaatgttaaaaactttacgccgggctcccgggggaacctccctttccccatttcggtttaacttccggaaaaaaaggcctttttgtgtgggggggaatctccccccggggggtcttttgtgttttgtaaaaacccccgtttttttttttttggaaaaacactggcccccccncgcttcgttgtgttataaaaaatttcgcgtcgggggggc

SEQ ID NO: 65969 - protein, 92 aa, Zea mays
  misc_feature: Ceres CLONE 1537937
  misc_feature (5)..(60): Pfam Name: UCR_UQCRX_QCR9 Pfam Description: Ubiquinol-cytochrome C reductase, UQCRX/QCR9 like
MGFHSTQLYRVVMRRNAVYVTFVVAGAFAGERAVDYGVHKIWEMNNLGEKGTKTYRVLGQRPQLEEMIKFLGQPSFCFRVLNPFFIFGPQVN

SEQ ID NO: 65970 - DNA, 784 bp, Zea mays
  misc_feature: Ceres CLONE 1537945
ggcggccgctctataactagtggatcccccgggctgcaggaattcgtctcacccctagaaaaaatggagtgaagttgcccttggttgggacatggtgtttcccttcgcatgtggcctttagttttgaacgacagttattatgtactagtgaatattactctgatcggccagtgctgacatatgcaaaaaaatgttctgtcggtatacattggaaccaaagttattgctggttaaataaaaaaaaacaagactctcggggttcccaatttccccctatagtgagtcgaaattagccccccttcaccgggccggtgatttccacaggcccgggactgggaaaaaaccctggggttttacaaaattttatccccccttggggggagagtccccccttttaaaaccgcttgggggggcacccccccaaaagggcccttaccccatttgcccctttcctcaaatattcgatctcccccgcaattgggggaaatgggaaatttgcgccgcgcctcaaaatttttgtgaaaaaaatccgccgctaaaattttttgtgtgaaaaaaggcgccctttttttttaaacaaaggcggggcgaaaaacagggaaagaacccccccctatcttactcttgaaaaaattaccccccactaataatgcgcgacaaaatttttcctcccctctcttatgaagaaagagctgcccccctattaatataaaagagattggttccccccccccttcccgtggggtgggaaaaaaacaccttcctcttgctgggagggtggttg

SEQ ID NO: 65971 - DNA, 468 bp, Zea mays
  misc_feature: Ceres CLONE 1537951
  misc_feature (226)..(226): n is a, c, t, g, unknown, or other
  misc_feature (229)..(229): n is a, c, t, g, unknown, or other
ctcccgcggtggcggcgctctgaactagtggatcccccgggctgcggattcgtctcacccctagaaaaattttgttaagagtatgtttttggacgatcctatatttcgtcctggcgctactatgtttcagaatggtggtactactataagtatcctggcgctttaagtattgcttgaaggatcaatataatttgcgtgtcatacccacaaaaaaaaaaaaaaaaanccnaaagacgcttcgaagggtaccccaattccccccctaaagggggggagcgtattttacccgcccccctcccctggggcccttccgtttttttacaaaccctttcttggaacctgggggaaaaaaaaccctggggggtgttttcccccccccattttaaaaaacccccccttttgtggaaaaaaaaaaaccccccccccctttttttttcccccccacaaggggggggggggaaaaaaaaa

SEQ ID NO: 65972 - DNA, 687 bp, Zea mays
  misc_feature: Ceres CLONE 1537959
  misc_feature (687)..(687): n is a, c, t, g, unknown, or other
agtggatctccccgcggtggaggccgcacaagaactagtggatcccccgggctgcaggaattcgtctcacccctagaaaaatgaggtgaacatatttatgagttgtcagatgagcttcggatgcaagctgggttaccgtgtcctcactgattttcatacttctcactattctgagttgtccacctcatcgagcttgcggtctctttagaatgtcacctgtggctaacactatttatattgatccctcactgctgaaactgcttattcagttccacctcctcccctcttgcgagaacaaagataactagatattttggatttccaattcgccctatagtgaatcttattacacgcgcgcgctgctcgaggtaccccattctccctatagtgaatcctattacgctcgctcactgacccgccttgtacaacatccccattgcgacaaccgtggtattacccaacaagctcgccttgatccaccttcccatttcttgcgctggcctaatggcgaataagacattcaccgctctcccattctcaacaaaaacccccgcctaaaattgtcgaaaaggaaatctcaaagcctttaacccctttgggcccaaaattcccggtgaaaaattttttggttaaaattcacacccaaattttttcctaaacccaaagagggtccacaaaattttcgtn

SEQ ID NO: 65973 - DNA, 651 bp, Zea mays
  misc_feature: Ceres CLONE 1537963
  misc_feature: Encodes the peptide sequence at SEQ ID NO. 65974
ctccccgcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatggg

SEQ ID NO: 65974 - protein, 140 aa, Zea mays
  misc_feature: Ceres CLONE 1537963
  misc_feature (4)..(97): Pfam Name: IBB Pfam Description: Importin beta binding domain
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAW

SEQ ID NO: 65975 - DNA, 528 bp, Zea mays
  misc_feature: Ceres CLONE 1537965
  misc_feature (414)..(414): n is a, c, t, g, unknown, or other
  misc_feature (415)..(415): n is a, c, t, g, unknown, or other
  misc_feature (499)..(499): n is a, c, t, g, unknown, or other
tggcggccgctctagaactagtggatcccccgggctgcaggaattcgtctcacccctagaaaaatcccccctctccacactgccaactcgctccgaagagggaggaggacgacgccggttgccactgccactgccgcgccgctcccgtctcccctccctccgcgggaactcggcgccaccatgctgtccacgcgcaccgtccgcctgtcgccgcctccgcgtcacccgcctccccgtggaagctgggaggaacggagcgagggcggggcgcccagcctggcagaccgggaggcccggaacctcaggaacaccctgcggagagggccgcccgccaaggggccgcctgccccccaagcggggggggaaaccggcccccaaaatgtcccccccccccccgggaaaaaagggggggtnnccccccaaaaaaaaacccggaggggggcgggccccccccccaaaaaaaaaacccccccctttttccccgcggggggaccccccnccccccccggagaggggggaccccccttt

SEQ ID NO: 65976 - DNA, 660 bp, Zea mays
  misc_feature: Ceres CLONE 1537966
  misc_feature: Encodes the peptide sequence at SEQ ID NO. 65977
  misc_feature (170)..(170): n is a, c, t, g, unknown, or other
  misc_feature (353)..(353): n is a, c, t, g, unknown, or other
  misc_feature (371)..(371): n is a, c, t, g, unknown, or other
  misc_feature (398)..(398): n is a, c, t, g, unknown, or other
ggagctccccgcggtggcggccgctctagaactagtggatcccccgggctgcaggaattcgtctcacccctagaaaaaactcgtgccgtgcactcgacccgtcccccctccctccactcgatccacccgccaagacctcccatgtgccgccgccgagccagccagggggnggagaagagaggccagccgcgtcgcggcgggcggaggaggaggacgagcgggagagccgagccgagccggccgggcaggatgttcgggcgggacccctggggcgggccgctggagatctccatcgccgactcggcgacggacgacgaccggagccgcgacctggaccgggcggcgctgatgcngcagctggacaataccancaaagctggctcctggccgggcccgcntaacagccggcaataaaaaaaacggtacgtcaactcggttgggtcgtcctcaaacgtaaggcctcttggggaaccgggggcccttcccgggccccgggggttttaaaggggttccaataatgaagcgaaaaacccgcccccaaaaaacgccccccccccccccccccaaaaaataacaccgggggggcaaaaagggggcttttttttctaaaccccaaagagggggagccccccccccaaaaatttaattccccccgaaaaa

SEQ ID NO: 65977 - protein, 54 aa, Zea mays
  misc_feature: Ceres CLONE 1537966
  misc_feature: SWISSPROT Homolog: EC 3.2.1.4 Cellulase
  misc_feature (35)..(35): Xaa is any aa, unknown, or other
  misc_feature (41)..(41): Xaa is any aa, unknown, or other
  misc_feature (50)..(50): Xaa is any aa, unknown, or other
MFGRDPWGGPLEISIADSATDDDRSRDLDRAALMXQLDNTXKAGSWPGPXNSRQ

SEQ ID NO: 65978 - DNA, 644 bp, Zea mays
  misc_feature: Ceres CLONE 1537968
  misc_feature: Encodes the peptide sequence at SEQ ID NO. 65979
ggagctccccgcggtggcggccgctctagaactagtggatcccccgggctgcaggaattcgtctcacccctagaaaaagttcgcgggcgcatgcggttttcgcgcccgcgctctcgccggcgccgcagccgctacaatgccgtcgcacatagaccttcgcggatcgcgaataagctggctaagaagatgcgccagatccgccccatcccctactggatccgcgtgcacactgaccataccatcacgtacaactccaagcgcaggcactggcacctcaccaagctcggcttctgagcgtctggattggccggctgctgcgtcagaaggctagggtctaagagctatcttccttctgttttatcactgtgtcagtttttctgtaagctagcaagtgttgctatgacgcttttattaagattctggtgagcggtgatgttaagagaaaattggctctactgtggtgtaccccaagattccttgcagcattgctatgctaagtaaagaaccctttatcttattatatatgccttgctgcatctggttgaggtaccgaagaggcccgaaccactagacgctcgaggtaccctgttcgccctatatggagtcgtattacgcgcgctcacaggccgtcgttatacaacggc

SEQ ID NO: 65979 - protein, 67 aa, Zea mays
  misc_feature: Ceres CLONE 1537968
  misc_feature (25)..(67): Pfam Name: Ribosomal_L39 Pfam Description: Ribosomal L39 protein
MRFSRPRSRRRRSRYNAVAHRPSRIANKLAKKMRQIRPIPYWIRVHTDHTITYNSKRRHWHLTKLGF

SEQ ID NO: 65980 - DNA, 679 bp, Zea mays
  misc_feature: Ceres CLONE 1537970
  misc_feature: Encodes the peptide sequence at SEQ ID NO. 65981
  misc_feature (450)..(450): n is a, c, t, g, unknown, or other
  misc_feature (486)..(486): n is a, c, t, g, unknown, or other
ggagctcaccgcggtggcggccgctctagaactagtggatcccccgggctgcaggaattcgtctcacccctagaaaaaaccatttttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgactttgtaaangtttgatggctactttgtgcttgttgggacagctantatcagaagaattgaattttctcaaaaaaaaaaaaaaaacgagacgctcgaggtacccaattcgccctatagtgagtcgaattacgcgcgctccctgggccgtcgttttcaaccgtcgtgacgggaaaaaccctggctttcccaacttaatcgccttgcagcaaatccccctttccccagctggcgaaaaaag

SEQ ID NO: 65981 - protein, 56 aa, Zea mays; identical to SEQ ID NO: 1999
  misc_feature: Ceres CLONE 1537970
  misc_feature (3)..(56): Pfam Name: Ribosomal_S14 Pfam Description: Ribosomal protein S14p/S29e

SEQ ID NO: 65982 - DNA, 654 bp, Zea mays
  misc_feature: Ceres CLONE 1537972
  misc_feature: Translation starting site: 438
  misc_feature: SWISSPROT Homolog: EC 2.7.11.1 Non-specific serine/threonine protein kinase
ggagctccccgcggtggcggccgctctagaactagtggatcccccgggctgcaggaattcgtctcacccctagaaaaaagcaccagctccctccctccggctcccaaccccagcacagcgcagcggcagtcctctctcctctcgctctactcctccagctccccacccctctcccaaaacctcagttcaatcccaggtttcaaatccgccaccttttggacacacaccacacttgcctacccccagagctgagctagctagctgctctctctctctctttgcacctaagcgagaacagagcccaagaggcctcaaaagaaccactgcacttcctccgcagagctcggcgccctctctctcctatcagtcctcccagctccagctaccacagcagccctctcgcttaaaggaggagggagaagagggcggggcgagcaatgtcagagcagcagcagccattgccgcagcctcggagcagcatgcgggaggctctggagaaggaggacaaggagaaggcggcggctgctgcagcggacaaagagaaagcggccgtccccaagaacggcaacggatacggcggcaagaatggcggcggcgccagcagcggcaacggcggagcgcccccgcagtccggggaggagacggcccgcgaga

SEQ ID NO: 65983 - DNA, 641 bp, Zea mays
  misc_feature: Ceres CLONE 1537973
  misc_feature: Encodes the peptide sequence at SEQ ID NO. 65984
ggagctccccgcggtggcggccgctctagactagtggatcccccgggctgcaggaattcgtctcacccctagaaaaagagcttgacatcgatctcaccggcgggcatccgcagaggccttgcgctgccgatgtggatttgcccagattagtcctggcaaagcgcgcttgtttcccatctcatcagatctgtaggattcagcgagtggtgccgatcagatattttgcccgtgcaatggatccatgatctctgccccctcctgcccactcgtttcgggaacatgacatgccacttttggccacgaacttttcgcagctcccgtcaatcttgtggtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctcggctacgcggcctggccgctgtactggatcgcgcagg

SEQ ID NO: 65984 - protein, 99 aa, Zea mays
  misc_feature: Ceres CLONE 1537973
  misc_feature: SWISSPROT Homolog: EC 1.14.99.33 Delta(12)-fatty acid dehydrogenase
MGAGGRMTEKEREKQEQLARATGGAAMQRSPVEKPPFTLGQIKKAIPPHCFERSVLKSFSYVVHDLVIAAALLYFALAIIPALPSPLGYAAWPLYWIAQ

SEQ ID NO: 65985 - DNA, 697 bp, Zea mays
  misc_feature: Ceres CLONE 1537975
  misc_feature (209)..(209): n is a, c, t, g, unknown, or other
  misc_feature (299)..(299): n is a, c, t, g, unknown, or other
ccgcggtggcggccgctctagtactagtggatcccccgggctgcaggaattcgtctcacccctagaaaaaattcttggatttatgaaagacgaacaactgcgaaagcatttcccaagattacggaatttgagttccaataaacggaatataccttcttcgatcaccttgaaggattgtatcattagaattttcatacagggctggcctntttgagtctctgcctacgcacgcagatgttgtggttcttgtgtttgtagcctatatgtactccctgagtcgattatagaaatgtttatgnccaaaaaaaaaaaaaaaaaaaacgaggaccccttcggaagggtaccccccaaaatttttcccgcccccccttttaaattttggttcctcgtttgttacgtccgctctccccggtgcctttattttttgctattccctcttggtgctttgtgctttcctttcctcttttttccctcccatatccgatttcttttttttcgagatattaagggctggatgtgcagtcttgccgcttctctgcgttcgttaacacaccgtgttcaacagatatacgtcagtaacattcgcgatagtgtaagaacgttgctttactgtattactttacccgctacttcacccccttttaccccactcccatacatctagatatatatacatcttcgcgggtgtcgattgcgg

SEQ ID NO: 65986 - DNA, 687 bp, Zea mays
  misc_feature: Ceres CLONE 1537979
tggagctcacgcggtggcggccgctctagaactagtggatccccgggcttgcaggaattccgtctccacccctagaaaaatggatgttatggccggcctacctggactcctttttccattagcggttggttgggcagctggtggaagttttccaaggaaatcctttccattccggccggccaatttgatggaaggtttcctttccaaaaaaaaaaaaaaaaccaaacccttccaaggaccccatttcgccccaatggggggcctatttccccccccccccgggcccgcctttttccacctcctggaccgggaaaaccccggccttaccccaccttatcccccttgcaccacttccccttttccccacctggcgaattaccaaagaggcccccaccgatcgcccttcccaacagttgcgcaccctgaatggcgaaagggaaatggtaagcgttaatatttggttaaaattcgcgttaaatttttgttaaatcagctcatttttttaaccaataggccgaaatcggcaaaatcccttataaatcaaaagaatagaccgagataggggttgagtgtttgttccagtttggaacaagagtccactattaaaagaacgtggactcccacgtcaaagggcgaaaaaccgtctatcagggcgatgggccactacgtggaacatcaccctaatca

SEQ ID NO: 65987 - DNA, 654 bp, Zea mays
  misc_feature: Ceres CLONE 1537980
  misc_feature: Translation starting site: 151
  misc_feature: SWISSPROT Homolog: EC 4.1.1.49 Phosphoenolpyruvate carboxykinase (ATP)
  misc_feature: SWISSPROT Homolog: EC 2.7.1.107 Diacylglycerol kinase
  misc_feature (474)..(474): n is a, c, t, g, unknown, or other
  misc_feature (475)..(475): n is a, c, t, g, unknown, or other
  misc_feature (626)..(626): n is a, c, t, g, unknown, or other
ggagctccccgcggtggcggccgctctagaactagtggatcccccgggctgcaggaattcgtctcacccctagaaaaaacgaccgcttggcgcttcatcactcgttccctttcgaaagcccgcgcacgagcaggacctcgatcggacgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgactcgtgaacccgggccgaaagtggtcaagggcgaccctgccgcnnaagggggaggccgccgcgcagggcgcgccttcgacggcgaagggcgcaccattagaacaggccccccggccgcccccgcattggacgtcaggcgacccccccccccagtacccgcctgtggcccacaacctctcccccgggtgacctgtancaaacaggcccctcaagaacaagaaggg

SEQ ID NO: 65988 - DNA, 697 bp, Zea mays
  misc_feature: Ceres CLONE 1537991
  misc_feature: Encodes the peptide sequence at SEQ ID NO. 65989
ggagctcaccgcggtggcggccgctctagaactagtggatcccccgggctgcaggaattcgtctcacccctagaaaaaattgtaggtgattagaggcgtctggatgcaattacccgtcaccctttcctaccttattccatgagatgtttaggaaggtttctggtaccatcatgcagatgaaacttacttgatgcgtgcgtactgtctttccgattcgacacttacactacctgtaaacgcaacccaccgtgttggtgttggagcttgtataatgaatgacaaaagagatgtcttgtgtgtacaagacaaagagtggtgtacttcgaggcctaggtgtgtgcaagtgtccactggcgtacttgaccgtgtgcaagatattgatcgtggatccgtataacatcacacaagacagccgctcgaggtactcattcgccctatagcagctccattacgcgcgctaatgccgacctttccaacgtcggactgcaaaaccctgcggttaccaccttatcccttgccagactttcccatttcgcggttgggcaaaatccggaaatgcccaacttaatcccttttcccaaattcccctttcctaaatgggcaaataaaaatataaagccccaaatttttgtccaaatccccccgttaaattttcttttaacccccctcttttttttttacccattggccctaattt

SEQ ID NO: 65989 - protein, 68 aa, Zea mays
  misc_feature: Ceres CLONE 1537991
MRAYCLSDSTLTLPVNATHRVGVGACIMNDKRDVLCVQDKEWCTSRPRCVQVSTGVLDRVQDIDRGSV

SEQ ID NO: 65990 - DNA, 661 bp, Zea mays
  misc_feature: Ceres CLONE 1537993
  misc_feature: Encodes the peptide sequence at SEQ ID NO. 65991
ggagctccccgcggtggcggccgctctagaactagtggatcccccgggctgcaggaattcgtctcacccctagaaaaatcccggctcgttgccggcggatagaaatcttctactgacttctcccgtgtcgtgctctctctctgccggcggatagaaatcttctactggctcgctgcgacgcgtccggcctctcctctcctctcctcaccccccccccccccccccgcgcgggagcgggtggttgcggtggcggctgaggtttagtcgagggacccggccgaccagcggtcgcgcggcggagccgagggcaaggggatggggaaccaggtcgggggccgacggcggcggcggccgccggtggacgagcgctacacgcgcccgcaggggctgtacccgcacccggacatcgacctcaggaagctccgccgcctcatcctcgaggccaagctcgcgccctgccaccctggcgccgacgacgcgcgcgccgacctcgacgagtgccccatctgcttcctgttctaccccagcctcaaccgctccaagtgctgcgccaagggaatttgcacggagtgcttcctccagatgaagtcgcccacctcgtgcaaaccgacgcagtatcctgactaaactcacttcatttcgaatccagagcctggtgctc

SEQ ID NO: 65991 - protein, 103 aa, Zea mays
  misc_feature: Ceres CLONE 1537993
MGNQVGGRRRRRPPVDERYTRPQGLYPHPDIDLRKLRRLILEAKLAPCHPGADDARADLDECPICFLFYPSLNRSKCCAKGICTECFLQMKSPTSCKPTQYPD

SEQ ID NO: 65992 - DNA, 621 bp, Zea mays
  misc_feature: Ceres CLONE 1538000
  misc_feature: Translation starting site: 163
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagtgtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccctcaggtcatttctgggcctggtgagagcccatgatttgtgtccagcacaagggtgaagagaagcagtttgcagctgaagagatctccctctatggtctttatcagatgcgtgagatggctgaagcttacttgggtagcacgatcaagaatgctgggggccacgtccctgcctactt

SEQ ID NO: 65993 - DNA, 646 bp, Zea mays
  misc_feature: Ceres CLONE 1538001
  misc_feature: Encodes the peptide sequence at SEQ ID NO. 65994
  misc_feature (620)..(620): n is a, c, t, g, unknown, or other
ctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcatggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtattaaccangatggcatcgattactacaaaggctc

SEQ ID NO: 65994 - protein, 167 aa, Zea mays
  misc_feature: Ceres CLONE 1538001
  misc_feature (63)..(167): Pfam Name: Glyco_hydro_1 Pfam Description: Glycosyl hydrolase family 1
  misc_feature: SWISSPROT Homolog: EC 3.2.1.21 Beta-glucosidase
  misc_feature (159)..(159): Xaa is any aa, unknown, or other
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINXDGIDYYKG

SEQ ID NO: 65995 - DNA, 643 bp, Zea mays
  misc_feature: Ceres CLONE 1538004
  misc_feature: Encodes the peptide sequence at SEQ ID NO. 65996
  misc_feature (350)..(350): n is a, c, t, g, unknown, or other
  misc_feature (362)..(362): n is a, c, t, g, unknown, or other
  misc_feature (385)..(385): n is a, c, t, g, unknown, or other
ggagctccccgcggtggcggccgctctagaactagtggatcccccgggctgcaggaattcgtctcacccctagaaaaaaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagntgacgtacagtnacgtgtgggagtgtaatgggagncttccatgcatgagtgaatccatgcccatgtatgaatctagtccttccttttctgtatcctccatgggacgcggcgtgtgcgtcccctcatgtgtgatgatgcaggatgaacctacaaaatagaagttggtgtgaaaaaaaaaaaaaaaagaaaggctcgagggacccaatcccccctttaggagagcttataacgcgccttccgggcgtctttttaaaccgtggggaggggaaaaccctggggtttcccaattaatc

SEQ ID NO: 65996 - protein, 115 aa, Zea mays
  misc_feature: Ceres CLONE 1538004
  misc_feature (64)..(64): Xaa is any aa, unknown, or other
  misc_feature (68)..(68): Xaa is any aa, unknown, or other
  misc_feature (75)..(75): Xaa is any aa, unknown, or other
MASLKAAKPSGVAAQGKEPAPKLSETATKPSAAKSGGVKKAEQKPRETKRKVKSSKQAAAAKKXTYSXVWECNGXLPCMSESMPMYESSPSFSVSSMGRGVCVPSCVMMQDEPTK

SEQ ID NO: 65997 - DNA, 653 bp, Zea mays
  misc_feature: Ceres CLONE 1538005
agctccccgcggtggcggccgctctagaactagtggatcccccgggctgcaggaattcgtctcacccctagaaaaatgtgctcatccgtgggaccttctatcatgctaaacatcaaagaaatgcttgactatggattggaatcatctgaataaatgtgaccacaggtgccagatgagactgctggcttcgttatcatcttcatagattacctatttgctccttgcgacatatgactagaaacatggttggtgtatgacaagcaggtgcttatgtacatttttctcattttctatggcacatcatcagagtagctaatgtcacccatattgacgaagagatggctagtcggccatgtctacaagaaacatgatgcacggtctcatacatgtctgtctctgagacgctagctgtagtgttcatattttgtcgatagcatcctttagcttaagccgtaccaccccatgcatcatctgtcaccgcgaaccaaatatcctagtaataacaagttcagaagatggattcattccctgctgaaccccctccctcttttttcaagaaagaatccctttaggttaaaagaaaaaaaatatcccacccttttgggaggttccaaattcgcccccttttggggggttgtttttccggccctcgg

SEQ ID NO: 65998 - DNA, 652 bp, Zea mays
  misc_feature: Ceres CLONE 1538006
  misc_feature: Encodes the peptide sequence at SEQ ID NO. 65999
gtacctggagctccccgcggtggcggccgctctagaactagtggatcccccgggctgcaggaattcgtctcacccctagaataaccagccaacacatgtcaagtcggagcccgcaggtgtcgacaccgcgcgccgggagccggaagaagggtggggggtgagctgtggaccatgagcgcgaccgggcgagccccgtgcggcctgccgcgcatcggcctgggcacagcggtgcatggcccgcggccggaccccgtccgcgccgcggtgctgcgcgccatccagctcggctaccgccacttcgacacggccgcgcactacgcctccgaggcgcccatcggggaggccgccgccgaggccgtgcgcacggggctcgtcgcctcccgcgaggacctcttcgtcacgtccaaagtctggtgcgccgactcgcaccgggacagggtgctcccggccctccgccggacgctcagcaatctccagatggaatacgtggacctgtgcatggtgcactggcccgtgaccatgaatgccgggaggttcacagcccccttctcgcccgacgacttcgagccgctctacatgcaggccgtgtgggaggccatggacgagtgccaccgcctgtgcctggccaatgccatcggcgtgtgcaacttct

SEQ ID NO: 65999 - protein, 160 aa, Zea mays
  misc_feature: Ceres CLONE 1538006
  misc_feature (7)..(160): Pfam Name: Aldo_ket_red Pfam Description: Aldo/keto reductase family
  misc_feature: SWISSPROT Homolog: EC 2.3.1.170 6'-deoxychalcone synthase
MSATGRAPCGLPRIGLGTAVHGPRPDPVRAAVLRAIQLGYRHFDTAAHYASEAPIGEAAAEAVRTGLVASREDLFVTSKVWCADSHRDRVLPALRRTLSNLQMEYVDLCMVHWPVTMNAGRFTAPFSPDDFEPLYMQAVWEAMDECHRLCLANAIGVCNF

SEQ ID NO: 66000 - DNA, 682 bp, Zea mays
  misc_feature: Ceres CLONE 1538007
  misc_feature: Translation starting site: 167
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaattcaccacgcaccccccacctgccttgtgctctctgtccatatcttccggcggccgtcgatcgactttacaagcagcagcaaagagatgtcggacggcacggccacctgcgtcgacatcatcctcgccatcatcctgccgccgctcggggtcttcttcaagttcggctgcggggctgagttctggatctgcctcatcctcaccttcttcggctacctcccaggcatcatctacgctgtctgggtcatcaccatgtagccggccggccgagaggaaccacggttccctgccactgccaggcagacatgcagctggccgtgctgtcttattaattgctagcttctgtttccgctgaagaatcatcaggacgcatgtacttggatcgatcgatggatcattaatgagctgtttctttctttcaaaaaaaaaaaaaaaaacgagacgctcgaggtacccaattcgccctatagtgagtcgtattacgcgcgctcactggccgtcgttttaaacgtcgtgactgggaaaaccctggcgttacccaacttaatcgccttgcagcacatccccctttcgccagctggcgtaatagcgaagaggcccgcc

SEQ ID NO: 66001 - DNA, 649 bp, Zea mays
  misc_feature: Ceres CLONE 1538028
  misc_feature: Encodes the peptide sequence at SEQ ID NO. 66002
  misc_feature (649)..(649): n is a, c, t, g, unknown, or other
ggagctccccgcggtggcggccgctctagaactagtggatcccccgggctgcaggaattcgtctcacccctagaaaaaaccactccctccctccggctcccaaccccagcacagcgcagcagcagtcctctctcctctcactctactcctccagctcccccacccctctcccaaaacctcagttcaatcccaggtttcaaatccgccaccttttggacacacaccacacttgcctacccccagagctgagctagctagctgctctctctctctctcttttcacccaagcaagaacagagcccaagaggcctcaaaagaaccactgctcttcctccgcatagctcgtcgccctctctctcctatcagtcctcccagctccagctaccacagcagccctctcgcttaaaggaggagggagaagggggcgaggcgagcaatgtctgagcagcagcagccattgccgcagcctcggagcagcatgcgggaggcgctggagaaggaggacaaggagaaggcggctgcggcggcggcggccaaggagaaggcggcagtccccaagaacggcaacggcaacggcggcaagaatggcggcggcgccggcagcggcaacggcggagcgcccccgcagtccggggaggagacggcccgn

SEQ ID NO: 66002 - protein, 71 aa, Zea mays
  misc_feature: Ceres CLONE 1538028
MSEQQQPLPQPRSSMREALEKEDKEKAAAAAAAKEKAAVPKNGNGNGGKNGGGAGSGNGGAPPQSGEETAR

SEQ ID NO: 66003 - DNA, 631 bp, Zea mays
  misc_feature: Ceres CLONE 1538031
  misc_feature: Encodes the peptide sequence at SEQ ID NO. 66004
cgtccgccattcttcataggatcccccgggctgcaggaattcgtctcacccctagaaaaatctccgtctcagaacgccccagccttccacctcgaactccgcggcgcccagcgccctcggtaaccgccccccgccccgccacagagacaggtcgacgagacagacaaaggccggccgccatgggagaggacaagaaggcgggcaacaaggacgccgccggcggcgacaagaagaaggacgccggcgccggggccgcgccgcagcccatcgtgctgaaggtcgacttgcactgcgccggctgcgccaacaaggtccgcaaggccatcaagcacgccccaggtgtggagtcggtgacgccggacatggcggcgggtaaggtggtcgtgaccggtccggcggacgcggtggagctcaaggagcgcatcgaggccagggcgaagaagcccgtgcagatcgtctccgccggcgccggcccacccaagaaggagaaggacaaggagaaggagaaggataagaaagcggacggcggcgagaagaaggcggacaaagagaaaggcggcggcggcggcggatagaagaaggccgacaaggaaaagggcggcggagagaagaaggccgacaaggagaaggg

SEQ ID NO: 66004 - protein, 131 aa, Zea mays
  misc_feature: Ceres CLONE 1538031
  misc_feature (30)..(92): Pfam Name: HMA Pfam Description: Heavy-metal-associated domain
MGEDKKAGNKDAAGGDKKKDAGAGAAPQPIVLKVDLHCAGCANKVRKAIKHAPGVESVTPDMAAGKVVVTGPADAVELKERIEARAKKPVQIVSAGAGPPKKEKDKEKEKDKKADGGEKKADKEKGGGGGG

SEQ ID NO: 66005 - DNA, 654 bp, Zea mays
  misc_feature: Ceres CLONE 1538035
  misc_feature: Encodes the peptide sequence at SEQ ID NO. 66006
  misc_feature (546)..(546): n is a, c, t, g, unknown, or other
ctggagctccccgcggtggcggccgctctagaactagtggatcccccgggctgcaggaattcgtctcacccctagaaaaactccccttccccacctcttcccattgccaagcaagagagaaacgcacgcgagccgcgagcagaacagagcagcgcggcgccatcccgatctcgctatttcccttctcccccgatgcgatctcgccgaaccctaatccccacgcccgacgcccggccgtcgccggagccctagccccgaatgcgggcggtgacgcgcggcgtgccaccaccaccacctcagcgcccgcgcccgcgcccgcgcccgccaccgaccgtcctgcccggccgacaccagctgccatgggcgccgccgacaagtggctgctcccgctcgtctccgtctccttcgtctcgctcctgctcttcctctccgcgctctcgggcttctccgcctcctccgcactcttcgcgcgcctcccgccaccctcctacgtgcgccgaggcgccgccgcaccgccctccttcgcctacctgctcgcgggcgggncggggggacggcaggaagctcctgcggctgctcctcgccgtctaccaccccaggaaccgctacctgctccacactctccgccgacgcgccggcctccgagcgcgccga

SEQ ID NO: 66006 - protein, 98 aa, Zea mays
  misc_feature: Ceres CLONE 1538035
  misc_feature (63)..(63): Xaa is any aa, unknown, or other
MGAADKWLLPLVSVSFVSLLLFLSALSGFSASSALFARLPPPSYVRRGAAAPPSFAYLLAGGXGGRQEAPAAAPRRLPPQEPLPAPHSPPTRRPPSAP

SEQ ID NO: 66007 - DNA, 620 bp, Zea mays
  misc_feature: Ceres CLONE 1538042
  misc_feature (364)..(364): n is a, c, t, g, unknown, or other
  misc_feature (428)..(428): n is a, c, t, g, unknown, or other
  misc_feature (528)..(528): n is a, c, t, g, unknown, or other
  misc_feature (532)..(532): n is a, c, t, g, unknown, or other
tggcggccgctctagaactagtggatcccccgggctgcaggaattcgtctcacccctagaaaaaaagagtagagcaagactcctatcttttttccacgcgccagtcttctctgaaccggtgaacccattcctcctcctcttcctactcaacgccacgatcgaagaggagactcagtcaatctcgccttgctctcctcttcgacccatcgtcggttcctgggatcagcatcgacgagcaggatttttccggctgtggaggattactgctgcttgacaaatccgagcgcaaaggttgcttcctgacgcgttcccccatggcacgagcaggagcacgagcacgagcacgagcaggagaaagcggctnagaggttcctgctcccgggcgtgacctctcacacggcatggtcgttgcttcccggggagcgcancggggatgtcgatagaacaggccgtgctcatcggggtcaccgcggcgtcccgcccccctggtcgcggcggcgggctgctttctggcttctggctctacgncggnggggcaaggtcccccacggaacccctcccggaatcccctcggaaaacctggggccgggggcccggtcgcccaccttaatctcgggttc

SEQ ID NO: 66008 - DNA, 678 bp, Zea mays
  misc_feature: Ceres CLONE 1538045
  misc_feature: Encodes the peptide sequence at SEQ ID NO. 66009
  misc_feature (491)..(491): n is a, c, t, g, unknown, or other
gctggagctcaccgcggtggcggccgctcctagaactagtggatcccccgggctgcaggaattcgtctcacccctagaaaaaattttaagcttgttttatgttggaaagtactggaaagaactgctacttgtctttatatttggtaattcagccgtagattgctatgctggttgggatttactcgtgaaccagagtttttctgtcttatatatcctgaattggttatcccaaagtttcttggctttttaactattttgttgttacatgtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaaatcgccttgcagcacatccccctttcgccagctggcgtaatagcgaagagcccgcaccgatcgcctttcccacagttgcccagctgaaatgcnaatgaaatttgtaacgttaatattttgttaaattccccgttaattttggtaaatcacgctcattttttaacccaaaggccgaaatcgcaaaaatcccttaaaatcaaaaaaatacccaaaaaagggttaaagttttttccatttgggaaaaaagccccttttaaaaaaaggggaccccccgtcaagg

SEQ ID NO: 66009 - protein, 82 aa, Zea mays
  misc_feature: Ceres CLONE 1538045
LELTAVAAAPRTSGSPGLQEFVSPLEKILSLFYVGKYWKELLLVFIFGNSAVDCYAGWDLLVNQSFSVLYILNWLSQSFLAF

SEQ ID NO: 66010 - DNA, 709 bp, Zea mays
  misc_feature: Ceres CLONE 1538053
  misc_feature: Encodes the peptide sequence at SEQ ID NO. 66011
ccccgcggtggcggccgctctagaactagtggatcccccgggctgcaggaattcgtctcacccctagaaaaacacacggatcgaaaacgaattaccctcggtgccctccctctcggcggcggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcgtcatcgtcgaggagtagttcccacgtgtcacctcagaagtttttttttccagttgtttttgaaaactcactctgcacaccacgacaaaatgaaatgctggggagatttgggcttgaaaataagcattaaccattttgagaacaccaacttcctggttgaattggccttttccttgccccaaaaaaaaaaaaaaataacgaaaacgctccgaaggtaccccaatttcccccctaaaggggaagtcgctattaccccgcccccccacttggcgccgtaatttttaaaaaacggccgggaaccggggaaaaaccccctgggcggtttacccacaacttaaactccccttgggaaaaaaaaacacccccttttgcccccaggtggg

SEQ ID NO: 66011 - protein, 62 aa, Zea mays
  misc_feature: Ceres CLONE 1538053
  misc_feature (2)..(62): Pfam Name: COX5C Pfam Description: Cytochrome c oxidase subunit Vc (COX5C)
  misc_feature: SWISSPROT Homolog: EC 1.9.3.1 Cytochrome-c oxidase
MAGGRVAHATLKGPSVVKEIFIGLTLGLIAGGMWKMHHWNEQRKTRSFYDMLDKGQIVIVEE

SEQ ID NO: 66012 - DNA, 653 bp, Zea mays
  misc_feature: Ceres CLONE 1538055
  misc_feature: Encodes the peptide sequence at SEQ ID NO. 66013
  misc_feature (653)..(653): n is a, c, t, g, unknown, or other
tccccgcggtggcggccgctctagaactagtggatcccccgggctgcaggaattcgtctcacccctagaaaaaagcgctttcctgtccgactcccagccgtcgtctgctgcgtactccgcctccagtttggtctgtttcttgcaagttgctcttgcggtagttcccccaactgtcaccatgcaggtccggacccaagcaacttcctcccaccacctcctccctcccatgcccgcatcgagatcttagcgggacagcgagaggagaggcgacgccgacgcgggcgccccctgatccctcctcgccgccgccgccaccgaccgaccgggggaggaggaggggaaaagggaaggacggacacgatggaggcggactccgggaagctcttcgtcggcggcatctcttgggagacggacgaggatcgcctccgcgcgtacttcggtcgctttggcgaggtcaccgaggccgttatcatgcgggaccgcaacaccggccgcgcccgtgggttcgggttcgtcgtcttcgccgattccgggatcgccgaacgcgtcaccctcgataagcacatgatcgacgggcgcatggtggaagcaaagaaggccgttcctagggacgaccagagtattgcgagcaagaacaacagcagcatagggtn

SEQ ID NO: 66013 - protein, 97 aa, Zea mays
  misc_feature: Ceres CLONE 1538055
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIG

SEQ ID NO: 66014 - DNA, 595 bp, Zea mays
  misc_feature: Ceres CLONE 1538060
  misc_feature: Encodes the peptide sequence at SEQ ID NO. 66015
  misc_feature (478)..(478): n is a, c, t, g, unknown, or other
ctccccgcggtggcggccgctctagaactagtggatcccccgggctgcaggaattcgtctcacccctagaaaaaatacatggaagtgctgctattgccagtgcttattctagggcatatgaggagacatttacacttacatttgtgactgggcggactgtaggaataggagcttatcttgctcgacttggtatacggtgcatacagcgtcttgaccagcctattattttaacagggttttctgccctgaacaagctccttgggcgggaagtgtacagctcccacatgcagcttggtggtcctaagatcatggcgaccaatggtgttgtccacctcactgttccagatgaccttgaaggtgtttccaatatattgaggtggctcagctatgttcctgcaaacattggtggacctcttcctattaccaaacctctggaccctccagacagacctgttgcttacatccctgagaacacatngcgatccacgtgcaagctatctgtgggtgtaaaatgaacaccccaagggaaaatgggttgggggggggggaaatttttttaaaaaaaaaaaaaacctttttttggggaaaaaaattt

SEQ ID NO: 66015 - protein, 170 aa, Zea mays
  misc_feature: Ceres CLONE 1538060
  misc_feature (5)..(170): Pfam Name: Carboxyl_trans Pfam Description: Carboxyl transferase domain
  misc_feature: SWISSPROT Homolog: EC 6.4.1.3 Propionyl-CoA carboxylase
  misc_feature: Functional homolog of the protein sequence given in SEQ ID NO 96884
  misc_feature: Useful for making plants with modulated herbicide sensitivity
  misc_feature (159)..(159): Xaa is any aa, unknown, or other
PRGGGRSRTSGSPGLQEFVSPLEKIHGSAAIASAYSRAYEETFTLTFVTGRTVGIGAYLARLGIRCIQRLDQPIILTGFSALNKLLGREVYSSHMQLGGPKIMATNGVVHLTVPDDLEGVSNILRWLSYVPANIGGPLPITKPLDPPDRPVAYIPENTXRSTCKLSVGVK

SEQ ID NO: 66016 - DNA, 647 bp, Zea mays
  misc_feature: Ceres CLONE 1538061
  misc_feature: Encodes the peptide sequence at SEQ ID NO. 66017
  misc_feature (647)..(647): n is a, c, t, g, unknown, or other
cccgcggtggcggccgctctagactagtggatcccccgggctgcaggaattcgtctcacccctagaaaaaacctaacccgacccgaccagaaaccaccgcgcactgacgccgcccggctccgtctccggctccggctcccgctcccgctcgaggtcgaggcccacgcagcaatctggtcttctggaaatctccatcaatccgattccgaacggcagaaaattttcccttcccccggccaccaaccaaccaaacccgagcaaccagcctgagccacctcccatgcgccgcgccgcagcctgaggaggaggaggaggacgcggtggtctggagagggatggagggcgcgtcctcgctgccgcccttcctgagcaagacgtacgagatggtggacgacccggccacggacgccgtggtggcgtggacgccgctggggaccagcttcgtcgtcgccaaccaggccgagttctgcagggatctgctccccaagtacttcaagcacaacaacttctccagcttcgtgcggcaactgaacacctacggctttaagaaaattgatcctgaacaatgggagtttgcaaatgatgatttcattaggggacaacagcaccgactgaaaaatatacacaggcgtaagcctatattcagn

SEQ ID NO: 66017 - protein, 103 aa, Zea mays
  misc_feature: Ceres CLONE 1538061
  misc_feature (8)..(104): Pfam Name: HSF_DNA-bind Pfam Description: HSF-type DNA-binding
MEGASSLPPFLSKTYEMVDDPATDAVVAWTPLGTSFVVANQAEFCRDLLPKYFKHNNFSSFVRQLNTYGFKKIDPEQWEFANDDFIRGQQHRLKNIHRRKPIF

SEQ ID NO: 66018 - DNA, 608 bp, Zea mays
  misc_feature: Ceres CLONE 1538062
  misc_feature: Encodes the peptide sequence at SEQ ID NO. 66019
  misc_feature (507)..(507): n is a, c, t, g, unknown, or other
  misc_feature (517)..(517): n is a, c, t, g, unknown, or other
ctggagctccccgcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccacctttgtctccgcctcaggggaggcatgcagatcttcgtcaagaccctcactgggaagactatcaccctcggaggtggagtcttctgacaccatcgacaacgtcaagggccagatcccagacagggagggcatccctccnggacagcagncgctcatttttgctggcagcagctcgaggacgggcgcacgctggccgactacacattcagaagggagcaccctccacttggtgttgcgtcc

SEQ ID NO: 66019 - protein, 96 aa, Zea mays
  misc_feature: Ceres CLONE 1538062
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLCLRLRGGMQIFVKTLTGKTITLGGGVF

SEQ ID NO: 66020 - DNA, 622 bp, Zea mays
  misc_feature: Ceres CLONE 1538063
  misc_feature: Encodes the peptide sequence at SEQ ID NO. 66021
  misc_feature (218)..(218): n is a, c, t, g, unknown, or other
tggagctcaccgcggtggcggccgctctagaactagtggatcccccgggctgcaggaattcgtctcacccctagaaaaaccgcatcgcctcgccgctgttccccgcaacctatcgacccccatctcgtcgacccggcgcgtcgtcccctccagatttcccgtcgccctctcaggtagcagaaactggtctgctgcagtctgacaaagtggagggcttnggagctcctgcttcctttattcgaaacatccttgctttttttggattgtttggaaaaaaccctccgcgaacttggaaaggggccaggttcccgccccctgcttgggttaaaaaaagggcggggttctttgtcccatttttcaatttcggggggcccaaaccggtttgggtcctccccaggagacccacctccctttttgtggggattttttcccccccttttaacccctttaaatttttttccaaagggggggccgaaaaatttggtggtttttaaagagggaattgtttcttcttcgggggaaaaggcccccaaagttttctcaaattaagagccgggcggtgttggttttaacaaaaaaggttggtaaaaaagggggggaaaaaaaaaaaaaacctttttcg

SEQ ID NO: 66021 - protein, 66 aa, Zea mays
  misc_feature: Ceres CLONE 1538063
GAHRGGGRSRTSGSPGLQEFVSPLEKPHRLAAVPRNLSTPISSTRRVVPSRFPVALSGSRNWSAAV

SEQ ID NO: 66022 - DNA, 660 bp, Zea mays
  misc_feature: Ceres CLONE 1538064
  misc_feature: Translation starting site: 413
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaactgagaaccgcagagacaggcgtcttcgtactcgcctatctccgcgactcaaagctttccccaattcccccccttctcccatttctgagcaccgtcgcagctcccccctaaataaaaataaaagacgagacgctcgaagtacccaattcgccctatagtgagacgtattacgcgcgctcacaggcagtcgtattacaacatcttgactgggaaaaccctggcgttacccaactgaatcgccttgcgtgacatccccctttcgccagctggagtaatatcgaataggcccgcaccgatcgcccttcagaacagtagcgcagactgaacggcgaatggaaatctgcaagcgtaaatattttgctaaaattcacgataaatttttgttaaatcagctcagttttatagcaataggcccaagtcggctaaatcccttataaatcaaatgaatagaccgagatatggttgagagtagttccagcttggaacatgagtcgactttgaaagtacgtggactccaacgtcaaagggcgaaagaccgtctatcaggccgatggcccactacgtgtaccatcaccctaac

SEQ ID NO: 66023 - DNA, 638 bp, Zea mays
  misc_feature: Ceres CLONE 1538071
  misc_feature: Translation starting site: 177
ggagctccccgcggtggcggccgctctatactagtggatcccccgggctgcaggaattcgtctcacccctagaaaaaaacgaccatctagtgccattggagtggctccattgcttggcaagctagctagtctcctgtcctgtcctgtcctgtccttccttgacaacaatatatataatggtgggtagggagcatatctgtgcgacgacgcacgcgcccaacaaggtggcgatgagcctccaggttttccatgtcctcctccttgccgccgtcgtccttttggtcccgctgctatccgcgaaggagaagctgctggggctgagcccggctgccgtggcggtggcctgctgggcggacgccgtggcggcgtgtgcgtacgcgatgtcccgcccccgccccgtctacctggtggagctgtccgggtacgtgggcgggccttcgcacgacgcctcccgcgccaagacaatcgcccacttcgggcggtgcggtcggttcagcgaccagagcatggcgttccataatcgtgatgctggagcggtcggggctcgtggagcagacccacttcccggcgtcgctcatcaacgtgcccgtggacatgtgcctccgcacggcgcgggaggagtcgcacgccgtcatcta

SEQ ID NO: 66024 - DNA, 640 bp, Zea mays
  misc_feature: Ceres CLONE 1538076
  misc_feature (299)..(299): n is a, c, t, g, unknown, or other
  misc_feature (308)..(308): n is a, c, t, g, unknown, or other
  misc_feature (345)..(345): n is a, c, t, g, unknown, or other
  misc_feature (383)..(383): n is a, c, t, g, unknown, or other
  misc_feature (393)..(393): n is a, c, t, g, unknown, or other
ctccccgcggtggcggccgctctagaactagtggatcccccgggctgcaggaattcgtctcacccctagaaaaaagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaangaacatcgnaagaaaggaaaggaggtgggcggcaatggaggatgcnatggctgcggaccccacagcgtgcggggggggcggtancaactgggcnggtccttggcaccgaaactttcgggcggttgccccgccccggaactgcccacgggccccaacctccgggtaaaggggtgcccaaggaaaactgggacccccgggcttggccgaaacaaaaaaagcgggaaatcccccttcttaaaaagggggcccccccccccaattctggaagtccccacagggggaggccccccccccccaaaatttcccccggcgcccaaatttttccccgggcgggggaacct

SEQ ID NO: 66025 - DNA, 621 bp, Zea mays
  misc_feature: Ceres CLONE 1538092
  misc_feature (252)..(252): n is a, c, t, g, unknown, or other
  misc_feature (255)..(255): n is a, c, t, g, unknown, or other
  misc_feature (256)..(256): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (281)..(281): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (301)..(301): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (400)..(400): n is a, c, t, g, unknown, or other
  misc_feature (568)..(568): n is a, c, t, g, unknown, or other
  misc_feature (569)..(569): n is a, c, t, g, unknown, or other
ctccccgcggtggcggccgctctagaactagtggatcccccgggctgcaggaattcgtctcacccctagaaaaagctccgcatagcctcggcgctgttccccgcaacctatctacgcaatcttggcggacccggcgcgtcgtctcctctagatgttggtcgccctctctgggtaggagaaactgttctgctgcagtctgacaaagtggagggcttatgagcttctgcttattttatgtctgaacaaattgcnttnntnnnnnnngggggnnnncccccccnggggggggggnnnnnnnnanannnnnnnnnnnnnnnnnnnnnccggttgggggggggggggtggaaaaattttttggcggccctttttgggggggggggaaaaaaaaggttaaaccctntttcccctcccccgggggggggacaaaattccttttgtgtgggggggaaaaaaaaaaaaaaggggggggcccccccccccaagggggggggggtttttttcccccacttttttcccccccccaaaaatttttgggggaaaattttgttgtggcggggggccccccccnngaaggggaagaaaaaaaccccccgggggggggccctagggggggggtgtttt

SEQ ID NO: 66026 - DNA, 577 bp, Zea mays
  misc_feature: Ceres CLONE 1538096
  misc_feature: Encodes the peptide sequence at SEQ ID NO. 66027
  misc_feature (216)..(216): n is a, c, t, g, unknown, or other
  misc_feature (233)..(233): n is a, c, t, g, unknown, or other
  misc_feature (237)..(237): n is a, c, t, g, unknown, or other
  misc_feature (238)..(238): n is a, c, t, g, unknown, or other
  misc_feature (245)..(245): n is a, c, t, g, unknown, or other
  misc_feature (256)..(256): n is a, c, t, g, unknown, or other
ctggagctccccgcggtggcggccgctctagaactagtggatcccccgggctgcaggaattcgtctcacccctagaaaaatcagctacgacgacatccagggcatgtacagcggcctcgacatgctgccgccggccggcgaggacttctactcctcgctcttcgcgtcgcccagggtcagggggaaccagcccaccggagccgcggggtcttgggnccccttctgagtgagcntcanngcgaagnatgggagggcntgggagattgaggagaaaaaaaacgggcccgggttttcccaaactctctgtaaaatccgggcccttggaggatcaacccgagggacttgtcgggttaaaaaccaaggggcgggtttcaccatggaacacaaaaaaattttttttgaaaccttttttgggccaaaaaaaaaaaaacaaagccccgggaggcccattcccccaaaaggggggttttaaacccccccccccggggggcgttttttaaaccgggggggggagaaaaacccggggggcccacaaaaaatatcgctggggagaaacaccccccctttgtgcgggggg

SEQ ID NO: 66027 - protein, 40 aa, Zea mays
  misc_feature: Ceres CLONE 1538096
  misc_feature (38)..(38): Xaa is any aa, unknown, or other
MYSGLDMLPPAGEDFYSSLFASPRVRGNQPTGAAGSWXPF

SEQ ID NO: 66028 - DNA, 651 bp, Zea mays
  misc_feature: Ceres CLONE 1538101
  misc_feature: Encodes the peptide sequence at SEQ ID NO. 66029
  misc_feature (362)..(362): n is a, c, t, g, unknown, or other
ctccccgcggtggcggccgctctagaactagtggatcccccgggctgcaggaattcgtctcacccctagaaaaaccacacgcacactcctctcccttcctctcctccgcttccatccctgggctgtgcgctactactccccctgctggccgctgctctgctctcacgcatgttttcacatccaagcgcctgcccctcgccctcgccgccacagtggtaacccgatccatgccgggcggcggccgctgacttgctgctgttggcttcaacggccgcaggcaaagttactgctggtagcgctagcgcggcgcggcggcggcggcgtaagaggaggggtcggcggcggagatgaggatgaagacnctggcgtgctgccggcggcggcctcaagacttcagcatcgatatggaccaagagcccgacagggtggtgacatataatggcctcgagacctgcattatcaacagttccacctatgacgatgacagtggcatcagtgcaacaacaggcggagatggctgtatcaccactgaattcccttgatgatgaagtctcctagttgctctagaaaagatgcttctgggttctcccttcacttcacacaggtcttagcaagcaggaggaacattcacctagatgaagttggggaccc

SEQ ID NO: 66029 - protein, 64 aa, Zea mays
  misc_feature: Ceres CLONE 1538101
MRMKTLACCRRRPQDFSIDMDQEPDRVVTYNGLETCIINSSTYDDDSGISATTGGDGCITTEFP

SEQ ID NO: 66030 - DNA, 649 bp, Zea mays
  misc_feature: Ceres CLONE 1538111
  misc_feature: Translation starting site: 213
ctccccgcggtggcggccgctctagaactagtggatcccccgggctgcaggaattcgtctcacccctagaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccggggggcggcccccgcgcgctcatcggcgacgtgtccgccaggctcacgtggaaggacctctgcgtcaccgtggctctgggcccccgcaagacgcagaccgtgctggacgagctcaccgggtacgcggaagcccgggtcgctgaccgcgctcatggggccctcggggtccggcaaagccaccctgctcgacgccctcgccgggccgctcgccgcaacgcccttctcctcgggaacgtgctcctcaacggcgcaaagccaag

SEQ ID NO: 66031 - DNA, 643 bp, Zea mays
  misc_feature: Ceres CLONE 1538112
  misc_feature: Encodes the peptide sequence at SEQ ID NO. 66032
  misc_feature (584)..(584): n is a, c, t, g, unknown, or other
ggagctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggacagtatcctctgccttcgtcggcggcggatgtggaggggaggaagcgatggaggcgagcgccgggctggtggccggctcccacaaccgcaacgagctcgtcgtcatccgccgcgacggcgatcccgggccgaagccgccgcgggagcataacgggcagctgtgccagatttgcggcgacgacgtcggccttgcccccggcggggactccttcgtggcgtgcaacgagtgcgccttccccgtctgccgggactgctacgaatacgagcgccgggagggcacgcagaactgcccccagtgcaagactcgatacaagcgcctcaagggctgccaacgtgtgaccggtgactacgatgaggacggcgtcnatgacctggacaacgagtgcaactgggacggacatgactcgcagtctgtggttgagtcc

SEQ ID NO: 66032 - protein, 126 aa, Zea mays
  misc_feature: Ceres CLONE 1538112
  misc_feature: SWISSPROT Homolog: EC 2.4.1.12 Cellulose synthase (UDP-forming)
  misc_feature (107)..(107): Xaa is any aa, unknown, or other
MEASAGLVAGSHNRNELVVIRRDGDPGPKPPREHNGQLCQICGDDVGLAPGGDSFVACNECAFPVCRDCYEYERREGTQNCPQCKTRYKRLKGCQRVTGDYDEDGVXDLDNECNWDGHDSQSVVES

SEQ ID NO: 66033 - DNA, 1907 bp, Zea mays
  misc_feature: Ceres CLONE 1538116
  misc_feature: Encodes the peptide sequence at SEQ ID NO. 66034
agcgacgacggcacgagcagaggccgtcgagccgtcgaggagaaatacccttttccctttccatttcgtctcgtcccggctcgttgccggcggatagaaatcttctactgacttctcccgtgtcgtgctgtgctctctctctgccggcggatagaaatcttctactggctcgctgcgacgcgtccggcctctcctctcctcttctctcctctcctcacccccgcgcgggagcgggtggttgcggtggcggctgaggtttagtcgagggacccggccggccagcggtcgcgcgtcggagccgagggcaaggggatggggaaccaggtcgggggccgacggcggcggcggccgccggtggacgagcgctacacgcgcccgcaggggctgtacccgcacccggacatcgacctcaggaagctccgccgcctcatcctcgaggccaagctcgcgccctgccaccctggcgccgacgacgcgcgcgccgacctcgacgagtgccccatctgcttcctgttctaccccagcctcaaccgctccaagtgctgcgccaaggggatttgcacggagtgcttcctccagatgaagtcgcccacctcgtgcaaaccgacgcagtgtccgtattgcaagacgctgaattacgcagtggagtaccgtggcgtgaagaccaaggaggagaagggcatagagcagcttgaggagcagagggtgatcgaggcgcagatcaggatgcggcagcaggaggtacaggacgacgcagagcggatgaagaacaagcggactgcaactttgggtgacgtagtagcatcagcacaggtcgattcttgcaataccgatggtgcatcaacagcagttgcaaacggtccacgaggcaacgatgttctctcgtccgaagtgcagcattctgagttgatatcgaggaattctgaagccttcaaacagatgcggggcaataattttgaggtggatcttgaagaagtaatgcttatggaggcaatttggctctctatacaagatcaagaagctttgggaaatccaggatgtgttagcactacaccgtcatcaattccttcaaggccttttgatgatggtgatatgacaacgaccgctgaagcagcttcttctggtggatttgcttgtgcagtcgcagctttagctgaacagcagcatatgcatggagagtcttctagcgcatcaccttgccaaacaataaggtttggcacccttagcagaccagacagatccactacacaggatctgagtgtagctgggagcagttcttcggactccagagttgaggaaccaccaaccagcaatacacaccgaacaatagaggctgcagagtattctaattctaatgtccagtggtccgaggtggccgaggctgggaccagtattgctgaatctgatggtacagtggaggctggtgttgacaattcatccacttcggctgggtccaacattgattctgttagtgttcctgatagcttcgaggagcagatgatgctggccatggctctctcgttggtcgatgcccgtgctagagcaggttctccggggttagcttggcggtagcatttccttgtaggcccttccactccttatactattcttttcggttgtgctgcgttttgttcctaagtgttccaattgccacgtaaaacatgggggattagatggggagcaggctcaaatttgacgaactgacagtgatacttgtgaatagtgggataaatctgtacatttgaagccagtggtttggctaattttatctcctcttctttcgattcttgaggaagaaattggattctcaggcagatttctgcctacagaagttgtgcctgatgatgttgaaacattgtgtaaatacggaaacgcactcacattttttccaaaaaaaaaaaaaaaaa

SEQ ID NO: 66034 - protein, 419 aa, Zea mays
  misc_feature: Ceres CLONE 1538116
MGNQVGGRRRRRPPVDERYTRPQGLYPHPDIDLRKLRRLILEAKLAPCHPGADDARADLDECPICFLFYPSLNRSKCCAKGICTECFLQMKSPTSCKPTQCPYCKTLNYAVEYRGVKTKEEKGIEQLEEQRVIEAQIRMRQQEVQDDAERMKNKRTATLGDVVASAQVDSCNTDGASTAVANGPRGNDVLSSEVQHSELISRNSEAFKQMRGNNFEVDLEEVMLMEAIWLSIQDQEALGNPGCVSTTPSSIPSRPFDDGDMTTTAEAASSGGFACAVAALAEQQHMHGESSSASPCQTIRFGTLSRPDRSTTQDLSVAGSSSSDSRVEEPPTSNTHRTIEAAEYSNSNVQWSEVAEAGTSIAESDGTVEAGVDNSSTSAGSNIDSVSVPDSFEEQMMLAMALSLVDARARAGSPGLAWR

SEQ ID NO: 66035 - DNA, 633 bp, Zea mays
  misc_feature: Ceres CLONE 1538117
  misc_feature: Translation starting site: 86
tcaccgcggtggcggccgctctttaactagtggatcccccgggctgcaggaattcgtctcacccctagaaaacgccgctcattttatggggctcacgcgcgggcgcttgcgcgcgcgcactgcccacgccgtcgccagcgcctgcttcctcgtgctcctcctgctccttctgacctcctcctcactcttcgcgcccatcggccgcagcaacgcggcggagtccgacgagggcgggacaacagttctcggcgccgctccgtcgtcgtcgtcgtcgtcctcctcctcctccttgttcgggaaggggcgggggagcagctgcgaagagctgcagtccatcagcggcggggaagggcgggtgcgcgtaactccgcgcccactcgccctggtccccgggcgggtacgtcgactacctccgcctcttctactgcgggcttcgccggcgcgctgccgggcgggcggcgtgcgccgcgctcgcgctgtggctgggggtgctcttctacctcctcggggaacacgcgtccgagtacttctgcgcgtcgctggaggggctctcgggggcgctgcgcctgccccccggcgtcgcgggcgtcacgctgctgtcgctggggaacggcgcgcccgacgtgttcgcca

SEQ ID NO: 66036 - DNA, 637 bp, Zea mays
  misc_feature: Ceres CLONE 1538119
  misc_feature: Encodes the peptide sequence at SEQ ID NO. 66037
ctctagaactagtggatcccccgggctgcaggaattcgtctcacccctagaaaaaaccgtataactcctgacttcttcctagtatttatcttaagtcccctcccccccccaaacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccagggaaaattttttgcggggcaacttcatcctcaaaaaagttttgcaagtagtcactataaaagctttgccgggaaaaaaattgcctcggagaaccaacgaaggagattcacaccgtaaacatcctgccttggaggtttgtctgcaaggattttcccaagacctccccttaaaagccacattaaacctttttgggaagctggaaagcctctccttcattttttaaaaaaccagccaaaccgccccaattaagcccgtttgcaaggttcggggtttgctgggtgcaaggaattggcctgggtcctatcaaaccggccgaaattattctgggcaaaatggttggcccaata

SEQ ID NO: 66037 - protein, 54 aa, Zea mays
  misc_feature: Ceres CLONE 1538119
MDTGCLSSMNITGASQGKFFAGQLHPQKSFASSHYKSFAGKKIASENQRRRFTP

SEQ ID NO: 66038 - DNA, 631 bp, Zea mays
  misc_feature: Ceres CLONE 1538120
  misc_feature: Translation starting site: 278
tccccgcggtggcggccgctctagaactagtggatcccccgggctgcaggaattcgtctcacccctagaaaaaaactcaccgtctgccttctgcgcctccatttcagcctctgtcccttgcaagttcaaactcacctaccaccttgagtaaagcataagtcccacgtcttctttgtggttattggatcatgtccactctggcaagtcaaccaacgcatagacgccttttctacgaacttggaagcgttgacattctcgtgatcacatatgttagagaatgaatgctgctgatatgaataatcggcccttcatctactcgtgtatgctctacctgctcaacgctgagcgtgagagatgtatcaccttggatattgctctgggcaagtttgagacctccaagtactactcgcactgtcattgattgccccctggacaccgtgacttcatcagtacatgatcactgctacctcccaagctgactgtgatatccttatatctcactcccccactggtggttctcatgctggtaactccaaagacggccatacccaataacatgctctcgttgcgttcacccaaggagtgaatcagatgatttgctgctgcccacaatggatgcaaccactcccaa

SEQ ID NO: 66039 - DNA, 702 bp, Zea mays
  misc_feature: Ceres CLONE 1538122
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (42)..(42): n is a, c, t, g, unknown, or other
ggggggggttggnngttntggnannntnngtcaaaacccccntaaaaagagaaacaataaagctggtgctccccgcggtggcggccactactagaactagtggatcccccgggctgcaggaattcgtctcacccctagaaaaacaaacaggccaacaaaggcagcaaagctaccgtcgccgaagccgagcgacgttccaagaaacgaaacagtcatgatgatgatgggagagggagcgcacgcgccgccttgacagcattcatcggcgggtcagcgggaatcatgggactgctgaacgaaggttgtcagcccgaaacgcccctccttgggcggaagctgaaaaaattaccgtggccgtcaaaaccaaggtgaagggcgtttaggaaccaaggaacaaacaaaggaaggcccctgggccgggccggcggggcccgccctttggaaatccgtaaagccttggagaaaggaagtttccggggaaagtgaccaaaagttcaaaggggggcccccaccggtgactccccccaagagaaaggggcccccccccaaacctgggaagggggattggccccccttatggcggataaacacgggggggaaaaaaaaagggccccagggcggagaacccaccccccccgggggcgggagataccaaaaaaacttcccgggggcgcgggggggggtggcccccgagtcatttct

SEQ ID NO: 66040 - DNA, 631 bp, Zea mays
  misc_feature: Ceres CLONE 1538124
  misc_feature: Encodes the peptide sequence at SEQ ID NO. 66041
  misc_feature (405)..(405): n is a, c, t, g, unknown, or other
  misc_feature (520)..(520): n is a, c, t, g, unknown, or other
ctccccgcggtggcggccgctctagaatagtggatcccccgggctgcaggaattcgtctcacccctagaaaaacatgcgtgtgcggctgtgcgccgccgctacactcgccggcgacgagccttcgtgtcggctcagagaaacagacagacatgcagagtccagaaatccaacagagaaacagggctccgacccactcgcgcgctggctcgctggcaccgcgcgtccctcgccacctccgcaccgccgccgcgctcgccgccgcggtgcaggtcctcatcgacgcgtcccctgcgcggggcgagtcgcagaccatccacgcgcagctcctagcgtcgggactcgtcggcagtgccgacctctctgtcaagctcctcgttctgcacatacggtgcggctccctgcancatgcccgcgccctgttcgtacgaatgccgagccggagccgcgccgcgcacaactacctcgtcgcgggatacttcccggcgggggccgcccgcggagcccctggggatcgtggcngcggcttggcggcgtccacggggcgggctggacgttcttcccgctgtccatggcgcttgaagctgtcctgcggcgctggctcttgccccggcgtcgttccccagggaggcc

SEQ ID NO: 66041 - protein, 160 aa, Zea mays
  misc_feature: Ceres CLONE 1538124
  misc_feature (85)..(85): Xaa is any aa, unknown, or other
  misc_feature (124)..(124): Xaa is any aa, unknown, or other
MQSPEIQQRNRAPTHSRAGSLAPRVPRHLRTAAALAAAVQVLIDASPARGESQTIHAQLLASGLVGSADLSVKLLVLHIRCGSLXHARALFVRMPSRSRAAHNYLVAGYFPAGAARGAPGDRGXGLAASTGRAGRSSRCPWRLKLSCGAGSCPGVVPQGG

SEQ ID NO: 66042 - DNA, 650 bp, Zea mays
  misc_feature: Ceres CLONE 1538125
  misc_feature: Encodes the peptide sequence at SEQ ID NO. 66043
acccgcggtggcggccgctctagaactagtggatcccccgggctgcaggaattcgtctcacccctagaaaaatgaatcaaatggacctggtgaatcgaacatctgaacttgctcgtgtatttggtattgattttttttctgttctttctcgggggtctcagtatcgtgttgaatctatgctcctgagattggctcatacacagaactaccttgcaatttctcctggaaatcaacaggttgcttctcagccagccatggagtgtttgccgcttgtaatggaaccagagtcggctttctaccctgatccagttgttgtgttggattttcagtccctctatccttcgatgataatagcatataacctttgttattctacatgcttgggaaaagttttcccatcaaagtcagatgtacttggtgtcagctcatattcagcagatccacatacacttgtagatctgaaaaatcagctgctgcttactccaaatggagtcctgtatgttcaacctgagataagaaaaagtgtacttccctcgcttctagaagagatattgtcaacaaggattatggtgaaaccagcaatgaaaaaattgaatccattccagcaaagtccttcacaggatattcaatgcacgggcagcttgctttga

SEQ ID NO: 66043 - protein, 192 aa, Zea mays
  misc_feature: Ceres CLONE 1538125
  misc_feature: SWISSPROT Homolog: EC 2.7.7.7 DNA-directed DNA polymerase
MNQMDLVNRTSELARVFGIDFFSVLSRGSQYRVESMLLRLAHTQNYLAISPGNQQVASQPAMECLPLVMEPESAFYPDPVVVLDFQSLYPSMIIAYNLCYSTCLGKVFPSKSDVLGVSSYSADPHTLVDLKNQLLLTPNGVLYVQPEIRKSVLPSLLEEILSTRIMVKPAMKKLNPFQQSPSQDIQCTGSLL

SEQ ID NO: 66044 - DNA, 616 bp, Zea mays
  misc_feature: Ceres CLONE 1538126
  misc_feature: Encodes the peptide sequence at SEQ ID NO. 66045
tcccccgggctgcaggaattcgtctcacccctagaaaaaacagcgtccgttccctgccacagagaaacgaactctcttgagtaccacaaaaaaaaacattggcattctctgtagtagagcacagagcgaagccgtcaacgatggcttccgctccgctgccggcggccatcgagcccgggaagaaaggcaacgtcaagttcgccttcgcctgcgccatcctcgcctcaatgacctccatccttctcggctatgatatcggagtgatgagcggcgcgtcgttgtacatcaagaaggacctgaaaatcagcgacgtgaagctggagatcctgatgggcatcctcaacgtgtactcgctcatcggctcgttcgcggcagggcggacgtcccgactggatcgggcgccgctacaccatcgtgttcgcggcggtgatcttcttcgcgggcgccttcctcatgggcttccgccgtgaactactggatgctcatgttcggggcgcttcgtggcccggatcggcgtgggctaccccctcatgatcccgcccgtgtacacgggccaaggtgtccccccgcgtcggcccgcgggtttcctgacgtcgttcccggaaggggtccttca

SEQ ID NO: 66045 - protein, 109 aa, Zea mays
  misc_feature: Ceres CLONE 1538126
MASAPLPAAIEPGKKGNVKFAFACAILASMTSILLGYDIGVMSGASLYIKKDLKISDVKLEILMGILNVYSLIGSFAAGRTSRLDRAPLHHRVRGGDLLRGRLPHGLPP

SEQ ID NO: 66046 - DNA, 612 bp, Zea mays
  misc_feature: Ceres CLONE 1538127
  misc_feature: Encodes the peptide sequence at SEQ ID NO. 66047
ctccccgcggtggcggccgctctagaactagtggatcccccgggctgcaggaattcgtctcacccctagaaaaaagtcgtcccccccggccccgacccccctccgtttgccaacgactccgggctccactgtcgctcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgacgccgtcgggacccggtgggccgtgctcatcgccggctccaacggctactacaactaccgccaccaggcggacatctgccatgcagacgagatcatgaagaagggcggacttaaggacgagaacatcgttgtcttcatgtacgatgacatcgcgcatagcccgggaaatccgaggcctggtgtcatcataaatcatccccaggggtggcgacgtctatgctggggtgccaaagattacactgggcgagagggcacgtcgacatttcttcgctgttctgctgggaacaaaatgctctcaggggggggagcggcaggttgtggatgtggccc

SEQ ID NO: 66047 - protein, 149 aa, Zea mays
  misc_feature: Ceres CLONE 1538127
  misc_feature (45)..(149): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADDAVGTRWAVLIAGSNGYYNYRHQADICHADEIMKKGGLKDENIVVFMYDDIAHSPGNPRPGVIINHPQGWRRLCWGAKDYTGREGTSTFLRCSAGNKMLSGGGAAGCGCG

SEQ ID NO: 66048 - DNA, 658 bp, Zea mays
  misc_feature: Ceres CLONE 1538137
ggagctccccgcggtggcggccgctctagaactagtggatcccccgggctgcaggaattcgtctcacccctagaaaaaacccgcggtacacatcccacactgtgcatataagctgctagctactacacatatggccgaacagaccatgagagagcaggaaggaggggtagctttctcggactctcgcaatggcttccatcatcgtgaacgcggcggtcatcctgctggacgtcatccccttcggactgtgcgaccacggcgactagcgcctcacccaggtcatcttcaccgaggacaccctcgaggagaaccactactgcgtctacgacacccacatcgcctcgggctacgacgtacgcgcgctgctcctcctcgtcgccgaggaggtcgtgatcatgctcgacaacggctgcttctgctgcggcacgctgctgaatgtggtaggctcacacgactgcgcgctcatccacttcctcttgaatggtgcgaccttgcacatcgcggacgtgtgcctgttggtgggatcaatactcaacaactacacaccccgtacaggggcgtattgtactgccagtcctgtcatacgacagggcgtccaaatccgtcttcgatgggtagctctgcattatacttcctgaaccggcattgttgggagaaa

SEQ ID NO: 66049 - DNA, 668 bp, Zea mays
  misc_feature: Ceres CLONE 1538138
  misc_feature: Encodes the peptide sequence at SEQ ID NO. 66050
  misc_feature (477)..(477): n is a, c, t, g, unknown, or other
  misc_feature (523)..(523): n is a, c, t, g, unknown, or other
  misc_feature (624)..(624): n is a, c, t, g, unknown, or other
  misc_feature (648)..(648): n is a, c, t, g, unknown, or other
ggagctccccgcggtggcggccgctctagaactagtggatcccccgggctgcaggaattcgtctcacccctagaaaaactttttccccttcacagccccgtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaccacggatctgctgcanaagttgtcccttggatcccaacccaaaggcggcgggtgcgaaaaancctgctgctgctgccccctgccgcccaaggagggtgcttgtgcaaaaccaggcccctgaatggggcccacccccccaaaagggtctaacaaccaccggtgncttcaaggaatttaaaggaacccnaaacttttcttaatccacca

SEQ ID NO: 66050 - protein, 76 aa, Zea mays
  misc_feature: Ceres CLONE 1538138
  misc_feature (42)..(42): Xaa is any aa, unknown, or other
  misc_feature (58)..(58): Xaa is any aa, unknown, or other
MAAVATPPAPAPAAPAPAPAPAAAPAPVTVAPAADQTTDLLXKLSLGSQPKGGGCEKXCCCCPLPPKEGACAKPGP

SEQ ID NO: 66051 - DNA, 643 bp, Zea mays
  misc_feature: Ceres CLONE 1538139
  misc_feature: Encodes the peptide sequence at SEQ ID NO. 66052
ctccccgcggtggcggccgctctagaactagtggatcccccgggctgcaggaattcgtctcacccctagaaaaaaccaaacgcacgcaaagccacacgcacctcgacccgttcccaggccatcacaccaccagcaccacctcgtcccccgtacctgcctcgccgccgccgccgcctcctgccggcctccgatggcgaagacccgcaagcctccggcccctccttctccgccgccgccccccgcagaaacgccatccccgcagcggcggcgcaagaagaagggccgcccgtccctcctcgacctccagcgccgcagcctccgcctgcaggcccaaaaccctagccccgccgcctcgcccacccgccgggaccccaatccctccgacgacgatgaggacgggaccgggagcgggcggcggcggcagaagcgcctcaagagcgtcctctccggcgtcgtcaaggaggagccgggggaggggaagaaggatgcagcgaaagcgacggggaaagaggacgctgcgtcggatggtgggcccacggggactcccctcccagacaaaaagttgctactcttcatcctcgataggctccagaagaaggatacttatggagttttctcggagcctgtcgatgcagaggaactt

SEQ ID NO: 66052 - protein, 151 aa, Zea mays
  misc_feature: Ceres CLONE 1538139
MAKTRKPPAPPSPPPPPAETPSPQRRRKKKGRPSLLDLQRRSLRLQAQNPSPAASPTRRDPNPSDDDEDGTGSGRRRQKRLKSVLSGVVKEEPGEGKKDAAKATGKEDAASDGGPTGTPLPDKKLLLFILDRLQKKDTYGVFSEPVDAEEL

SEQ ID NO: 66053 - DNA, 571 bp, Zea mays
  misc_feature: Ceres CLONE 1538145
  misc_feature: Translation starting site: 355
  misc_feature: SWISSPROT Homolog: EC 1.4.1.2 Glutamate dehydrogenase
  misc_feature (145)..(145): n is a, c, t, g, unknown, or other
  misc_feature (164)..(164): n is a, c, t, g, unknown, or other
  misc_feature (366)..(366): n is a, c, t, g, unknown, or other
ggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccngctgagtgagaagaagagnatggccggcaaggggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatncacaccgtctttgatgccaagcgtctcatcggcaggaggttcagtgatgcgtctgtccagagtgatatcaagttgtgggcccttcaggtcatttctgggcctggtgagaagccatgattgttgccagcacaagggtgaagagaagcagttgcagctgaaaaatctccctctatgttctatccagatgcctgaaatgctgaacctt

SEQ ID NO: 66054 - DNA, 589 bp, Zea mays
  misc_feature: Ceres CLONE 1538147
  misc_feature: SWISSPROT Homolog: EC 4.3.1.5 Phenylalanine ammonia-lyase
ggagctccccgcggtggcggccgctctagaactagtggatcccccgggctgcaggaattcgtctcacccctagaaaaacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggggcgcgcgccgctgatctggccgggtacccactggactaagtgaagcgcatggttgcgcaagccccgcagcccgggtcaagatcgagggctccaccctccgcgtcgggcaggtggccccccttccctccgccaaagaaactttccggggttcccctcaaatccaaaaaagaagcccccccccccctcaagccacaacgaattgggttccccaatgggtttgccccggggggggaaattttagggggttccccccggggtttggggggccccccccccgccccaccaaaagaaaaggcccccccccctcaggtaaagtgttccggggttccaaaccccgaaattttttggaccccggaaaaaaaagggaacccc

SEQ ID NO: 66055 - DNA, 614 bp, Zea mays
  misc_feature: Ceres CLONE 1538149
  misc_feature: Encodes the peptide sequence at SEQ ID NO. 66056
tggggggcgctctacgactagtggatcccccgggctgcaggaattcgtctcacccctagaaaaacattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcctttctcgccgcggcgaccgtcaaggtccccgaaatggggcttccagggcccttaacccggggggggcccgggggcaagggggttcctgggaaaggggccacccggggggccccccaaaaaaaaccccgggtgggggggtgacccccccgcccccccctgggggggccacacttaaaaaagaaggggcggttcttcttgttttatttattaaagccgg

SEQ ID NO: 66056 - protein, 139 aa, Zea mays
  misc_feature: Ceres CLONE 1538149
  misc_feature (9)..(101): Pfam Name: NAM Pfam Description: No apical meristem (NAM) protein
MDCGGALQLPPGFRFHPTDDELVMYYLLRKCGGLPLAAPVIAEVDLYKFDPWQLPEKAFGGEKEWYFLSRRGDRQGPRNGASRALNPGGARGQGGSWERGHPGGPPKKTPGGGVTPPPPPGGATLKKEGAVLLVLFIKA

SEQ ID NO: 66057 - DNA, 638 bp, Zea mays
  misc_feature: Ceres CLONE 1538152
  misc_feature: Translation starting site: 262
  misc_feature: Pfam Name: Glyco_transf_10 Pfam Description: Glycosyltransferase family 10 (fucosyltransferase)
gcggtggcggccgctctagaactagtggatcccccgggctgcaggaattcgtctcacccctagaaaaaccaatggagaattggagccggccgaacagaaccaaatccgtgcccgtgcgaggaagatctcagcggctgctggcgcggggggtcgttggctcgttccaaactcgcctgactcagcccaccgtctcttggtcgccccacacgatctctccaccactccccacccggcgccggcgaggcgcgaggagggccagcaatgatggtctcctcccactcgcagtcgcaggcgggccgccggcggcgatggaggtgcttgctgccgctcctcgtaggcgccgccttcctcgccgagatcgccttcctcggccgcctcgacatggcgaagaacgccgaggtggtcgagagctggaccacctcctttttacgccgctcctcccattggggtgaagccgtgggccggggcgcggtcccgagggcaagcggcgacggcgaggacaaaaagatccgcgctgcgagcagcggctcgagagggaagacgccgtgccctacaaccgcgactttgacagggacccccgtgctggtcggtggcgctgccaagaacggaataaatgctacgtaggttgggattttggt

SEQ ID NO: 66058 - DNA, 625 bp, Zea mays
  misc_feature: Ceres CLONE 1538154
  misc_feature (396)..(396): n is a, c, t, g, unknown, or other
  misc_feature (459)..(459): n is a, c, t, g, unknown, or other
  misc_feature (625)..(625): n is a, c, t, g, unknown, or other
ccccgcggtggcggccgctctagaactagtggatcccccgggctgcaggaattcgtctcacccctagaaaaactctctcatcctccaaaggaccaagaagtaccatttctgctatctccattcgtctccaatcccaacacagcttctcaattcagttcagggaattctcccttttcttttgttttgctctagtgctcttggctgtttactccgcttcttatcctcttctctccacagaagaggagtgcatgtgcagcagctgtaaagacatttttttttcacctcatcttctcccaaggtgttgttggtgccccaggtggaggcaactgccaaagtgtttgggtttcttgtatgccaccccttttttgggggaggaggaagggcttgatcaattangttcacccattcttgccccagtggttcttggattcatggtcgtggaattaatcccaagggtanctggaactgctcattttccccttccaaaaaacgaaggcgatcgtttgaaacggaactagctgtttgccgttgaaccggggcaatgtcctctttcctgcatgccgaccggcctggggttggacctggaatagggaaagggggcggcttccccgggggggcacttttn

SEQ ID NO: 66059 - DNA, 654 bp, Zea mays
  misc_feature: Ceres CLONE 1538157
  misc_feature: Encodes the peptide sequence at SEQ ID NO. 66060
  misc_feature (519)..(519): n is a, c, t, g, unknown, or other
  misc_feature (588)..(588): n is a, c, t, g, unknown, or other
  misc_feature (608)..(608): n is a, c, t, g, unknown, or other
  misc_feature (651)..(651): n is a, c, t, g, unknown, or other
agctccccgcggtggcggccgctctagaactagtggatcccccgggctgcaggaattcgtctcacccctagaaaaaacgaccacatcatcactcgctcgtctccacagccatcgacctcactcactagctagcttccagcagcagcagccttgtcgtgcaacagcagcaccaggaccaggctaccaccagttagctgctggggacctggggtacggttgctgttccgtgactctcgtcgcacaacacaatgccggccatggtagaggaggggctcgtcaggcgggcggcgcccgagccgcacttcctggtggtgaccttcccggcgcagggccacatcaacccggcgcgccacctcgcgcgccgcctgctacgcgccacgggggcgcgggtcaccgtctgcacggccgtgtccgcgctccgcaagatgttcccgggcgccgaggcagacgcggtggaggagggccaccgcgacggcgcgggggtgcggtacgtgccctactccgacggctacgacgacngcttcgacggcgccgtgcacgacgccacgcgctacatggaccaggtcaagggtcgtggggtcccgcacngctgggggacgtcctggccngcctccgcggcgcgggcagcccgccacgctcgtctgtcacggnttt

SEQ ID NO: 66060 - protein, 134 aa, Zea mays
  misc_feature: Ceres CLONE 1538157
  misc_feature (91)..(91): Xaa is any aa, unknown, or other
  misc_feature (114)..(114): Xaa is any aa, unknown, or other
MPAMVEEGLVRRAAPEPHFLVVTFPAQGHINPARHLARRLLRATGARVTVCTAVSALRKMFPGAEADAVEEGHRDGAGVRYVPYSDGYDDXFDGAVHDATRYMDQVKGRGVPHXWGTSWPASAARAARHARLSR

SEQ ID NO: 66061 - DNA, 638 bp, Zea mays
  misc_feature: Ceres CLONE 1538165
  misc_feature: Encodes the peptide sequence at SEQ ID NO. 66062
ggagctccccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacaaggaagcgacctccttccgccgccgaatcggcgcagcggcgaagcccccgcacgccaaagccgccgggcgtcatccgctcccgactccggcgcgggacgggggccagcattgctcgccgctgaagggccgtcctttgaaccccccccattcagacgacaaaaaagaagggggtccactttccgcaagggcaagaacgagggcaacaagaacgggggaaggtttcccctaaaaatccttccgccggtttccctgaaatgttcggggaaacgtcgcatggaaattcc

SEQ ID NO: 66062 - protein, 97 aa, Zea mays
  misc_feature: Ceres CLONE 1538165
  misc_feature: SWISSPROT Homolog: EC 2.7.9.1 Pyruvate, phosphate dikinase
MAASVSRAICVQKPGSKCTRDKEATSFRRRIGAAAKPPHAKAAGRHPLPTPARDGGQHCSPLKGRPLNPPHSDDKKEGGPLSARARTRATRTGEGFP

SEQ ID NO: 66063 - DNA, 643 bp, Zea mays
  misc_feature: Ceres CLONE 1538167
  misc_feature (333)..(333): n is a, c, t, g, unknown, or other
  misc_feature (343)..(343): n is a, c, t, g, unknown, or other
ggagctccccgcggtggcggccgctctagaactagtggatcccccgggctgcaggaattcgtctcacccctagaaaaagctctaccgctcaagggtcgactcccgtgcgcttgcggtgcggacgcttcccctccacctccgcacacatctccaactaaccatgccagtctaccgcagtactgccgacttctagcagttgttttataggttagtttcgttgccttgtgtctttgttagtgtatcaaaaccaattcgcgacatcacttaggaaggggaaagcaggggccggaaaaagaaaagagacgggaatggcaagctccgactcaaatcccnacgatgcatncgagtacatgctgcttgagaaggatcctgatctctaccggaggtttttctctgtcccgagccagacagtccatggattgaccccaaatgtgttaaagctgaacaccggattagggaaaagcccttttgggaattgttggttaccacctcccccccaaagaaaaaaaggattcaatcaacaccttgaaattggggaaaaaaacccccccccaattaaagagaaacccccggcaatttttcccacgaaagttcccctaaaatctcccaaaaattggggggggcgggggaaactttttttttt

SEQ ID NO: 66064 - DNA, 737 bp, Zea mays
  misc_feature: Ceres CLONE 1538169
  misc_feature: Encodes the peptide sequence at SEQ ID NO. 66065
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (67)..(67): n is a, c, t, g, unknown, or other
nnnnnnnggggggagaggagggggataacataaatcccctcgcnnnngtnnnnttgggactcaacgnggtggcggccgctcttttctagtggatcccccgggctgcaggaattcgtctcacccctagaaaaaatggagctgtgagctgagctgagcttaccaccaccacacacgggagatagctatagctagcatagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggaccagttcttccggaagcgcgcgggggcacaccgcagcacccgtgttccgcaccaacatgcgggcgcactttcccccttcttcgggggggtggacccccgcgtgggtcgccatcgtggaacgccgccgcctttcaccgtgctctttctacccggaactcgtgggacaagccgcgaaatcgctctcggggcccaacaagccgggggcgccagccttcactgggcgggaacccgcctccggcttttaacttcgaaacgggcaggagggaggaacaagacggggcgtgtaaggacttttcgaaaatgggaaccttcgctcaaggggggtagagcccgaaacccgggggagcaggcagaatttgccgggg

SEQ ID NO: 66065 - protein, 169 aa, Zea mays
  misc_feature: Ceres CLONE 1538169
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDQFFRKRAGAHRSTRVPHQHAGALSPFFGGVDPRVGRHRGTPPPFTVLFLPGTRGTSREIALGAQQAGGASLHWAGTRLRLLTSKRAGGRNKTGRVRTFRKWEPSLKGGRARNPGEQAEFAG

SEQ ID NO: 66066 - DNA, 623 bp, Zea mays
  misc_feature: Ceres CLONE 1538170
  misc_feature: Encodes the peptide sequence at SEQ ID NO. 66067
ctccccgcggtggcggccgctctagaactagtggatcccccgggctgcaggaattcgtctcacccctagaaaaaacccacacccacaccacacctcacgtctcctcactacccgcgctctcaggcagcgcacctcgctcctcctcccccacagcgctttccattttcgtctatctcccgagaaccctcctgcgcctcccaaagctctcttctatcgcggccgcgcgcctgatcgacgtacgaccggtctggtacgtacgtgtgctcgcccgccatggctcgcggcgacggcgagctggagctgtccgtgggggtccgcggcaccggcggcgcggcggcggcggcggcggaccacgtggcgccgatcagcctcggcaggctcatcctcgccggcatggtcgccggcggcgtgcagtacggctgggcgctgcagctctccctcctcacgccctaagtgcagactctggggctctcacatgccctcacttcattcatgtggctatgccgtcctattgctggcttagtggcccaaccgcctggttggcctgtacagggataggtgccccagacagatgggagagaaccaaggccatttttcctgaaaggaatgcatgctccatctgc

SEQ ID NO: 66067 - protein, 59 aa, Zea mays
  misc_feature: Ceres CLONE 1538170
MARGDGELELSVGVRGTGGAAAAAADHVAPISLGRLILAGMVAGGVQYGWALQLSLLTP

SEQ ID NO: 66068 - DNA, 639 bp, Zea mays
  misc_feature: Ceres CLONE 1538173
  misc_feature (340)..(340): n is a, c, t, g, unknown, or other
tccccgcggtggcggccgctctagaactagtggatcccccgggctgcaggaattcgtctcacccctagaaaaactgtaatatgagtagaaggtgcatttcaatatcgagaactcaagtgggacgtggtgacatgttgtcgatgtttccttttaaacttttgtatcagatatcaagataggtccatcagaatgtattattgattgacacagacaaatatatcaataaaattgttaatttttcaaaactgagggcctggcaagactgctgtttatgcctccttggcgaagattgatttgtttgggacttttttctttctttcagtcggaggaataatatgcngtgtcttgtttgccttgaccccccaccccagacgggggagggcctaattccccctatagtgagcctattatacacgctcctggccgaaaaaattcggcttctcccctggaaacccctggcgcaaccccccttatccccgggggggaatacccaaaaaccccccggcatatccccttacaaaactgtcgcgatcctatttgaaaagtaatattcccccaataataattggaaaaaccccccttaattttttttaaaaacccctcttttttaaccgaaaagccacacatttgaaaaccccc

SEQ ID NO: 66069 - DNA, 661 bp, Zea mays
  misc_feature: Ceres CLONE 1538177
agctccccgcggtggcggccgctctagaactagtggatcccccgggctgcaggaattcgtctcacccctagaaaaaatacatgctggaatggacaaaccaaccaaccattggcttttctcgcttcagggtgctggcgattcccgcagcgacctcctgtgtatcgtatccaatttgagcattagatctgccccccctgcaggcgtttctttcctatccctgatccgagaagcagggtgtagtctaggtggctggcatacgggattacatcaggcagtgtgtaagttcagctggaactcgattggtaattgggatggatgattgatgatatatatatagcacacactgtttctgcgtctggcaagacacaaaaaagagggggggagagaaaaaaaaaaaaaaacgagacgctcgaggtacccatttcgccttataggagtcgtattacgcgcgctcactggccgtcgttttacaacgtcgtgactgggaaaacccttggcgttaccaaacttaatccgccttgaaaaaaatcccccttttcgccaggtgggggaaatacgaaagaggccccgccccaattccccttcccaaaattttgcccaacctgaaatggcaaaaggaaaatttgtagcgctttaatatttttgttaaaaattccgcttg

SEQ ID NO: 66070 - DNA, 650 bp, Zea mays
  misc_feature: Ceres CLONE 1538178
  misc_feature: Encodes the peptide sequence at SEQ ID NO. 66071
  misc_feature (362)..(362): n is a, c, t, g, unknown, or other
  misc_feature (380)..(380): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (402)..(402): n is a, c, t, g, unknown, or other
  misc_feature (430)..(430): n is a, c, t, g, unknown, or other
tccccgcggtggcggccgctctagaactagtggatcccccgggctgcaggaattcgtctcacccctagaaaaaaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaattgagtacgaatattctctttttttttgtaatttttactccagactccagtcatatttgctgcattgctggaaaaaaaaaaaaaaaaaaaaaaaaaaaaaaaaaaaaaanaaaaaaaaaaaaaaaaanaaaaannnaaaaagaacccaanacccccaaaaaagggaaaaaaaaaaaanaaacggggcgcccgggggtccccatttccccttaagggaaaacatataccccccccccctgggccgccttttaacacctccgggattggaaaaaccccggggtacccaaattaaccccccttgaaacaatccccccttttcccagtgggggaaaaaccaaagaaagccccccccaaatccccttttcccaaaaatggcccccccgaaagggggaaaggag

SEQ ID NO: 66071 - protein, 34 aa, Zea mays
  misc_feature: Ceres CLONE 1538178
PRGGGRSRTSGSPGLQEFVSPLEKRLMASVFFCC

SEQ ID NO: 66072 - DNA, 704 bp, Zea mays
  misc_feature: Ceres CLONE 1538180
  misc_feature: Encodes the peptide sequence at SEQ ID NO. 66073
aagactcaacacacgctctcgccagccaaccgaagccaccgtacccacccacccaatggcggcagcttaccgccacgtcgcgacgcgcggcctcgccctggccctcgcggcggccgtggtcacggcgtggcagtgcgcggcgcagcgggcgccgtccggcccgggctgcatgccggagctcgtcagcctgaacccgtgcatggactacatgtccggcaacgcgacggcgcccgacggcccgtgctgctcggccgtgtcgggcatgctgcgggccagcccgagctgcctctgcatggtggtcggcggcacggccgcgacgctcggcgtcgccgtcgacggcgcccgcgcgctgcggctgcccgcggcgtgccaggtccaggcgccgcctgctagccagtgcaacgtcgcgggagctccagtgccgtctccggtggcggggacgaacacaccaggggctcaggcagcggcggcgccatcggacgccaataatgtcacccctgcagggtctggatcgacccttccatcctccgacggagacaacggcagacctggaacgaccttcgtattcgccgctgcggcacaggcgttgttacatcgtctctgagacacgagagttttcacgtgtccatcgactcatcgtggacgaacctttcgttaacacgtgttggtgtttgtcccaccgtcaggattaagagctctggcaa

SEQ ID NO: 66073 - protein, 182 aa, Zea mays
  misc_feature: Ceres CLONE 1538180
  misc_feature (38)..(115): Pfam Name: Tryp_alpha_amyl Pfam Description: Protease inhibitor/seed storage/LTP family
MAAAYRHVATRGLALALAAAVVTAWQCAAQRAPSGPGCMPELVSLNPCMDYMSGNATAPDGPCCSAVSGMLRASPSCLCMVVGGTAATLGVAVDGARALRLPAACQVQAPPASQCNVAGAPVPSPVAGTNTPGAQAAAAPSDANNVTPAGSGSTLPSSDGDNGRPGTTFVFAAAAQALLHRL

SEQ ID NO: 66074 - DNA, 527 bp, Zea mays
  misc_feature: Ceres CLONE 1538182
ggagctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgatcagcatctgggcaggtggcgccctcatgggccctgccgacccctttggccagccggggccttcttccttttgcccggccaatttgttccccaaaaaaaaaattcccaaaaaaaaaaaaaaaaaaaccggccccctttcggaggaaccccatttcccccccccaaaggggaggggttttttaaaaacccccccccttggggggggggttttttttaaaaaaaaaacggggggggtggggggggaaaaaacccccccggggttctccccccccccaaaaaaagaaaaaaggcggggggggagagaacaaaaaaccccccccccccctttttggtgg

SEQ ID NO: 66075 - DNA, 620 bp, Zea mays
  misc_feature: Ceres CLONE 1538184
  misc_feature: Encodes the peptide sequence at SEQ ID NO. 66076
  misc_feature (620)..(620): n is a, c, t, g, unknown, or other
agctccccgcggtggcggccgctctagaactagtggatcccccgggctgcaggaattcgtctcacccctagaaatagagtagcaccagaaaggagtactccaccagaaagatagacacgtccgccgtctccgctccggttttcgctgtctcgctgccgtcctaggtttggagccaggtcaccggcgctaggagggcgtgaaatcgagtcgacggtcggcactcggcactcacgcgttctccacctactgctggcgctcctgtgaggcgacccgacgggccaccccccgcatgcgaacagcgcacggaccggccaccggtgtgacccctccatccaaggcttcagctccagaccgagccgccccgccaatcgccgtccgccgaaccgcctaggaatttgttttcctcatctaaagttactgcattgtattccatagaaatggctatggggttgattaatgctaatcctataatccatgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacn

SEQ ID NO: 66076 - protein, 48 aa, Zea mays
  misc_feature: Ceres CLONE 1538184
  misc_feature: SWISSPROT Homolog: EC 3.2.1.23 Beta-galactosidase
MKKKKKNETLEVPNSPYSESYYARSLAVVLQRRDWENPGVTQLNRLAA

SEQ ID NO: 66077 - DNA, 669 bp, Zea mays
  misc_feature: Ceres CLONE 1538189
  misc_feature: Encodes the peptide sequence at SEQ ID NO. 66078
  misc_feature (412)..(412): n is a, c, t, g, unknown, or other
ggagctccccgcggtggcggccgctctagaactagtggatcccccgggctgcaggaattcgtctcacccctagaaaaagcataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatacttatgcttgtctctatatagnctataggtcctagttcaaataacagatgctgcttgcagccttggatatttgtggagtgaacacatttgttgatagcatatggtataagaaagtaatgtaattatctgggagatggtgtaattatgtggcaaatattatttgcaaaaaaaaaaaaaaaaaacaagacccttcgaaggaccccaattcgcccctaaagggagtcctaattacgcccccctcactgggcccgtcgtttttaaaaacgtgcgggaccgggg

SEQ ID NO: 66078 - protein, 75 aa, Zea mays; identical to SEQ ID NO: 55919
  misc_feature: Ceres CLONE 1538189

SEQ ID NO: 66079 - DNA, 640 bp, Zea mays
  misc_feature: Ceres CLONE 1538200
  misc_feature: Translation starting site: 542
  misc_feature: SWISSPROT Homolog: EC 3.2.1.23 Beta-galactosidase
tccccgcggtggcggccgctctagaactagtggatcccccgggctgcaggaattcgtctcacccctagaaaaatacccacatttgaaccatgaaatgttcacttcgagaataccaattgtttatattgttcgttcttatgtttttttttcttgcattgtcaaaaaaaattgattgttaccattgtcctcaaaagaattatgatggctgattctatcgtgtagcccatttaaagcatatacaatagaggtcaacagaaggtcatcgctcaactgtaaatttgtaagtacagcaacacaagtatttattttggctcatctcattataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgtttatattttgttaaaattcgcgttaaatttttgttaaatcagctcatttttttaaccaataggccgaaatcggca

SEQ ID NO: 66080 - DNA, 644 bp, Zea mays
  misc_feature: Ceres CLONE 1538201
  misc_feature: SWISSPROT Homolog: EC 3.2.1.23 Beta-galactosidase
  misc_feature (622)..(622): n is a, c, t, g, unknown, or other
tggcggccgctctagaactagtggatcccccgggctgcaggaattcgtctcacccctagaaaaatacctttctcggccttttggctaagatcaagtgtagtatctgttcttatcagtttaatatctgatatgtggaccatgtgtccacttcgatattaaatttattttttgtgggggaggaatcacaacagtggcttgccactgggttcctcaagcgtcgtccggccgttgcactattggctggaccaggcgcaccccaataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagataggggttgagntgttgttccagtttggaacaag

SEQ ID NO: 66081 - DNA, 656 bp, Zea mays
  misc_feature: Ceres CLONE 1538203
  misc_feature: Encodes the peptide sequence at SEQ ID NO. 66082
  misc_feature (274)..(274): n is a, c, t, g, unknown, or other
  misc_feature (278)..(278): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (287)..(287): n is a, c, t, g, unknown, or other
  misc_feature (290)..(290): n is a, c, t, g, unknown, or other
  misc_feature (291)..(291): n is a, c, t, g, unknown, or other
  misc_feature (294)..(294): n is a, c, t, g, unknown, or other
  misc_feature (295)..(295): n is a, c, t, g, unknown, or other
  misc_feature (310)..(310): n is a, c, t, g, unknown, or other
  misc_feature (366)..(366): n is a, c, t, g, unknown, or other
ctggagctccccgcggtggcggccgctctagaatagtggatcccccgggctgcaggaattcgtctcacccctagaaaaatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtagggggaaaagcgcgttccntccntnnngcgcnggnnacnntcccatcgtgggggnacctaacacaaaatcggggccccagaccaacatctccgctccaggaacttggtggnccaagtaccggaccacacagggttctctgtttcttccggcccggggccctgtgccccccccttaaattgtttttttcccccaaagcccccccaaagggcctttgtttggcccccccaaaaacaaatttttttcttttcccgggggtgggtggccaggggggcccccaaaattctcccggttaaaaaaaatggggaaaaggggggctttttctccccccccggggaaaaatattggggcgcgaaaccgaggaaattttgtataaaacccccccctcggtgttaaaaaaaaa

SEQ ID NO: 66082 - protein, 108 aa, Zea mays
  misc_feature: Ceres CLONE 1538203
  misc_feature (57)..(57): Xaa is any aa, unknown, or other
  misc_feature (59)..(59): Xaa is any aa, unknown, or other
  misc_feature (60)..(60): Xaa is any aa, unknown, or other
  misc_feature (63)..(63): Xaa is any aa, unknown, or other
  misc_feature (64)..(64): Xaa is any aa, unknown, or other
  misc_feature (69)..(69): Xaa is any aa, unknown, or other
  misc_feature (88)..(88): Xaa is any aa, unknown, or other
MALQAAYEYLQQAVGHGAWSSTQTLTLLLIAVPTVLLLLASLAKSTSSSGRGKSAFXPXXAGXXPIVGXPNTKSGPQTNISAPGTWWXKYRTTQGSLFLPARGPVPPP

SEQ ID NO: 66083 - DNA, 636 bp, Zea mays
  misc_feature: Ceres CLONE 1538212
  misc_feature (355)..(355): n is a, c, t, g, unknown, or other
  misc_feature (482)..(482): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
atagctggagctccaccgcggtggcggccgctctagaactagtggatcccccgggctgcaggaattcgtctcacccctagaaaaagcctcggtcacgacgcgcagtcgcccattccgcatctcgccctcccgtcttgtcccgtccgtccgttctccgattggccgccgcccgcctcgccctcgtcaacaaaagcccaccgcaagcgagcgagcgagccaccctccccgccgccgccaccgcccccgtcccgcccccaccccgactcctcctgaccgccggcgtggggtgcccgggctccacctccggggacgaacccttccccgcgggcgcgcccccaccggctgctccgtttgngggggtagcggggctccggcctcgcggcttcaaagccccctcctcacaacgggatccaaaatcctcctaacctctccacccccccttccaaaattccctctttttgcatcccgggaggtcggatttnaacctcatcatccctctacatgctctcactatcaacgatgatctctctcgccgagcaccatcatgacctcccgtgcgatatccactcggnnnnnnnnnnnnnnnnnnnnnnnnnnnnnnnnnnnnnnngnnnnnnnnnnnnnnnnnnnnnnnnc

SEQ ID NO: 66084 - DNA, 731 bp, Zea mays
  misc_feature: Ceres CLONE 1538214
  misc_feature: Encodes the peptide sequence at SEQ ID NO. 66085
ctccccgcggtggcggccgctctagaactagtggatcccccgggctgcaggaattcgtctcacccctagaaaaaaaaataccaaggtcaaggagtcgcagaaccatgcagcaccaaggacgatggatgcactctttgcacggatgaaggcgcaacgcatgaggaccgcaccacagcagcaggcaaatcctgcctctggacgtgatttcaaccagcagcgacgtgttcagcagcagcagaggcgaggtagagcatatggtggccgtgttgtcggcaaccaatgagcatatttggtgcatcgaagcccccttctcttcactggtcttaaggaccttgagggctagtttgggaactttatgtttctctatttcctcaagggaaaatgacctaatttttcttggccccccccatctcggactattaaaactatcgaataaaaaaacccttaaaaaaaaaaaaaaaaccggaccccctcgggggtaccccaatttcgcccttaagagagaagccctatataccaggcgccttacagggccgtttgtattttaatacgtttcgtgttggggaaaaaccccctggggatttacccccaactttaatctcatatttaataaaaacatttcccaccttttccccgtaagctgggtggaaaaataataaaaaaaagcgccccccgccccgtatccccccctttatcaaacagatttggccgcaattttataagcgtggtgg

SEQ ID NO: 66085 - protein, 53 aa, Zea mays
  misc_feature: Ceres CLONE 1538214
MDALFARMKAQRMRTAPQQQANPASGRDFNQQRRVQQQQRRGRAYGGRVVGNQ

SEQ ID NO: 66086 - DNA, 638 bp, Zea mays
  misc_feature: Ceres CLONE 1538215
  misc_feature: Encodes the peptide sequence at SEQ ID NO. 66087
tccccgcggtggcggccgctctagaactagtggatcccccgggctgcaggaattcgtctcacccctagaaaaaagattttgtggtctccggtactgcttcagagtcactttatggtgcttgtgagtccatgtataaggcaaacatggaacccgaagaacttttcgagacaatctcgcaagcattgcaagcatctgttgatcgcgactgcctcagcggctggggaggttatgttcttgttgtcacacccactgaagtgcatgagagagtgctgaagggaaggatggactgatgagtgctgccatgtagttattctacgagagattgtttcttcattcgccctgacatactcgcccctgtcctacggcgtacataattcagagaacctgtgcaccacgtttacttctcattctgaatgaacattgattcccttttcgccagctggcgtaatagcgaagaggcccgcaccgatcgcccttcccaacagttgcgcagcctgaatggcgaatggaaattgtaagcgttaatattttgttaaaattcgcgttaaatttttgttaaatccgctcctttgtttaccaataggccgaaatgggaaaatcccttatcactcaaaagagtagacttatatagggttgag

SEQ ID NO: 66087 - protein, 53 aa, Zea mays
  misc_feature: Ceres CLONE 1538215
  misc_feature: SWISSPROT Homolog: EC 3.4.25.1 Proteasome endopeptidase complex
MYKANMEPEELFETISQALQASVDRDCLSGWGGYVLVVTPTEVHERVLKGRMD

SEQ ID NO: 66088 - DNA, 628 bp, Zea mays
  misc_feature: Ceres CLONE 1538218
  misc_feature: Translation starting site: 139
  misc_feature: SWISSPROT Homolog: EC 1.13.11.12 Lipoxygenase
  misc_feature (289)..(289): n is a, c, t, g, unknown, or other
  misc_feature (369)..(369): n is a, c, t, g, unknown, or other
  misc_feature (381)..(381): n is a, c, t, g, unknown, or other
ccccgcggtggcggccgctctagaactagtggatcccccgggctgcaggaattcgtctcacccctagaaaaacactcactcactcactcactcacacagcaaatacccacagtccacactccacagcaagaaccgaagatgttcggaaacatcggaaagatcccgatcattggcgacctgacgggcagcaacaagaatgcgcacctcaagggcaacctggtgctcatgcgcaagaccgtgctcggcttcgacgtcaccagcatcgccggctccctcatggacggcctcngcgagttcctcggccgcggcgtcacctgccaactcgtcagctccaccgtcgtcgacccctacacgggaaccgcggggaangtgggtcaggangcgaaccctggagcagtggctgctgcaaccgccgccgctttctgcccgcggagaacagttccgcgtcaccttcgactgggaagtggagaagccaggcgtccgggcgccatcatcgtggagaaacacacgccctcgagttcttcctcaagacatcaccatcgacgacgtcccggggcacgggcccatcggtctcgtcgcaaatcaatggtggtaccccaatcaagtaccgctacaacggcgtcttctt

SEQ ID NO: 66089 - DNA, 694 bp, Zea mays
  misc_feature: Ceres CLONE 1538222
  misc_feature: Encodes the peptide sequence at SEQ ID NO. 66090
  misc_feature (284)..(284): n is a, c, t, g, unknown, or other
  misc_feature (333)..(333): n is a, c, t, g, unknown, or other
  misc_feature (388)..(388): n is a, c, t, g, unknown, or other
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (404)..(404): n is a, c, t, g, unknown, or other
ctccccgcggtggcggccgctctagaactagtggatcccccgggctgcaggaattcgtctcacccctagaaaaagcatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctncacctcctggctaaggagaaggaggcggggccggccgcgggcggcggcnacgggcccagcgtggcgcccggggagctcctagaggggtggggggcgggctgccnngnncgcccgccggcntccgggacctccggcaacacggcggaatatttccgcctgccggacacggacgacgccaggaatggtctacttctttcttcgaatcgaggggcaaaaaagagggaggcccacccccctctgggtttggggccccccggaggggcccggctgccaccaccaaaattggccctctttttcaaaaaaatgggccccctccccattggcccaacaaatgggggcttggtttgggaaaaaaatccggggggggaccccaatctcaaaatatcacaatttggtgggatccccccccc

SEQ ID NO: 66090 - protein, 188 aa, Zea mays
  misc_feature: Ceres CLONE 1538222
  misc_feature: SWISSPROT Homolog: EC 3.4.16.5 Carboxypeptidase C
  misc_feature (69)..(69): Xaa is any aa, unknown, or other
  misc_feature (87)..(87): Xaa is any aa, unknown, or other
  misc_feature (88)..(88): Xaa is any aa, unknown, or other
MASSRLPALLCLAAVAVAVAAEAAAAAGEGGLRLPRDATFPAAQAERLIRALHLLAKEKEAGPAAGGGXGPSVAPGELLEGWGAGCXXRPPASGTSGNTAEYFRLPDTDDARNGLLLSSNRGAKKREAHPPLGLGPPGGARLPPPKLALFFKKMGPLPIGPTNGGLVWEKNPGGDPNLKISQFGGIPP

SEQ ID NO: 66091 - DNA, 666 bp, Zea mays
  misc_feature: Ceres CLONE 1538224
  misc_feature: Encodes the peptide sequence at SEQ ID NO. 66092
  misc_feature (666)..(666): n is a, c, t, g, unknown, or other
ctggagctcaccgcggtggcggccgctctagaactagtggatcccccgggctgcaggaattcgtctcacccctagaaaaaagcggaattcacataaaaaagcatgaaccctcgcaccggacctcaattaaaaaccgcagaaaaggaatcaatccgaccatccataaaaaggacggcgacgcggtcaccactacggcaccgccgccgccgccatcctcgacccctgaagtgaagaggcaacccgaggacgcctctcccatccacgcgcgaatcctaccgccctcacacacccaaaaacctagccgcgcgcggcacctgcatcccatggcggcaaccgcggccgcggcggggaccgggtcgtccctctcctcgcgccgcagtcgcagcgctgtctcctcgcccttccgcgcagctgcctcgcgcttccgctcgccgagatgcgtgctcgggagcgagcagctgcgggtggcgcatgaagggaagcggatgagcggcaccgagtccaggaccgccgcgtgggcgccaaaggtgcccgcaccggagtccaggcttgccgcactgccaagggagctgcgggactccaggatgaagatcttctccggcacggctaaccgtccgctcgctcaggaaattgctgcttaccctgggtatagaactcggcaagatn

SEQ ID NO: 66092 - protein, 114 aa, Zea mays
  misc_feature: Ceres CLONE 1538224
  misc_feature: SWISSPROT Homolog: EC 2.7.6.1 Ribose-phosphate diphosphokinase
MAATAAAAGTGSSLSSRRSRSAVSSPFRAAASRFRSPRCVLGSEQLRVAHEGKRMSGTESRTAAWAPKVPAPESRLAALPRELRDSRMKIFSGTANRPLAQEIAAYPGYRTRQD

SEQ ID NO: 66093 - DNA, 721 bp, Zea mays
  misc_feature: Ceres CLONE 1538229
  misc_feature: Encodes the peptide sequence at SEQ ID NO. 66094
  misc_feature (450)..(450): n is a, c, t, g, unknown, or other
  misc_feature (622)..(622): n is a, c, t, g, unknown, or other
cagagctggagctccccgcggtggcggccgctctagaactagtggatcccccgggctgcaggaattcgtctcacccctagaaaaagtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccnagtacgagatccaggggtccccacccatcaagatcttcagggaccaggggaaagacattcaggaataccagggccctagggaggctgatggctttgggaattacttgaagaaccaggttggcccttgcgtccagggaaacaagtccaccagaaaatgcgacggccccttttngatgaacgaaaaaactcccttggtggggttcctccccggaatcccggggccccaatttcccaaacttcctgggggcgcccacaaaaacctaaagtccta

SEQ ID NO: 66094 - protein, 194 aa, Zea mays
  misc_feature: Ceres CLONE 1538229
  misc_feature (35)..(143): Pfam Name: Thioredoxin Pfam Description: Thioredoxin
  misc_feature: SWISSPROT Homolog: EC 5.3.4.1 Protein disulfide-isomerase
  misc_feature (105)..(105): Xaa is any aa, unknown, or other
  misc_feature (162)..(162): Xaa is any aa, unknown, or other
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATXYEIQGSPPIKIFRDQGKDIQEYQGPREADGFGNYLKNQVGPCVQGNKSTRKCDGPFXMNEKTPLVGFLPGIPGPQFPKLPGGAHKNLKS

SEQ ID NO: 66095 - DNA, 629 bp, Zea mays
  misc_feature: Ceres CLONE 1538231
ggcggccgctctagaactagtggatcccccgggctgcaggaattcgtctcacccctagaaaaaataaataaatttgatatcgatagaggctcgggtacactggtcattcagtatcggagaccgatatctgaggctagtggcgatggaggactgtgttattactactataaactggtggatgtgtttctgtatctggtgaatgatcaagttggaagcttttagtctatcttagatatatcaatggatagtgttactagtattttcgttttcttttccaatgtgtgttgggtcttgtgaattatcctttttttctaatctaatacaatgaagatgcttaatcagaaaaaaaaaaaaaaagcgagacgctcgaggtacccaattcgccttagaaccacccaaattacgtgccctaactggccttggtttttaccacgaacttgacagggaaaaacccgggcattacccaactaaaaccccctttgaggactttccccctttccccagcttggtgtcattaccgaaacaggccccgcaccgaatcgccctttccccaactttttgccccaccctcaaatgggcgaaagtgggaaatttggacccgctttagaaatttttggttaaaattcccc

SEQ ID NO: 66096 - DNA, 702 bp, Zea mays
  misc_feature: Ceres CLONE 1538232
  misc_feature: Encodes the peptide sequence at SEQ ID NO. 66097
  misc_feature (387)..(387): n is a, c, t, g, unknown, or other
  misc_feature (401)..(401): n is a, c, t, g, unknown, or other
tgagctccccgcggtggcggccgctctagaatagtggatcccccgggctgcaggaattcgtctcacccctagaaaaagtccttctccacctagctcccccgcgccaagaacacgccagctagcaagcgcgctcgatcgaataccgttaccgtgtcgccatggccgccaccgcgtctctatcagccgtcgcggcgccgctgtcggtgcccgggctcaggaagccgctcggcgcgtcgtcgctccggcccctgcagccgagggcggcgaggatgacgacgacggccgtgcgggcgtcggcgtcgcccctcgtcacgtccatcaaggagaaggctgcggccgggctgaccgcggcggccctggcggccgcgctggtgctgccggacgtcncggaaggcgcgcantccccccggctcacgccgtcgctcaagaacttcctcctcagcatcgtgtccggtggggtcgtgctcgttggaattggcggcgccgtcgttcgccgtctccacttccaccccgtcaagagggcctgatcggaaatccttcgtatcaatcgtccccccctgggctccggccctgggccctgggctgtccggaaacaaccgggggggggctataccccctggggggttaattggatttgggaaaatgtgtccaacctttttttttttttttaaaaaaagggggttctcagtttaaacctttggc

SEQ ID NO: 66097 - protein, 122 aa, Zea mays
  misc_feature: Ceres CLONE 1538232
  misc_feature (77)..(77): Xaa is any aa, unknown, or other
  misc_feature (81)..(81): Xaa is any aa, unknown, or other
MAATASLSAVAAPLSVPGLRKPLGASSLRPLQPRAARMTTTAVRASASPLVTSIKEKAAAGLTAAALAAALVLPDVXEGAXSPRLTPSLKNFLLSIVSGGVVLVGIGGAVVRRLHFHPVKRA

SEQ ID NO: 66098 - DNA, 606 bp, Zea mays
  misc_feature: Ceres CLONE 1538237
  misc_feature: Encodes the peptide sequence at SEQ ID NO. 66099
  misc_feature (411)..(411): n is a, c, t, g, unknown, or other
  misc_feature (412)..(412): n is a, c, t, g, unknown, or other
tggagctccccgcggtggcggccgctctagaactagtggatcccccgggctgcaggaattcgtctcacccctagaaaaactctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttggnngaagcagaggctcatgagaatgcaaaaacgattggaagaactttgctttgccttggctgatgagcatttcagagaggagccagatggtgatgggagttctgctgtccagctattttgcaaggaacgagccagatgatgtttggatgtctgaaaaaagcccaaggactacctgcgaactgggagcacctgtacct

SEQ ID NO: 66099 - protein, 68 aa, Zea mays
  misc_feature: Ceres CLONE 1538237
  misc_feature (49)..(49): Xaa is any aa, unknown, or other
MDSAQDFQPRTFSIKLWPPSESTRIMLVDRMTNNLSTESIFSRKYRLLXEAEAHENAKTIGRTLLCLG

SEQ ID NO: 66100 - DNA, 846 bp, Zea mays
  misc_feature: Ceres CLONE 1538239-R
  misc_feature (846)..(846): n is a, c, t, g, unknown, or other
acgaattgggtacctcgagcgtctcgtttttttttttttttttgaagattaactcatgcagttgtaatacgtgaaaacccattttctcattgacatacagcagatattcgactccctaaatattgccatacaggtagaaatgcatctgcaacattttctcgagtgccttcagagcttcagcatcaacttgctgatgcaacttcactctagtccaaacaataaacatttgcattcctcgcttattaattaagaaaatgattgattcttttcgtcagcaacagaacatgtaaaactggtcatccacctctatctgagattgatttgattccaaacttccagaccacgctgggctgtattaaacagatgagaaaaaatgagtgggcccagaaaaattatttgtaccccttgaaaacatttcctttaatggcacaaaatcaatggtcaaaaatgtttagtcccattggaaaaaaccacccccctttttattttttgtaaagccccaaaccttttcttttttcaatccaaaaaggtggggccgggggataagcccttttccaaaaaacccccccggtttatttccaataaacaggggtttttccccccaaaaaaaaaaaaaaaaaaggccctaaaagggggggtgtttttcccctcctgaaaaaaaatggttctcacacaaaatttttttaaaaatacccccccccccgggggtttcccacagcacaaagaaaggcccgccctttctttgggtgggtgaaaaaaaataacacaaaaaaccccgccctttataaaaaatatcccccccctcccccgcgaaagggggaattaatttgggggggctcccccccn

SEQ ID NO: 66101 - DNA, 362 bp, Zea mays
  misc_feature: Ceres CLONE 1538241
cggtggggcgctctaaactgtggatcccccgggctgcaggattcgtctcacccctagaaaatacctatatgctcttcttgatcatgaatgaaaagagggaatgagtcaggaaagaggcagaaaaatttgtgggtgaaaggtaattttccctttgctaatggcccgtggaaggggggctaagggggaaaggggtttttttcccccaccaattttacaaaaaaaaaaattcccaaaatggggttttaaaaaaaaaaaaaaattttttttaccccccggggggggaaaaaaaaaggttttcccccccccttggggggggaaaaaaaaaaaaaaaaattttgtttaaaaaaccccccccccaaaaa

SEQ ID NO: 66102 - DNA, 631 bp, Zea mays
  misc_feature: Ceres CLONE 1538251
  misc_feature: Encodes the peptide sequence at SEQ ID NO. 66103
  misc_feature (609)..(609): n is a, c, t, g, unknown, or other
ggagctccccgcggtggcggccgctctagaactagtggatcccccgggctgcaggaattcgtctcacccctagaaaaagctgctattcccacacctcgtgcggcggtggcccaaccaaaggtcagccggggcgcttgaggcggtgagtcctcgtcctcgtccgatatcgcagcggaacaaggtcatgggcttccaggtggctgccgtggcaccgccgccgtgcgcgcgctcctcctccgccttatcgtcgccctcgacctcctcgcggccgttgcccgccttcctcggaggcggcggcggatgcgccgggctcgcgagatcccgggcacccgtaaactggggaaccggcgtgatggtgcggcgcccgcgcccggctcggacgccagcgaggtgcgcgctgagcgcgagtttggatgggatgggtggcggggacgcggagttcatgaagaagatcgaggagctcgctgcggcggctggggtgcagccggccggcccggcgggttgcggctggcccgcgagcgtggagctgagcgcgagcaacgtcgggctgccgctgtcgctgcggatgctgaagcggaaaaagcagcaacagcaggcgcagctgcatgnctgtagcgcgtccttcacgctg

SEQ ID NO: 66103 - protein, 149 aa, Zea mays
  misc_feature: Ceres CLONE 1538251
  misc_feature (142)..(142): Xaa is any aa, unknown, or other
MGFQVAAVAPPPCARSSSALSSPSTSSRPLPAFLGGGGGCAGLARSRAPVNWGTGVMVRRPRPARTPARCALSASLDGMGGGDAEFMKKIEELAAAAGVQPAGPAGCGWPASVELSASNVGLPLSLRMLKRKKQQQQAQLHXCSASFTL

SEQ ID NO: 66104 - DNA, 720 bp, Zea mays
  misc_feature: Ceres CLONE 1538254
  misc_feature: Encodes the peptide sequence at SEQ ID NO. 66105
  misc_feature (250)..(250): n is a, c, t, g, unknown, or other
  misc_feature (711)..(711): n is a, c, t, g, unknown, or other
  misc_feature (712)..(712): n is a, c, t, g, unknown, or other
tggagctccccgcggtggcggccgctctagaactagtggatcccccgggctgcaggaattcgtctcacccctagaaaaaggcgtggggcgtttgcctgtgtggcgcttcgcaggtgccgtggcttgccgcttccttcgccgtgctcactagtcaccagagagggaggaggctctggcgctctgcttctgctgccgcttcttcttcttctcctgctgctgctcttacggagataagcagggggggcggggnccggggcaggggggagggggaggtgacagctgagctgactagctgagtgaggcatggggatggacgccggcggcggcaagctgccgtacagctacgccggccaacaggacggagggaagctggtgaagagcgtcagccgcgtggagccgcgcaggttcggcctgggcctcgtggcgggcttcctcctcgtcacctgcgcctacttctccaccgccaagttcgacgccatccagatcgccatgaccagccgacccgtctccagcaatgcggccggcgtcggagtcggctcgctgggagtgggcgccgccgccgccgacaccctcaacgcctccaggcagggattagatttgggcgcgatgtccatggccgaggaggggagcgaggcccaagcgctcgagaaagacggcggcaaggcttcttcaccttcgggggcaggttcttggtcaggcgttcctgcagcnntctcttct

SEQ ID NO: 66105 - protein, 139 aa, Zea mays
  misc_feature: Ceres CLONE 1538254
  misc_feature (137)..(137): Xaa is any aa, unknown, or other
MGMDAGGGKLPYSYAGQQDGGKLVKSVSRVEPRRFGLGLVAGFLLVTCAYFSTAKFDAIQIAMTSRPVSSNAAGVGVGSLGVGAAAADTLNASRQGLDLGAMSMAEEGSEAQALEKDGGKASSPSGAGSWSGVPAAXSS

SEQ ID NO: 66106 - DNA, 710 bp, Zea mays
  misc_feature: Ceres CLONE 1538255
  misc_feature: Encodes the peptide sequence at SEQ ID NO. 66107
  misc_feature (533)..(533): n is a, c, t, g, unknown, or other
  misc_feature (543)..(543): n is a, c, t, g, unknown, or other
ggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccatttgacacgtcaaggccaagatccaggacaaggagggcatccctccagaccagcagccgctcatctttgctgggaagcagcnttgagacggncgcacgcttttgcgactacacatccagaaggagagcaccctccacttggtgctgcgcctcaggggaggcatgcagatcttcgtgaagaccctgaccggcaaaactatcacccttcaagggtggagtcttcagacaccatcgacaacgtcaaagccaagatccaggac

SEQ ID NO: 66107 - protein, 99 aa, Zea mays
  misc_feature: Ceres CLONE 1538255
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTI

SEQ ID NO: 66108 - DNA, 649 bp, Zea mays
  misc_feature: Ceres CLONE 1538260
  misc_feature: Encodes the peptide sequence at SEQ ID NO. 66109
  misc_feature (32)..(32): n is a, c, t, g, unknown, or other
ttgagtcgtcgaccgtcttcagatctagactngtggatcccccgggctgcaggaattcgtctcacccctagaaaatctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggcgtggccacgccggactaagaaacacgctgccgctggctggctgctcacgttgtgcgcggccgccgcgcccgccgccaggttttctggcttttgctggccacagatttgtagccgaccaaaggatttcagcacttccgctgcctgagatttacgccctcttagagcgaaaccctgggtgttcgattgaaaaaaaactgcccttgaggaagggttgtaatttcgttttcaaaccttgttggggcca

SEQ ID NO: 66109 - protein, 93 aa, Zea mays
  misc_feature: Ceres CLONE 1538260
  misc_feature (20)..(85): Pfam Name: zf-Tim10_DDP Pfam Description: Tim10/DDP family zinc finger
MDKSMLGDLDGLPEEDKMRMAAMIDQLQIRDSLRMYNSLVERCFTDCVDTFRRKNLDKQEESCVRRCAEKFLKHSMRVGMRFAELNQGVATPD

SEQ ID NO: 66110 - DNA, 712 bp, Zea mays
  misc_feature: Ceres CLONE 1538261
  misc_feature: Translation starting site: 187
  misc_feature: Pfam Name: Lycopene_cycl Pfam Description: Lycopene cyclase protein
  misc_feature (499)..(499): n is a, c, t, g, unknown, or other
  misc_feature (535)..(535): n is a, c, t, g, unknown, or other
  misc_feature (536)..(536): n is a, c, t, g, unknown, or other
  misc_feature (551)..(551): n is a, c, t, g, unknown, or other
  misc_feature (552)..(552): n is a, c, t, g, unknown, or other
ctggagctccccgcggtggcggccgctctagaactagtggatcccccgggctgcaggaattcgtctcacccctagaaaactctcttcgccgccacccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagcccagtccagatcgcttccnagctatcgcccatatctgatgaaaatacagtgcttnngattggttatcattnnggtgtggtccagctggtctttctctagcttcagagtcggctaagaaaggtctcactggtagtctcattgggcctgaccttccattcacaataactatggggtgtggggaagatgaaatttaaagaatctcggccttggagagctgtttcaagcattgcct

SEQ ID NO: 66111 - DNA, 623 bp, Zea mays
  misc_feature: Ceres CLONE 1538264
  misc_feature: Translation starting site: 168
  misc_feature: Pfam Name: PGAM Pfam Description: Phosphoglycerate mutase family
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaacgataggttcactgcatcttccatatgtgcaggtcaggcatgcccagggcattcacaatgtcgcgggggagaaggacttcggcgcgtacatgtcacatgaactgttcgatgctcagctcactcctttgggttggaaccaagtcgatggtctgcgtgagcatgtgaagaaaagtgggcttgcagaaaatctccggttattaaccttccataccactcttctctgcctcacactcctctcatgccccaatccacgcgcaggaatggaacttggcgccaccactgccctctaccctctgcaccgctgcaaaaccatttacctggtacttcctacttccccatccatactgaattgcacaacaggcaagggagggatacagcaaaaaaaaaaaaagaaacgagacgctcgaggtacccaattcgccctatagtgagtcgtattacgcgcgctcactggccgtcgttttacaacgtcgtgactgggaaaaccctggcgttaccccacttaatcgccttgcagcacatccccctttcgccagctggcgtat

SEQ ID NO: 66112 - DNA, 912 bp, Zea mays
  misc_feature: Ceres CLONE 1538272
ttaccgtttcctccccctttacataaaccctgacgcggcttcgcctatatcaccctccgaactcgtcgcggtggcggccgctctagactagtggatcccccgggctgcaagagattcgtctcacccctagaaaatttctgccctatcaattttcgatggtacgataggggcctaccatggtggtggccggaacgtcttgtcgagctcttgcctgtcgaggattctaaattcctcttctgcgtccaattgtctctgccatgtgcgagtaataccaatcaatgcttatcttcactatacaactgtaaataacacatataaaaatatcaagaccctcgtagggtacccaatttcccccctttcagcaagcccttaatcacttcgcctctatagatgccagcttctcttcacaaaacccacttcaataggtaacaccctcttgtgatttttacaccaaccacacatcctcctttttaattaaataacactccctttttttatatcgccccccccccaactagtttaaaagaagggttgctccccccacgtattttgcccttattccacacacacattttggtactaccctctcggaaacgggcaaaaacagtaaacaattttctactcagccggtttaagttcatcacctccctaaacaaattttaccgcataagcacaacacacatcccccccttcaaaatcatacacttcataattctatctcaacccctatccgcgttcccctaatttcctccccaattatcacctccctcatatattccccacccaccatacctccaacctaataacataccacctttcaatatattactcttccccccctatgcgcccaataaaggcgcgcccccctttctctcaataaaactattgggaatgcctcgactttctcaaacg

SEQ ID NO: 66113 - DNA, 640 bp, Zea mays
  misc_feature: Ceres CLONE 1538273
  misc_feature: Translation starting site: 201
  misc_feature: SWISSPROT Homolog: EC 3.2.1.23 Beta-galactosidase
  misc_feature (542)..(542): n is a, c, t, g, unknown, or other
ctccccgcggtggcggccgctctagaactagtggatcccccgggctgcaggaattcgtctcacccctagaaaaagagcaaaccccagcctccgttactctccttcctcttggctcgcttcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaatccccacatgttcatagggatgcatttgttgctccaagtgcatcccttattggtgatgttcaagtcgggcaaggagcttccatttggtatgggtgcgtcttaagaggtttgtggttcctgtccccatgagcattttattgttttacacaaaaaaaaaaaaaaaaacgagacgctcgaagtacccaattncgccctatagtgagtcgtattacgcgcgctcacgggccgtcgttttacaacgtcgtgactgggaaaaccctggcgttacccaacttaatcgccttgcg

SEQ ID NO: 66114 - DNA, 667 bp, Zea mays
  misc_feature: Ceres CLONE 1538281
  misc_feature: SWISSPROT Homolog: EC 3.2.1.23 Beta-galactosidase
tccccgcggtggcggccgctctagaactagtggatcccccgggctgcaggaattcgtctcacccctagaaaatagaaaaagtataatagttctcgtgagcgcacaccatgtaatcgtcgaaattcatccatgtgttgtgacattttttgagcacagttgaacatgtggtggagcctggaggcaggtcattctcgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatggaaattgtaagcgttaatattttgttaaaattcgcgttaaatttttgttaaatcagctcatttttttaaccaataggccgaaaatcggcaaaatcccctttaaatcaaaagaatagaaccgagaatagggttgagtgtttgttcccagtttgggaacaagaagtccaacttattaagaaactgggaactcccaccgctcaaaagggccgaaaaaacccgtccttatcagggccgaatgccccccact

SEQ ID NO: 66115 - DNA, 682 bp, Zea mays
  misc_feature: Ceres CLONE 1538285
  misc_feature: SWISSPROT Homolog: EC 3.2.1.23 Beta-galactosidase
tacccgcggtggcggccgctctagaactagtggatcccccgggctgcaggaattcgtctcacccctagaaaaagttcaaacttgaccgaacggcagccattacctggtggcgcctcctccttgccggtcggagccggctcgccggcgggtggcgacgctcccgccgctgtcacagggctgctcgcaccacgtgcactcctctccagtacacccaccgagacgcgagacctctaaggctctaacccaaggttgatctcatctcgtgcactcctctcccttcccccctaaaaaaaaaaaaaaaaacgagacgctcgaggtacccaattcgccctatagtgagtcgtattacgcgcgctcactggccgccgttttacaacgtcgtgactgggaaaaccctggcgttacccaatttaatcgccttgcagcacattcccctttcgccagctggcgtaatagcaaagaggcccgcaccaatcgcccttcccaacagttgctcatcctgaatggctaaatggaaattgtaagcggttaaaatttcggtaaaattcgcgttaaattttttgttaaaccagttgctttttcttacccaattgggccgaaaatccggaaaaatcccctctctaaagcccataggatccgcacctgagataaggggttatagtggttactttccatttttggg

SEQ ID NO: 66116 - DNA, 674 bp, Zea mays
  misc_feature: Ceres CLONE 1538287
  misc_feature: Encodes the peptide sequence at SEQ ID NO. 66117
  misc_feature (48)..(48): n is a, c, t, g, unknown, or other
gggagctccaccgcggtggcggccgctctagaactagtggatcccccngggctgcaggaattcgtctcacccctagaaaaaaaaaaaaaaaaaaaaaaaaaaaaaaaaaaaaaaattttcccggtcctccccattctcagccgcccgctagggttttagtgtttttagcctcctgcgtccctcccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgaggtgctgctaactgctgatacaaaaaatgttgaagaacaccatgaggcagactgtcagaaagtgtgctactgtcataagccaaagccaccatccttcttattgtcattttcatctggccaatttgcttggagtaggggtttctcctctcagccaggtgcaaattctagtgacaaggatgatgagttagaggatgtattttctgatctcaatgttccaccagaagctggtaaaaaggatgctgggttgacatctgaagatacttctgatgaggatgccactgatgaaattggcttgcctagtatggatgctgatgcaaaacctgagacggac

SEQ ID NO: 66117 - protein, 138 aa, Zea mays
  misc_feature: Ceres CLONE 1538287
MWALRRAGNPLRFHAQKVVSPRGCASLEVLLTADTKNVEEHHEADCQKVCYCHKPKPPSFLLSFSSGQFAWSRGFSSQPGANSSDKDDELEDVFSDLNVPPEAGKKDAGLTSEDTSDEDATDEIGLPSMDADAKPETD

SEQ ID NO: 66118 - DNA, 723 bp, Zea mays
  misc_feature: Ceres CLONE 1538297
  misc_feature: Encodes the peptide sequence at SEQ ID NO. 66119
  misc_feature (577)..(577): n is a, c, t, g, unknown, or other
  misc_feature (604)..(604): n is a, c, t, g, unknown, or other
  misc_feature (686)..(686): n is a, c, t, g, unknown, or other
  misc_feature (720)..(720): n is a, c, t, g, unknown, or other
aaagctggagctcaccgcggtggcggccgctctagaactagtggaacccccgggctgcaggaattcgtctcacccctagaaaaagtgccgtctagtcttccgcccctcttcttcccgggagaagctcgagctcctcctcttcctatcgctgcgtgcctcgcagctccgccagctgcaccttccacccctccctagcggtatatggcatccccgtcctcctgcaacgccacgggcgtgccgttcaccctgctgggcgcgctcatcaccgccggacccgccgcctggccggcctgcgtcggcggcggccgcgccttcctccgggactacgcgcggcgcgggaccaacgcgctgctgtgggcgggcctcctcgccgtcacctggctcctgctcctccgcgtcgccgcgcttctccgcctctgggcgctcggctcccgcatcccggggccccgcgcgctaatcgccgaccccgggctcgcctccgtcttgcgcaacggcggcgacatctccggttttctatcaaaattgcatgggagatatggcccagttgttcgcctgtgggtgggaccctcccagctanctgtatcagtcgtagatcctactctangtaaagaggtgctatcaaaggctaaagataagttaccattgactgggaggacatataatttagcttgtggaagaactgcccntgtttgtgtcctcattccagaagtgaaaaggacnaga

SEQ ID NO: 66119 - protein, 174 aa, Zea mays
  misc_feature: Ceres CLONE 1538297
  misc_feature (126)..(126): Xaa is any aa, unknown, or other
  misc_feature (135)..(135): Xaa is any aa, unknown, or other
  misc_feature (162)..(162): Xaa is any aa, unknown, or other
MASPSSCNATGVPFTLLGALITAGPAAWPACVGGGRAFLRDYARRGTNALLWAGLLAVTWLLLLRVAALLRLWALGSRIPGPRALIADPGLASVLRNGGDISGFLSKLHGRYGPVVRLWVGPSQLXVSVVDPTLXKEVLSKAKDKLPLTGRTYNLACGRTAXVCVLIPEVKRTR

SEQ ID NO: 66120 - DNA, 662 bp, Zea mays
  misc_feature: Ceres CLONE 1538299
  misc_feature: Encodes the peptide sequence at SEQ ID NO. 66121
  misc_feature (466)..(466): n is a, c, t, g, unknown, or other
  misc_feature (467)..(467): n is a, c, t, g, unknown, or other
tcaccgcggtggcggccgctctagaactagtggatcccccgggctgcaggaattcgtctcacccctagaaaaaagcaccgaagtccgagctctccaccgaggaaacctccccgctctctctctcctcaggtcatcagtcccctatcctcctcctcctcttcttccccacatcgtcagtgaggtcctcggggttgcagcggcaataatgggggagaggaggaggtttcctgctagcgctcgcttgctcgccctcgccgtggcgatggtgttgcaggcggcagcggtggtgctcgtcctgggcgaggcgagtgacggcggggccatgcttgtgggctcgcggcagctggagaagttcgtggacgagctgccggacatgccgaggctgcgcggctacggcgtcacggagggcggcgcgctcgtcgccggcaacctcaccatcggcatgtacgataccagctggaaattnncacgcgaccttccggcgacgcgcgtcttcgcctacggaaccagcaaggagaccgccacggtgccgggccccaccatcgaggccatgcggggcgtccccacgcacgtgacgtgggcgaaacactcccgggcgcgcactttcctcccgtggaccccacgctgacgacccgccgtgcgcccgggggccgcgggtcccc

SEQ ID NO: 66121 - protein, 140 aa, Zea mays
  misc_feature: Ceres CLONE 1538299
  misc_feature (87)..(87): Xaa is any aa, unknown, or other
  misc_feature (88)..(88): Xaa is any aa, unknown, or other
MGERRRFPASARLLALAVAMVLQAAAVVLVLGEASDGGAMLVGSRQLEKFVDELPDMPRLRGYGVTEGGALVAGNLTIGMYDTSWKXXRDLPATRVFAYGTSKETATVPGPTIEAMRGVPTHVTWAKHSRARTFLPWTPR

SEQ ID NO: 66122 - DNA, 655 bp, Zea mays
  misc_feature: Ceres CLONE 1538304
  misc_feature: Encodes the peptide sequence at SEQ ID NO. 66123
  misc_feature (345)..(345): n is a, c, t, g, unknown, or other
  misc_feature (347)..(347): n is a, c, t, g, unknown, or other
  misc_feature (358)..(358): n is a, c, t, g, unknown, or other
  misc_feature (377)..(377): n is a, c, t, g, unknown, or other
  misc_feature (378)..(378): n is a, c, t, g, unknown, or other
  misc_feature (519)..(519): n is a, c, t, g, unknown, or other
  misc_feature (551)..(551): n is a, c, t, g, unknown, or other
ggagctccccgcggtggcggccgctctagaactagtggatcccccgggctgcaggaattcgtctcacccctagaaaaagtttcgtcgactaatctccaaacatttttttcctcttcacaactcggcaactgctgactgccccgcactcatttgctctccacccctaccgcctgcctcagatctcgatgcggcgcaagcttcccggagacgcgccgctgtcggcggcgaaggccggtcatgcttcgtccgcatccgcgccgtcccgagcggggactgctcagctctccgcggccatcgcagccggggaagacctgggccccttcgtgcgccgggccttcgcgtgcngncgccccgagcngctgctcgcctcgctccgnnggggcgcgcggggaccaaagccgagatcgaggaactctgccgcgcacactttcaccgattcatccgcggccgtcgacgaacttcggtcccttctgggcgaaccccgaatcgctccaaggggtcccttctcggggtccccantcccgtgcttttcttccctcggggggccccgntgtgcccccccccttgaaatcccttccccgcctgggcggctttggtcccggggaaaaacccctccccccggggcctaagcctctctcccaaaagggggggtaac

SEQ ID NO: 66123 - protein, 147 aa, Zea mays
  misc_feature: Ceres CLONE 1538304
  misc_feature (54)..(54): Xaa is any aa, unknown, or other
  misc_feature (58)..(58): Xaa is any aa, unknown, or other
  misc_feature (65)..(65): Xaa is any aa, unknown, or other
  misc_feature (112)..(112): Xaa is any aa, unknown, or other
MRRKLPGDAPLSAAKAGHASSASAPSRAGTAQLSAAIAAGEDLGPFVRRAFACXRPEXLLASLRXGARGPKPRSRNSAAHTFTDSSAAVDELRSLLGEPRIAPRGPFSGSPXPCFSSLGGPRCAPPLEIPSPPGRLWSRGKTPPPGA

SEQ ID NO: 66124 - DNA, 633 bp, Zea mays
  misc_feature: Ceres CLONE 1538310
  misc_feature: SWISSPROT Homolog: EC 3.2.1.23 Beta-galactosidase
  misc_feature (294)..(294): n is a, c, t, g, unknown, or other
ctccccgcggtggcggccgctctagaactagtggatcccccgggctgcaggaattcgtctcacccctagattaagtagtatatatataagtaattaactgccatgcatggaagctagctaatggatggaggcagaggccagaacgatgaagggggaagctatacatatatgtgtgtaattaatatagatatatgggctttgtgttcatctttgcagctatgtattaatttgcatggatatctgttattcctttttatgtgtaacgtcttctaataaaatgtaattgaaccaaanctgctccatgaaatcaaaactctgttcttcaaatacatcatcaattatcgaaaaaaaaaaaaaaaaccgagccgctcgaggtacccaattcgccctatagtgagtcgtattacgcgcgctcactggccgtcgttttacaacgtcgtgactgggaaaaccctggcgttacccaacttaatcgccttgcagcacatccccctttcgccagttggcgtaatagcgaaaaggcccgcaccgatcgcccttcccaacatttgcccagcctgaatggcaaatggaaattgtaagccgttaattttttgttaaaattcccgttaaatttttgttaaatccccccct

SEQ ID NO: 66125 - DNA, 626 bp, Zea mays
  misc_feature: Ceres CLONE 1538317
  misc_feature: Encodes the peptide sequence at SEQ ID NO. 66126
  misc_feature (530)..(530): n is a, c, t, g, unknown, or other
gcggtggcggccgctctagaactagtggatcccccgggctgcaggaattcgtctcacccctagaaaaataccctggtctgccaagtcggttggagaaagaaattcttgaccgttatcttgatgtagttttgaagggaaacaaagatggcctaaagaaattacgactgcggatagaggatcctcctcggagaaagcacatggtgtatctgggaggtgcagtgcttgctgggatcatgaaggatgcacctgagttctggataaccaggcaggagtaccaggaagaaggtgtagcgtgcctaaggaagtgcgggcagtcataagtcttgccacatatcatccacagaaagaaatggaggttgcatgtgtaaagaagagctctgttgttggtgttgtgtattgaacccagctatagctgtcctgaacatgcttggggataaccatgtttgtattggcctactcaatttaacctctgttattgatcatcctttttaaatatggaacattgccggccccctttattttggattttntttttggggggcccccaattgatttttaaaaaaaaaaaaaaaaaacggagaccccctcggagggaccccaatttccccccattataggggggtggg

SEQ ID NO: 66126 - protein, 105 aa, Zea mays
  misc_feature: Ceres CLONE 1538317
GGGRSRTSGSPGLQEFVSPLEKYPGLPSRLEKEILDRYLDVVLKGNKDGLKKLRLRIEDPPRRKHMVYLGGAVLAGIMKDAPEFWITRQEYQEEGVACLRKCGQS

SEQ ID NO: 66127 - DNA, 648 bp, Zea mays
  misc_feature: Ceres CLONE 1538321
  misc_feature: SWISSPROT Homolog: EC 3.2.1.23 Beta-galactosidase
ctccccgcggtggcggccgctctagaactagtggatcccccgggctgcaggaattcgtctcacccctagaaaacgtgtgaaacaggtctccaagatcgggaatgctctcactttaactgttgtacttgcttgcagatacgatcttgctgtgttggcgactagcacaaaatgaaggaaaactcggtcatgtggggggcacggttattccgggaagtgatccatcagcatgaactggcactctctcccttcgtgttttttagccccgtttgttgatcactcgtaccgtgtaaaatataataaactaggttaaccttgattggcaaataatatctctgtttttatggcctagttgcaaacaaagtgacagaagcattcattccatggtgaatcgtgaacaatgagcgccgcctgctttctttaccacctgggagtgtatcctgcatcacattgtaacagacgtgcatttattcgacttacagtcaccgtaccaaaaaaaaaaaaaaaaacgagacgctcgaagtacccaattcgccctatagtgagtcgtattacgcgcgctcactggccgtcgttttacaacgtcgtgactggaaaaaccctggcgttacccaacttaatcgccttgcagcacatccccctttcgccaag

SEQ ID NO: 66128 - DNA, 879 bp, Zea mays
  misc_feature: Ceres CLONE 1538325
  misc_feature (36)..(36): n is a, c, t, g, unknown, or other
  misc_feature (44)..(44): n is a, c, t, g, unknown, or other
cctttttttgtttgttgttgggagctagggagaatnttattttnggtaatgtatattagctccccgcggtggcggccgctctagtaactagtggatcccccgggctgcaggaattcgtctcacccctagaaaaacatatgcaatggaagtctttgaatctgggttcaacagagaagtgtttatgagttcaaaaaaccacaatgttaggttgttttggctcaagagagaaattaaagcgcttgctgctatcatgtgatgtgaagtgaatgtggttgtgaagagataggcttactgaaaccgaaatatatccaactgctattacctgttccagcgagaagacttctgtcctgctttctggagagcttggagaacaataaaaaagcccatagatgctgttttttcgtttatgtttgctttagaggaccgatttccgcaccccaggaatttactcttgtttttgtacagcattcgttttttgccaataacccccccgcgcgctcttagagtaataatgtttggcttagggcttagaaaaaaagaaaaaaaaaacctattctttctttttagcgtatacccaagttttcccccccttattaggtggcaggcctagaatttatttatgctgtctctcctcgggcccttacacatttttacaagccgttcttaggaacacggggaataaacaccactgaagacaaaaacacaaagtttcacatggctcctcatggccggccgtgatcgccctccttttttttgcctatggttctgctctgtattcttatcacgataaaggttgcgctcaatatctatttttcgcgctattctccaagacatatatgattctcctcccactcggattgtccacaattttgtctatat

SEQ ID NO: 66129 - DNA, 643 bp, Zea mays
  misc_feature: Ceres CLONE 1538329
  misc_feature: Encodes the peptide sequence at SEQ ID NO. 66130
  misc_feature (256)..(256): n is a, c, t, g, unknown, or other
  misc_feature (278)..(278): n is a, c, t, g, unknown, or other
  misc_feature (306)..(306): n is a, c, t, g, unknown, or other
  misc_feature (353)..(353): n is a, c, t, g, unknown, or other
aacctggagctccccgcggtggcggccgctctagaactagtggatcccccgggctgcaggaattcgtctcacccctagaaaattcggtgagccgtgccacggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgnaatccgctaaggagtgtgtaancactcacctgccgaaatcactagccccnaaaatggatggcgctgaagcgcgcgacccacacccgccatctgggcnagcgacatgccccgatgaagtagaggggccggccgccgcccgcaaaacccggggcgcgagcccggcgggacgggcctcggtccaaattttggggggtgtgcccaaatttccaatgaaaactttgaaggccaaaaagaaaaaaggtcccgtgaaaccgcccctggccctgggttaacccctacccaaggggacggggaaaacccggggaaaagggggataccccccggttccccaaaaggggaaccgggtaaaaatttccccagcgccgggcgtgggggggaaaaagggac

SEQ ID NO: 66130 - protein, 40 aa, Zea mays
  misc_feature: Ceres CLONE 1538329
MNRKPGYGAKLRANLEPTKGVGRLRQQDGGHGSRNPLRSV

SEQ ID NO: 66131 - DNA, 768 bp, Zea mays
  misc_feature: Ceres CLONE 1538330
  misc_feature: Encodes the peptide sequence at SEQ ID NO. 66132
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (375)..(375): n is a, c, t, g, unknown, or other
ccccgcggaggttctttaaacggccacgccctcccctntttttaaacnnnnnnccccccactaaatccccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacnccatctacgccatcaccaagaacaactagctagtcatccttgccgacgacgacccatgtctctgtatctgcgtctgttcatatgcctgaattccccaccccgctgtatgtagttgcttgaatccagtcgtgttttgctaccgtacccaccccatgcaccatctggtaccgcggacgcaataatcctaagtaataacaagctccagagatttgatgcccgagaaaaaaaaaaagaccgagacgcttcgagggtccccaaatttccccccaaaacgcgaggtctgatttaagtcgccgcatcacgggggccggtcgatttttatcatcagccggcggacctggggaaaaaacccctggggggggttccccccaaccttcataccctgcccttggg

SEQ ID NO: 66132 - protein, 58 aa, Zea mays
  misc_feature: Ceres CLONE 1538330
  misc_feature (6)..(56): Pfam Name: UPF0057 Pfam Description: Uncharacterized protein family UPF0057
  misc_feature (50)..(50): Xaa is any aa, unknown, or other
MSEGTANCVDILIAIILPPLGVFLKYGCGHEFWICLLLTFLGYIPGIIYXIYAITKNN

SEQ ID NO: 66133 - DNA, 655 bp, Zea mays
  misc_feature: Ceres CLONE 1538331
  misc_feature: Encodes the peptide sequence at SEQ ID NO. 66134
  misc_feature (285)..(285): n is a, c, t, g, unknown, or other
  misc_feature (287)..(287): n is a, c, t, g, unknown, or other
  misc_feature (301)..(301): n is a, c, t, g, unknown, or other
  misc_feature (395)..(395): n is a, c, t, g, unknown, or other
ggagctccccgcggtggcggccgctctagaactagtggatcccccgggctgcaggaattcgtctcacccctagaaaaatacgatgaaagaggtgccaaatatgagcttccaaagtacgttctaagcgagccaacaaacttgatcagggacggttgaattgataaaataaacgtggggtccaatgtaaattatgtggatcacattattatactgacatcacgttggcatgattttggaacttcaataatattatgatgtgctagattctgattttagctgtccaananaaaaaaaccccganaaaaaaaaaaaaaaataaaaaaaaaaaaaaaaaaaataaaaaacaaaaaaaaaaaaaaaaaaaaaaaaccaaaaaaaggaaaaaaaaaaaaaancccggccccctcgaggtccccatttccccctaaagggagccattttccccccccccccggcccgtctttttaaaacctcgggatgggaaaaaccctgggtttcccaaattaaatcgccttgaaaaaaatccccttttccccggttggggaaatagcaaaaagcccccccccaatcccccttcccaaaatttccccaccctaaatggcaaatgaaaattgaaacctttataatttggtaaaattccccttaaaattttttt

SEQ ID NO: 66134 - protein, 51 aa, Zea mays
  misc_feature: Ceres CLONE 1538331
GAPRGGGRSRTSGSPGLQEFVSPLEKYDERGAKYELPKYVLSEPTNLIRDG

SEQ ID NO: 66135 - DNA, 688 bp, Zea mays
  misc_feature: Ceres CLONE 1538332
  misc_feature: Encodes the peptide sequence at SEQ ID NO. 66136
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (455)..(455): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (596)..(596): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
ggagctccccgcggtggcggccgctctagaactagtggatcccccgggctgcaggaattcgtctcacccctagaaaagttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgttcgtgagctgggaggcagtatctgtgttgtgtagcaaacttgttgccccaccccccccccnnangncactactggtctgtttgccgtatcaaaagagtttaaactgatgttgtaaccatgcaaaggctgaaaatttttaaaaaaaaaaaaaaaaacagacgcttcgaggaccccaattcccccttataggccccnnnnnnnnnngtngnnnnnnnnnnnnnnnnnnnnnnnnnnnnnnnnnnnnnnnnnnnnnnnnnnnnnnnnnnnnnnnnnnnnnnnnnnnnannnnntcccgcgag

SEQ ID NO: 66136 - protein, 68 aa, Zea mays; identical to SEQ ID NO: 61997
  misc_feature: Ceres CLONE 1538332
  misc_feature (1)..(64): Pfam Name: RAMP4 Pfam Description: Ribosome associated membrane protein RAMP4

SEQ ID NO: 66137 - DNA, 741 bp, Zea mays
  misc_feature: Ceres CLONE 1538333
  misc_feature: Encodes the peptide sequence at SEQ ID NO. 66138
ctggagctccccgcggtggcggccgctctagaactagtggatcccccgggctgcaggaattcgtctcacccctagaaaaaacccgttcgcctctcaccttttcgctgtactcactcgccacacacacaccctctccagctccgttggagctccggacagcagcaggcgcggggcggtcacgtagtaagcagctctcggctccctctccccttgctccatatgatcgtgcaacccatcgagctacgcgcgtggactgccttccctgagtcggcgcaggacgggatcggaaggatggcagcgtcggtttccagggccatctgcgttcataagccgggctcaaaatgcaccaggtacagggaagcgacctccttcgcccgccgatcggtcgcagcgccgaggcccccgcacgacaaagcctgcggagtcatccgctacgactccggcgtcgggacggggccagcatttgcttcgcgctgaggggccgtcgttgactcccgcgtccgatacagactaccaaaaaagagggtggtccccttgcggctaggggcagagccgaggggcaacagaaccatgaaggacctgctgggggggcaagggcccgaaccctggcggaaaatgaggagcatcggggcttacagggcccaccggggatttacgggtttcaacgaaggttgccccccaaaccaggaaaccccggtggggccccccccccggggtttggggcaaaaaatctcaacgggt

SEQ ID NO: 66138 - protein, 61 aa, Zea mays
  misc_feature: Ceres CLONE 1538333
  misc_feature: SWISSPROT Homolog: EC 2.7.9.1 Pyruvate, phosphate dikinase
MAASVSRAICVHKPGSKCTRYREATSFARRSVAAPRPPHDKACGVIRYDSGVGTGPAFASR

SEQ ID NO: 66139 - DNA, 687 bp, Zea mays
  misc_feature: Ceres CLONE 1538336
  misc_feature (184)..(184): n is a, c, t, g, unknown, or other
  misc_feature (273)..(273): n is a, c, t, g, unknown, or other
  misc_feature (504)..(504): n is a, c, t, g, unknown, or other
ctccccgcggtggcggccgctctagaactagtggatcccccgggctgcaggaattcgtctcacccctagaaaaactcgtcatcggcaggacatccacaccaacccgtgttcaaggaaaaaaaaccggggcggcgaataccctcgtaccctaatccttacgcccctcatggcggacgctgatgcngcgctgcctacgccgcccctcggagtagtagccccccgagagcatcccgtgggcgccgaatcccacgtcgccgcgccggccgaagtcgnatacaagcggaaactagaggaaggtcagcgccgaacccgataggtgaaggcacccagccaagaaccccaagcgcccccgccttggaaatggaaacccctaccccccaaaacggggtttgagccaccaaatccaatgggcccccccgggaaatgggattcccccacccccccggagaataagggtgcccctttaagtttggccccacattgggttggggaaaataaaaaacnctggttcccccctcccccctccaaaaaacaaaaggggggtttttttaaaaaaaaccccctttaaaaacccccctttaaacccccccgggggggagggggtttccccccactcgtttcaaaaaaattttttcccaaaaaaaaaaagcccccacacccaggggggggtgcgctctttttaaaaaa

SEQ ID NO: 66140 - DNA, 767 bp, Zea mays
  misc_feature: Ceres CLONE 1538338
  misc_feature: Encodes the peptide sequence at SEQ ID NO. 66141
  misc_feature (406)..(406): n is a, c, t, g, unknown, or other
  misc_feature (413)..(413): n is a, c, t, g, unknown, or other
  misc_feature (414)..(414): n is a, c, t, g, unknown, or other
  misc_feature (422)..(422): n is a, c, t, g, unknown, or other
  misc_feature (424)..(424): n is a, c, t, g, unknown, or other
  misc_feature (428)..(428): n is a, c, t, g, unknown, or other
  misc_feature (429)..(429): n is a, c, t, g, unknown, or other
  misc_feature (523)..(523): n is a, c, t, g, unknown, or other
  misc_feature (573)..(573): n is a, c, t, g, unknown, or other
  misc_feature (767)..(767): n is a, c, t, g, unknown, or other
ctggagctcaccgcggtggcggccgctctagaactagtggatcccccgggctgcaggaattcgtctcacccctagaaaaaacagaagacaggcagggcggcagcgcccacctccatctcccagccccgctccccaaatctcagccccgctccttcccagtcccagtcccagatccaggatgtcctcctccgacccggacgacgcccccgacgggggcgaggactcgcccctcttccgccgcagcggggggccgtcctccggcggcaccgttggcgacgtccccgtctcccagtcgctcatcaaggcggcaagcaacgtgtgcttctccctcttcgtgctcgccgtcctcgtcgtcaccgtcgtcgccgtcacataccagcccgcgggacccctggctcccagtccntcgccgnncatcacancntcgnntctcccgcgtccctccccaactcccacctttcctcgtccccgaacgacctcgctcctccccaccgggcgagggatttccaactcctccaccggncgttccccagcccccggtgccggaatggacaatgaacccgggttgcgggncgttcaggcgccgccccccgcccgggggcccgcggggaaacaaggacctggggaaacccgggacccgccccgtttaaaatttggttccaaacaccgcgggggttccctcccccgcccgttaaagagggcgtttaaaaccgccgggggcgcttttttccgggggaaacgcccccctcggggtttcccccaccaan

SEQ ID NO: 66141 - protein, 196 aa, Zea mays
  misc_feature: Ceres CLONE 1538338
  misc_feature (79)..(79): Xaa is any aa, unknown, or other
  misc_feature (82)..(82): Xaa is any aa, unknown, or other
  misc_feature (84)..(84): Xaa is any aa, unknown, or other
  misc_feature (132)..(132): Xaa is any aa, unknown, or other
MSSSDPDDAPDGGEDSPLFRRSGGPSSGGTVGDVPVSQSLIKAASNVCFSLFVLAVLVVTVVAVTYQPAGPLAPSPSPXITXSXLPRPSPTPTFPRPRTTSLLPTGRGISNSSTGRSPAPGAGMDNEPGLRXVQAPPPARGPAGKQGPGETRDPPRLKFGSKHRGGSLPRPLKRAFKTAGGAFFRGKRPPRGFPHQ

SEQ ID NO: 66142 - DNA, 785 bp, Zea mays
  misc_feature: Ceres CLONE 1538339
  misc_feature: Encodes the peptide sequence at SEQ ID NO. 66143
  misc_feature (36)..(36): n is a, c, t, g, unknown, or other
  misc_feature (37)..(37): n is a, c, t, g, unknown, or other
  misc_feature (54)..(54): n is a, c, t, g, unknown, or other
cgttgttgctcccttcctgcggcggccttccccttnnctatcaactttttcctngttctttgaactcaccgcggtggcggccgctctagactagtggatcccccgggctgcaggaagtcgtctcacccctagaaaaccgcgcttccttccgtcgccgccgccgcttcgcagccatgggtaaggtgcacggatcgctggcccgcgccgggaaggtccgcgggcagacgcccaaggtggcgaagcatgacaagaagaagaagccccgcggccgcgcgtacaagaggatgcagtacaaccgccgcttcgtcaccgccgtcgtcggcttcggcaagaagcgcgggcccaactcgtccgagaagtaggcgcgacgcctttgggctcgcatgccctatgcctatggctcttgctcttcctggtaatagcttccgtgtgtgcaagcagaaagaaaatctttttttgttgttcagggcacatcccccccaaaaaagctggagattatatggtcaacccccctttttaattcaaggatgaatttgttggagaaaagacatccaccgtaatgaagaagaggaataagaagggaggaaaaagataaataaaaatcggggccccttctgggggtcccccaaattccgcccccaatttggggaggtcctgtattaatcccgcgggccctcacctggggctccattctttttttttaccaaacgcccccccggaaatagggagaaaaaaaaaccgcgagagggggttagacccccaagatatatgaagtactccccccc

SEQ ID NO: 66143 - protein, 62 aa, Zea mays
  misc_feature: Ceres CLONE 1538339
  misc_feature (3)..(61): Pfam Name: Ribosomal_S30 Pfam Description: Ribosomal protein S30
MGKVHGSLARAGKVRGQTPKVAKHDKKKKPRGRAYKRMQYNRRFVTAVVGFGKKRGPNSSEK

SEQ ID NO: 66144 - DNA, 728 bp, Zea mays
  misc_feature: Ceres CLONE 1538342
  misc_feature: Encodes the peptide sequence at SEQ ID NO. 66145
  misc_feature (462)..(462): n is a, c, t, g, unknown, or other
  misc_feature (481)..(481): n is a, c, t, g, unknown, or other
ctggagctcaccgcggtggcggccgctctagaactagtggatcccccgggctgcaggaattcgtctcacccctagaaaaaagcaccgcaccgcaccgcaccgcaacgcgccaccgatccaccccgcgtcctcggcctccctccctccggcgagcggcggcgcgggcggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctctatgctcttcggcaccatcgtcggctccctcgccgacnaaacagggcgcaagagggnctgcatcacctactgcatcagctacatcctcagctgcatcaccaggcactcccccgagtacagggtcctcatgatcggccgcattcccggaagcatcgccaccttgttggtctttctcggccttcgattccgtggttcgtccaaaagcaaaacagaaaaggttttgaccccgcaggggctgtcactaaaatttccccaaagcctttttcctggggaagggttaaattgccctttgtgtctggggctt

SEQ ID NO: 66145 - protein, 186 aa, Zea mays
  misc_feature: Ceres CLONE 1538342
  misc_feature (4)..(186): Pfam Name: DUF791 Pfam Description: Protein of unknown function (DUF791)
  misc_feature (98)..(98): Xaa is any aa, unknown, or other
  misc_feature (104)..(104): Xaa is any aa, unknown, or other
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADXTGRKRXCITYCISYILSCITRHSPEYRVLMIGRIPGSIATLLVFLGLRFRGSSKSKTEKVLTPQGLSLKFPQSLFPGEGLNCPLCLGL

SEQ ID NO: 66146 - DNA, 648 bp, Zea mays
  misc_feature: Ceres CLONE 1538345
  misc_feature: Encodes the peptide sequence at SEQ ID NO. 66147
  misc_feature (448)..(448): n is a, c, t, g, unknown, or other
  misc_feature (592)..(592): n is a, c, t, g, unknown, or other
ctccccgcggtggcggccgctctagaactagtggatcccccgggctgcaggaattcgtctcacccctagaaaaagacgtagtagtacgtggacgatgccaatcccagtgtttgtgtttgtcgcctagacgcctcaaggccctctttccccctctccgccttgactcactcacttggccactcttcttcctcctcatcaatccgctctccagcacttgttcggaagaaaaagaagctagaacacgctaacaagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggcaaggncgcgaggcagcaggaggcaagccgtctcggggcctccggcggcggcgacgtccctctcgtcgactacctcaacacccagtacttatggggtcgtcggcatcgggcacacgccgcaaaatttcaccgtcatcttcgaaaccgggnaggtcaaccttttgggtcccctcctcccgatgctacttccccaatggcctgcaacc

SEQ ID NO: 66147 - protein, 128 aa, Zea mays
  misc_feature: Ceres CLONE 1538345
  misc_feature (62)..(62): Xaa is any aa, unknown, or other
  misc_feature (110)..(110): Xaa is any aa, unknown, or other
MGRGRGHLLLPAAAACLWALSCALLLRASPHRAGAGAGGLLRVGLSRRGGGLDQRALAAARXRGSRRQAVSGPPAAATSLSSTTSTPSTYGVVGIGHTPQNFTVIFETGXVNLLGPLLPMLLPQWPAT

SEQ ID NO: 66148 - DNA, 733 bp, Zea mays
  misc_feature: Ceres CLONE 1538346
  misc_feature: Translation starting site: 190
  misc_feature: SWISSPROT Homolog: EC 2.3.1.119 Icosanoyl-CoA synthase
atagctggagctcaccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggcgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccagtccccaggcccgtgtacctcatcgacttcgcatgctacaagccggccgacgagctcaaggtgtccaaggcgggattcatcgacctggcgcgcaagtccggcaagttcgacaaggacagcctggcggtcaagtcgcgtctgctggccaagtccgggatccggcgaaaagtcgtacatgccgcgcctgcg

SEQ ID NO: 66149 - DNA, 844 bp, Zea mays
  misc_feature: Ceres CLONE 1538351
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (23)..(23): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (494)..(494): n is a, c, t, g, unknown, or other
cttttgtnttnnggtgngttttnttttcattttcattnnaanngaaacnnnnccgtctctggactccaccgcggtggcggccgctctatactagtggatcccccgggctgcaggaagtcgtctcacccctagaaaaaatgttttttctttgttgtccgtccgtccatgcaaccaagaaatttcatggagaatctgtacaaaagagtggctagctactacacgagagtccgttctgagagaagcaacacgaggtcagtcagtggatgagtttagagtgagacattcacacgctgagagggttgataatttgtgatattttcctctttttttttcttcttcctgattttgtatattggaatatcctgcctggattttccaatggaatgagtgaaagaaccaatccaatctttataaatagtagtagtacacccccaggtgggtgggggctgatatcacccatgagagttatgggttttttttcccccccctttganaatacgagcatttgtaatgcttttcacattactcacttctcccggaggaccctcacgtttgccgcactcaccccctcctacgtgcccagtcttctttataacgagccgcgtgagcatgcggaacattctgtgccgcccttggtcaagtccaactccatgaacacagtttaagtggagtcatgtgtcttttaccaccttaccgccccttttcgccagctcctatttaccttatcccttgtaagtccgattgacttattatgttcgtgcgtccccccatccgcgtggggttggcctctcccttcataaccccggctttcctataactctatccaaaccgtcttatgtatgtt

SEQ ID NO: 66150 - DNA, 659 bp, Zea mays
  misc_feature: Ceres CLONE 1538352
  misc_feature: Translation starting site: 104
  misc_feature: Pfam Name: Nramp Pfam Description: Natural resistance-associated macrophage protein
  misc_feature (531)..(531): n is a, c, t, g, unknown, or other
  misc_feature (536)..(536): n is a, c, t, g, unknown, or other
tggagctccccgcggtggcggccgctctagaactagtggatcccccgggctgcaggaattcgtctcacccctagaaaaaaggtccaactcgcgacgcatctcgatggccgccaccgacgacggtgccgtggactccgcctccgccgcggccgcggccagggccgtcgaggaggcgcgcgcgctgctccccgccccggcgccggactacgacgacgaggatctcgaggagcgcgcgtacgaggcggctgagaaggtcatcgtgtccatctcgggcgggccggacccggaggacgtcgacggcgatggcgacggcgcggagctctgctcgtcctcggggtcgtcaccgccgcccttctcgtggcggaagctctggctcttcacgggccccgggttcctcatgagcatcgcgttcctggacccgggcaacctcgagggcgacctccaggcgggcgccgtctcccgggacacgctgctgtggctgctcatgtgggccaccgccatgggcctcctcgtgcagctcctcgccgcggngcctngggggtcgccacaggccgtcacctcgccgagctctgccgcgacgagtaccctgactgggcgcgccgcgcgctctggctcattggccgaagttccccttggtccgggccggaacttccctggag

SEQ ID NO: 66151 - DNA, 766 bp, Zea mays
  misc_feature: Ceres CLONE 1538353
  misc_feature (766)..(766): n is a, c, t, g, unknown, or other
aagctggagctcaccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgaccaaaaccggggggcaacagcagcgggatccccgtgctggtcgacgaagacgacccgctcgcgctcgaatcgtttctaaacatcactctggtggacaaggcagggcgcctcgtaagcttggagatggatgtctccagagcctacttcgtggcttacgtagcagggcagcgcctcgtccctcctcaagagatcaagcccgcacgttccccgtcggcgaatctgtttactaccggggggcccgtgggggaaacaaagtccgggctccctgtcaaccggaccttgtttgcttgcttgcccggggaaccggctaagggatcccgtgggggtccggggcattgggccaaacccaaaaaaatttccgaaaan

SEQ ID NO: 66152 - DNA, 877 bp, Zea mays
  misc_feature: Ceres CLONE 1538355
  misc_feature (26)..(26): n is a, c, t, g, unknown, or other
  misc_feature (34)..(34): n is a, c, t, g, unknown, or other
  misc_feature (458)..(458): n is a, c, t, g, unknown, or other
ttgttgcccccgccgggcgccccccnttcctatnaaaacacccggcggaccgcacccgagctccacgcggtggcggccgctctagtatagtggatcccccgggctgcaggaattcgtctcacccctagaaaaactttaattttaccaagtttgtttcaaggtggatcgcgtggtcaaggcccgtgtgctttaaagacccaccggcactggcagtgagtgtggctgcttgtgtagtgcttcggacgtatgggttttatttgcttctggatcttctgtactcctttgggttggtgcaatcattatgcagcagtggcgttttgtagttccagctggggctaactgtatttttatcatccctcctctacaatcgcacccctatccccccctccagaccgcagacaagaaagacgggtatctcttccgtacttattggatttctggctttaaaccccccatanatagcaaacccccccctttagtggacccttagttatggcccaccccacactttgccctgggggaaccttccccgctacctgttttccccgttctccccccgtcccgtttgccttctgccgccccccacgttgtttgccgcatcgtgtaccaccaatgtcatcggaagatagatctcctgtcacctactttgcctgtgctctttccccagcgaggagctgctcctaatcccatctttagacccacatccttcacactcctccataccgtttcgcacatgtcgctggacaccccctctgtgccccttggttttcggtttgcgccgtgggagccccctttccgatcccttatgccaaccacgagccaccaaagttggtttagccgtccgtagctgggggaggtcccgaacttgcctctcccc

SEQ ID NO: 66153 - DNA, 879 bp, Zea mays
  misc_feature: Ceres CLONE 1538356
  misc_feature: Encodes the peptide sequence at SEQ ID NO. 66154
  misc_feature (38)..(38): n is a, c, t, g, unknown, or other
  misc_feature (47)..(47): n is a, c, t, g, unknown, or other
  misc_feature (879)..(879): n is a, c, t, g, unknown, or other
ttcccctccctcccccccttcacgtattatgggatggnggggtcccnttaaaacacacctaaacctccccgtcggtggcggccgctctagaactagtggatcccccgggctgcaggaattcgtctcacccctagaaaaactctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaacgcaatgaacctgtccagccgtgggaggatgattgggatgaccatcatgttaacgatgatctctcccccgctcccgagcaaataacctgtaggtacagtaccgcccacaaagacctgaacccctttttttttccacctcccaggagggcgggggggggggcgcccccccccttcttttcatatctttaaacccctcttcctttaccctacacgttccccctggggattaatctcccgtttcccggcccgacctatactcgaccaacgctcccccccatgcgtcatttcttttagtatccgcccaaattaaaaaagaacatctgtcacatctccctccttatgttcaagcccccgactctgttactagttttccgctaacgctagccggtcttttcttgtgcccgcagccccatacccctcctcggccatcaccgccgattcccaccctttttacaaaccgcgatattgacccacccccctccccccttctgtcacatccccgcgtcgctgcactcgccccccccccaagcccgcgtacttgcccgaccccggttcgtattgctgacaagggttacttctcccccttcccn

SEQ ID NO: 66154 - protein, 100 aa, Zea mays
  misc_feature: Ceres CLONE 1538356
  misc_feature (8)..(66): Pfam Name: DSS1_SEM1 Pfam Description: DSS1/SEM1 family
MAATPADAKTEAAKMDLLEDDDEFEEFEIDQEWDEKEERNEPVQPWEDDWDDHHVNDDLSPAPEQITCRYSTAHKDLNPFFFPPPRRAGGGAPPPFFSYL

SEQ ID NO: 66155 - DNA, 682 bp, Zea mays
  misc_feature: Ceres CLONE 1538363
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (309)..(309): n is a, c, t, g, unknown, or other
  misc_feature (495)..(495): n is a, c, t, g, unknown, or other
ctggagctccccgcggtggcggccgctctagaactagtggatcccccgggctgcaggaattcgtctcacccctagaaaaagttttatcccctcgcccttgcactcctccgccgcacccctttcctccttccgccctccgccgcgcctggctttctcccttcccgagaggccacgctccatccccgcccgcgctgcctcccctggcgatcggcggcgaccgcggcccaacgaaagcgtcgtggtcggccgacgctgggcggactgggaacaagcgccaatggggnnnatcgcggtggtggctctacacanccatggccgggggcgttcaccacccactccccggcatccattctgtcccttcggcagactttacgaggataaacagccgcacaattcggtgccaacgccagacactgcaggcgtcctaagatcccgagctgagtcggtcaggggctgtgccagcgatcgatgaccgggtacagagggaacggtccntgggtcaagatgccatgaatacgctaggcaggttcttggcgacatcagctggcttgtcaacctgtaatgggcattgggggtctaaaggggagggctgccaggacccccccccaaagggggaagccccttttcggttgagaaaaagccccgggaacctttgcgagagaccaaggggttaccttgtggg

SEQ ID NO: 66156 - DNA, 626 bp, Zea mays
  misc_feature: Ceres CLONE 1538366
  misc_feature: Encodes the peptide sequence at SEQ ID NO. 66157
  misc_feature (577)..(577): n is a, c, t, g, unknown, or other
  misc_feature (595)..(595): n is a, c, t, g, unknown, or other
aaagctggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcggggtgcgtgttcccggagctgctcgcccgcacggcgtcaagtcggcgaaggccgtgtggttcaagggccgggtccagatcctcagcgaaggcnggcttgactacctcggcnacccgagcctgatccacgcgcagagcatccc

SEQ ID NO: 66157 - protein, 151 aa, Zea mays
  misc_feature: Ceres CLONE 1538366
  misc_feature (58)..(149): Pfam Name: Chloroa_b-bind Pfam Description: Chlorophyll A-B binding protein
  misc_feature (136)..(136): Xaa is any aa, unknown, or other
  misc_feature (142)..(142): Xaa is any aa, unknown, or other
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGVRVPGAARPHGVKSAKAVWFKGRVQILSEGXLDYLGXPSLIHAQSI

SEQ ID NO: 66158 - DNA, 645 bp, Zea mays
  misc_feature: Ceres CLONE 1538387
  misc_feature: Encodes the peptide sequence at SEQ ID NO. 66159
  misc_feature (368)..(368): n is a, c, t, g, unknown, or other
  misc_feature (402)..(402): n is a, c, t, g, unknown, or other
ctggagctccccgcggtggcggccgctctagaactagtggatcccccgggctgcaggaattcgtctcacccctagaaaaaacagagcagccacttgggatccgggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgcgnccctcggcgggccgccgcagcaggaggaacggcngcggcgtgtcctcccgggtccggctccggcggcccgtgcggctgccgaagatcagctgcagcgccaccgaagaagtcagcggcggccttgtcgtcccgtcaccgtggaaaggatgcttacgggtaacggcttccggtggaagcggtccccggccatccgggcaaaatgtactttcaagggggcccttaaaaaaaaattggggaaccttatttcggaaaaaccctgcccgcgggaaacccccac

SEQ ID NO: 66159 - protein, 120 aa, Zea mays
  misc_feature: Ceres CLONE 1538387
  misc_feature (40)..(40): Xaa is any aa, unknown, or other
MMNLNLKQPLVLPAHHSNVVGSRLSSPRPSAGRRSRRNGXGVSSRVRLRRPVRLPKISCSATEEVSGGLVVPSPWKGCLRVTASGGSGPRPSGQNVLSRGPLKKNWGTLFRKNPARGKPP

SEQ ID NO: 66160 - DNA, 667 bp, Zea mays
  misc_feature: Ceres CLONE 1538392
  misc_feature: Encodes the peptide sequence at SEQ ID NO. 66161
tccccgcggtggcggccgctctagaactagtggatcccccgggctgcaggaattcgtctcacccctagaaaaaacagcaaccagcgcaaatcagcacgatgcgtcgcgagggccgccagcacgggtgggtgtttaccgtcgaccccagcctggtcgacgcggagggcaagtgccggtcccgcgcggtgcatgtggagggcgcggcggcggccaacggcgggttcgtcagggcgtcgaggaaacccaccaaccactccaagcccgccgtcggccgcgcgtacaagtccatgatcggcaagggagaggccgggtcgggcaagcagggcaggcacaagttcaagcacgacgaggtcaagatgtactccctctacctcgagggcgcccacgacgcctacgcggatgcgatgctggagttcgactcgtagtcctgctgatgacattgggtgtgtgaatgatgaggtgctggatttcgacttgcgccatttgccagactcaggaggtgtacagattcgatgtacgcctctgtgtctgaatccaatgtgttttggggatgtgaccagtgaataacccgactgggttgtgaccaaaaaaaaaaaaaaaaaccaagaccctccaggtacccaatttccccctcttaggtgagtcgttatttcccccccctccctgg

SEQ ID NO: 66161 - protein, 108 aa, Zea mays
  misc_feature: Ceres CLONE 1538392
MRREGRQHGWVFTVDPSLVDAEGKCRSRAVHVEGAAAANGGFVRASRKPTNHSKPAVGRAYKSMIGKGEAGSGKQGRHKFKHDEVKMYSLYLEGAHDAYADAMLEFDS

SEQ ID NO: 66162 - DNA, 546 bp, Zea mays
  misc_feature: Ceres CLONE 1538395
  misc_feature: Encodes the peptide sequence at SEQ ID NO. 66163
  misc_feature (186)..(186): n is a, c, t, g, unknown, or other
ctcaccgcggtggcggccgctctagaactagtggatcccccgggctgcaggaattcgtctcacccctagaaaaattcacgcacctagggttttcgcgccgccgccgccgccgccgccgcagccgcaacaatgccgtcgcacaagaccttccggatcaagaagaagctggcgaagaagatgcgccangaaccgcccccattcccctactgggatccggcattggccgccctggacaaattccctttgggaaaaagcccagcgcggggctggggcccccccaagttgggttttaaacttgggaatggccggcttctccccaaaaggtagggccaaaaaccccttccctcttgtttaaaaaggggccttttttttgaaacacaaaagggtggtttaaacctccccccaaaaatcccgggggggggggttttttaagaacccccccccctcacacaatgagggaaagcgcctccgtgtttttccgcgctccccctctccggcggcttttttatttttcgttgggggaaaaacaaataaaaaaagccggcg

SEQ ID NO: 66163 - protein, 65 aa, Zea mays
  misc_feature: Ceres CLONE 1538395
  misc_feature (19)..(19): Xaa is any aa, unknown, or other
MPSHKTFRIKKKLAKKMRXEPPPFPYWDPALAALDKFPLGKSPARGWGPPKLGFKLGNGRLLPKR

SEQ ID NO: 66164 - DNA, 720 bp, Zea mays
  misc_feature: Ceres CLONE 1538404
  misc_feature: Encodes the peptide sequence at SEQ ID NO. 66165
ggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgcccccctgtgaatctagtcctcccttttcttgtatcttccatggtaacgcgggcgtggtgcgtccccaacacgctgtgatgatggccggaaggaacaccaccttattagaccgtttgccgtggctggcacagtcaccgtgccctacgaacggaggcaaatacattgagaacccttgtgggggaccgctattgccccccgcataggtgaagtggcagatcccctggcctagatacgcactgtctcgtatcgctatttcaaggggcgcttacgtgagtggtgtggaaagacactgctgtggattggttatcccggatctgt

SEQ ID NO: 66165 - protein, 63 aa, Zea mays; identical to SEQ ID NO: 28299
  misc_feature: Ceres CLONE 1538404

SEQ ID NO: 66166 - DNA, 797 bp, Zea mays
  misc_feature: Ceres CLONE 1538405-R
  misc_feature: SWISSPROT Homolog: EC 2.7.11.1 Non-specific serine/threonine protein kinase
  misc_feature (531)..(531): n is a, c, t, g, unknown, or other
aattgggtacctcgagcgtctcgtttttttttttttttttctttagaaaatggcaaaccccaatatttctcggtaatttatgtacaagatgaatcctcccatgtgggattgagttcacaagagtgctccaatacactacaacgaaccaacaacaaccgatataatacagattattacacactagtgtcatcttccaacggagatgcccgacgtcatggtggtgcccatgctggtccccgaccacgggtactgcagagcagactggtcgaacgacgtctggctctgcatgaggctgagcaagctgatgcccgccggcgtcagctccggcagcggcgcgtcgccgtccaggtactgcatgacctgcctcatggtaggcctctcggccggggacgggtgggagcacatgagcccgagcgtgagcaccatcctggcctcgtcgaagttgtagtcgccgcgcagcctgaagtccacggtctcctcgatcgagcccctgcgccagtactccagcacccggtcgaacagcagcttgcngccgtggcgcacggtgtcaacaaacggcccgcggcccccagtgacccaagcaagaaaggtgcccaatgccaaaaacctccgtgaaacggggaaccctttgcccgtcctgaaaaactccggcccccttgtaaccccggggggcccaaacccccttgcgtgggccctgaaaggccggccccccgggttcctaacacccctgggaaagccccaaaatcccccccagggggggccccacctgtggccccctctccaaaaaaaaacccttt

SEQ ID NO: 66167 - DNA, 660 bp, Zea mays
  misc_feature: Ceres CLONE 1538405
  misc_feature: Encodes the peptide sequence at SEQ ID NO. 66168
  misc_feature (586)..(586): n is a, c, t, g, unknown, or other
  misc_feature (617)..(617): n is a, c, t, g, unknown, or other
  misc_feature (618)..(618): n is a, c, t, g, unknown, or other
ctggagctccccgcggtggcggccgctctagaactagtggatcccccgggctgcaggaattcgtctcacccctagaaaagatcagcgatgccctccttcctcgtagtagccttcttcgtcctcctctgcctcggcctcaacaaccttctggcgctcggtgacgccggcggcggcaacgactactccttcgtctactctggcttcggcggcgcgaccggtgccagcagcctcgtccttgacggcacggccacggtcacccgggaaggcgtcctcaagctgacgaacgacgagcaggccaacctgaaaggccacgcgttccacccgactccagtccagttcagggactcctcctcctcctcgcccaataatgccacggcggcggtgcggtccttctccgccaccttcgtcttcgccatcatctccgcctccacctactggagcagcgacggcatggccttcgtcgtctccccggtgaaggacctctcgggcgcgtcgtccgcgcagtacctgggcttgctcaacagcacgagcgacggccccggcgccgccgccagcaaccacgtgctcgccgtggagctcgacaggntcatggaacgtggagttccaggacatcgacnnacaccacgtcgggcgtcgacgtcaacacccctctccctcgtt

SEQ ID NO: 66168 - protein, 191 aa, Zea mays
  misc_feature: Ceres CLONE 1538405
  misc_feature (30)..(191): Pfam Name: Lectin_legB Pfam Description: Legume lectin domain
  misc_feature (167)..(167): Xaa is any aa, unknown, or other
  misc_feature (177)..(177): Xaa is any aa, unknown, or other
MPSFLVVAFFVLLCLGLNNLLALGDAGGGNDYSFVYSGFGGATGASSLVLDGTATVTREGVLKLTNDEQANLKGHAFHPTPVQFRDSSSSSPNNATAAVRSFSATFVFAIISASTYWSSDGMAFVVSPVKDLSGASSAQYLGLLNSTSDGPGAAASNHVLAVELDRXMERGVPGHRXTPRRASTSTPLSLV

SEQ ID NO: 66169 - DNA, 774 bp, Zea mays
  misc_feature: Ceres CLONE 1538406
  misc_feature (23)..(23): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
agctggagctctcagtcgtccancgagcattcaannnnnnggatcccccgggctgcaggaattcgtctcacccctagaaaaaacgttcaaggcttcgaggcccaacctgttcatgtgatttagctgtggtcagtgtatgtgatcgtaagaatctgtgttttaagttttgacgctaagacttgggtggtttgaagattcacctctttttaaaaagattattttcaaaaaagcttgggacaaatacaaaataacgagggaataaaaataaaaaaaccaaacgctcgaggttccccattccccctatagggagtcgtattacccgccctccctggcccgccttttttacaacgccgttaaggggaaaaaaccctggccgtttcccaaatttaatcccccttagaaaaaatatccccccttttcccccccttggggtttaatagcaaaaaaaggcccccccccgtattcccccctttccccaaaatttttcccccccccccgaaattgggcaaatagggaaatttttaaacccctttaaatatattttgtaaaaacttccggcgttaaaattttttttgttaaaactcacccccctttttttttacaaccaaaaagggcccaaaaaatctggacaaaatccccttttttaaattcacaaaaaacaaaacccccaaaataaggggcttccagtcgtttcctcccctctttcggaaaaaaagaaccctcccttttataaaaaaaacgggtggtcctcccacaggtcaataggggccataa

SEQ ID NO: 66170 - DNA, 679 bp, Zea mays
  misc_feature: Ceres CLONE 1538407
  misc_feature: Encodes the peptide sequence at SEQ ID NO. 66171
ctccccgcggtggcggccgctctagaactagtggatcccccgggctgcaggaattcgtctcacccctagaaaatcaactgttggacaatgggcacggatagagaatatgaccatcctgggcgaggatgttcatgtgtgtgacgaggtatacagcaatggcggtgttgttctccccataaagagatcaagtcaagcattttgaagcctgagatcgtcatgtgagagttctccagttttaactacagtacattcttaagttcttcgactaagtgaggattgcagatccccttttataagtgatatctattggtatctttggcctaattcaaacagcttcagacatgttcgcttgctaaactgttgacaatgtatcctttgtctttgttgaaaagtttttgactttcaactgtcaatccaatttatcaagtggttggccataaaaacggaagggaaggttttggaccctttgattctacaaaagtttcatatcaattggtgcccaagaataagttttttttttttttaaaccgccgatatacaacacttcttttaggtaacatttataaaatatcccccaaaacgccccgaagggtccccacatttccccccttaagtggggtgcccttattacccccccccctcccggtggcccggttttttttaaaaaagccgccgggag

SEQ ID NO: 66171 - protein, 31 aa, Zea mays
  misc_feature: Ceres CLONE 1538407
  misc_feature: SWISSPROT Homolog: EC 2.7.7.13 Mannose-1-phosphate guanylyltransferase
MTILGEDVHVCDEVYSNGGVVLPIKRSSQAF

SEQ ID NO: 66172 - DNA, 997 bp, Zea mays
  misc_feature: Ceres CLONE 1538411-R2
  misc_feature: Pfam Name: Sec23_BS Pfam Description: Sec23/Sec24 beta-sandwich domain
  misc_feature (1)..(1): n is a, c, t, g, unknown, or other
ngggggggggggggggggttgtttgtttttttttttttttggtaagcggtaaaactttgatttgggagcctgactaccaaattttagagctatgtcctttactctttcatcaattgagagcctcatatcaatagcatcagaggcagtcctggcacgcaatacagttcttttaccaatgataactgccgcaacatcctcctgcacacttgccagatatgcagacaaaccatcatcagtctgcagcctcatagtgatcacccgagtgatttctgtttgatatatattggaataatggacagccaactgaaagaaaacaaaatcgcgtttgatatcagcctttgtctccatttacacagaaaaactctgtgtttcctcaaaactatgcatctggagtacagaaagaacaaccccagccttgaaacgttttcattgaaaaatcaggaagaagcctctttcctcccatggggcaaaaaactttggagtaaacataacatggtttttcggaaaccccctggatctctcaaaactaaagcccatggggaaaacccggctggcctccttgatttgaaggccccccttttgtgagaaaattgtgaccccctataaagggcgctttcttcccaaaaaagatccattccaatggaagacctctaaaggagagcaccgaaccctttcccaaaaaaaaaaaactgtttgtgcacaaaaataggttgttttcaaaggaaaactaggaggtagaccccccctacacaggggaacaacctgtgttcccaaatctagcaaaaaaagaatattcctcacccgtccaggttttgcaggcgggataccccctgaggccacttcatataaaacccaaaaaaacgctttaccataacacacattcgatatacatggttcttatttccaggattaaggaccttcagtttgggtgactgtctttggacatcaaaagaggggtaacgcaatcccaggagtccacaaaggtgttttatggcgc

SEQ ID NO: 66173 - DNA, 1086 bp, Zea mays
  misc_feature: Ceres CLONE 1538411-R
  misc_feature: Encodes the peptide sequence at SEQ ID NO. 66174
  misc_feature (832)..(832): n is a, c, t, g, unknown, or other
ggagctttgatttgggagcctgactaccaaattttagagctatgtcctttactctttcatcaattgagagcctcatatcaatagcatcagaggcagtcctggcacgcaatacagttcttttaccaatgataactgccgcaacatcctcctgcacacttgccagatattgcagaacaaccctcatcagtctgcagccctcatagtggtcccccgcattgaatttcggtttgaagattcatgggaatcatggacagcgtaatgggaagaaaacaaaaacccttttaaaatcaggctttgttctccctagaacacagaaaaaactccgttgtttcattcaacacttttcgtctttgtattcttgaattgaaaccggccgctgtcttgggacagttgttccgggaatatgcccgtggaagaaccctctccccccccttgaggggccctaaaagcttgggggggtaaatgttcacgatggtttgcgccctgtaagcatgttcctgtccattgcgtcgatggatatagtgcgtttggggggaggaacccgatctcctgatcacgctcacgtgtttagctgggcctccctttcccgccagtcgtagtgtgtccgcctccctgtattgggagccctctcttcctctagaaagggtcaggtaggccacgggtggggactacatgtatacgcgagcatgtgacgctgggccgccgcgaatatgaatctttttttacgccctggccgctggtgtgttgggacaggaaaagacacgtgggataagcccgctcctcgtagtgagaaaagcagttccagtcctcgctctctcttgccaccaccggntgtgctcgcgtggaccggcgaggttgtgcagtgttttgtggtccactgcgtataattaaccggagaggagattgtttattgagggttgatttttgtagcggcgtcctcatacggtcattgtttcccccactccgcttcgaggagatggggggttttggcgtggtgggtccgcggagtggatagttccagagcctttgtagtatgggcagcagtcggctgcacgactcggggtttgcgcgcctctagcgtcctgt

SEQ ID NO: 66174 - protein, 53 aa, Zea mays
  misc_feature: Ceres CLONE 1538411-R
MSFTLSSIESLISIASEAVLARNTVLLPMITAATSSCTLARYCRTTLISLQPS

SEQ ID NO: 66175 - DNA, 666 bp, Zea mays
  misc_feature: Ceres CLONE 1538429
  misc_feature: Encodes the peptide sequence at SEQ ID NO. 66176
  misc_feature (330)..(330): n is a, c, t, g, unknown, or other
ggagctccccgcggtggcggccgctctagaactagtggatcccccgggctgcaggaattcgtctcacccctagaaaaaattaacaacactaacatagtgttatcccaggttgtaattttgttctgttgtggatggtgctaagtgccggtgggctcggccttcttctataagtatatcccatctttagtttctctattgaggattgtcacttaagctagcatgtatttgaaaacctataaatattttatacattttaaattgtaattttttttgaatcactttcttttgtaatcactccgataattgtataatgtaaacttattgtaatcnaaaaaaaaaaaaaaaaaaaaaaaaaccttaaaagagtcaaataaagagagaataaaagaacgaacatttaaaaaattcacgacagggaaaaaccgaaaaattacccaatttcgaaacccctcaaggacccaattcccccctaaggggagctaaataacccccccccctggccccttgtttttacccacctttagcgggaaaaacctggggtttcccaaatttaaccgctttaaaaaaaatccccctttcccaaagggggttaaaaacaaaaagccccccccaaatccccttcccaaaagtgtgcacccccctatgggcaaaagaaaattaaaacct

SEQ ID NO: 66176 - protein, 46 aa, Zea mays
  misc_feature: Ceres CLONE 1538429
GAPRGGGRSRTSGSPGLQEFVSPLEKINNTNIVLSQVVILFCCGWC

SEQ ID NO: 66177 - DNA, 687 bp, Zea mays
  misc_feature: Ceres CLONE 1538437
  misc_feature: Translation starting site: 112
gagctccccgcggtggcggccgctctagaactagtggatcccccgggctgcaggaattcgtctcacccctagaaaaactcctttcctttttgctccgatccgatccgatcaatgaccaagtcgaagggtggttcggtggacgcgcgcacgctggtggcgcacgtcctggcagcgggcgccgtcgtgctggtgctcctgtggtgcatccacttccgcggcggcctcgccctccgctcccaggacaagccgctcatcttcaacgtccaccccgtgctcatggtcctcggccccatcgtcctcggcggagaagccatcctcagctaccgctctctcccgctcgcccgcgacgccaggaagaaggtgcaccctgcgctgcacgcccgcggcctcgccgcgggcgtcctcggcgtctacgccgtcttcaagtccacgtcgagagcggcatcccaaactctactcgctgcactcctgggtgggatcgccggcatcaccctttacggccttcagtggaacgcccggtttcctcgcctactttttcccgggggccttcccccgccacagggccaaaacgtttgcgtggaaagccctttttcgggcccctggtttttggggccccccggggaacccgaaatttgggtttctccaaaaatctcccttttaggaggggccccccctttggctgtccca

SEQ ID NO: 66178 - DNA, 671 bp, Zea mays
  misc_feature: Ceres CLONE 1538438
  misc_feature: Encodes the peptide sequence at SEQ ID NO. 66179
  misc_feature (558)..(558): n is a, c, t, g, unknown, or other
cgcggtggcggccgctctagaactagtggatcccccgggctgcaggaattcgtctcacccctagaaaaatctccgtctcagaacgccccagccttccacctcgaactccgcggcgcccagcgccctcggtaaccgccccccgccccgccacagagacaggtcgacgagacagacaaaggccggccgccatgggagaggacaagaaggcgggcaacaaggacgccgccggcggcgacaagaagaaggacgccggcgccggggccgcgccgcagcccatcgtgctgaaggtcgacttgcactgcgccggctgcgccaacaaggtccgcaaggccatcaagcacgccccaggtgtggagtcggtgacgccggacatggcggcgggtaaggtggtcgtgaccggtccggcggacgcggtggagctcaaggagcgcatcgaggccagggcgaagaagcccgtgcagatcgtctccgccggcgccggccccacccagaaagagaaggacaaggagaaggagaaggataaagaagcggacggcggggaagaagaaggggaacaanaaaaagggcgccgctgcggccgaaaaaaaaaaagccaacaaggaaaaggggcggccgaaaaaaaaaaggccaccaggaaaaagggcggcggctaaaaaaaggcccacaaagga

SEQ ID NO: 66179 - protein, 154 aa, Zea mays
  misc_feature: Ceres CLONE 1538438
  misc_feature (30)..(92): Pfam Name: HMA Pfam Description: Heavy-metal-associated domain
  misc_feature (124)..(124): Xaa is any aa, unknown, or other
MGEDKKAGNKDAAGGDKKKDAGAGAAPQPIVLKVDLHCAGCANKVRKAIKHAPGVESVTPDMAAGKVVVTGPADAVELKERIEARAKKPVQIVSAGAGPTQKEKDKEKEKDKEADGGEEEGEQXKGRRCGRKKKSQQGKGAAEKKKATRKKGGG

SEQ ID NO: 66180 - DNA, 655 bp, Zea mays
  misc_feature: Ceres CLONE 1538441
  misc_feature: Encodes the peptide sequence at SEQ ID NO. 66181
ggagctcaccgcggtggcggccgctctagaactagtggatcccccgggctgcaggaattcgtctcacccctagaaaaattcttccaccgtttgcctcctcccgcgtcttaattgcggttgctgtccagccgtcgatctcccccctcttcctttcctcgttcgcttcttgcgattttcgtcactcgcatgtgaaacctctccctccctccctctcccgcctccgtgtttctgtcacaaggatcgggtggggcggaacctcgaaaccgcgtttcgtgtacagcctgcctcccttcgcacctccaggctccaaccatcttccctccgtttctttcaagaagcccttccttctcaatcgcttctccgccaaaaaatcctttcttgtctgggctccggctttgtcacgagccactgcatccaggaggaggcggcggcgttacctgccctgctccggtcgactggctcccgggagttcggagccgagatctcgccaggccccgatcggcggcggcgttgtgggaaacaggatgggggatctgcccgcgctgcgcctgtggctctgcttgctggcggcaatggcggcggccgcgtcggcgccgtggccggcggatgcgctggggatgaactggggcacgcaggccacgcacccgctgccgcc

SEQ ID NO: 66181 - protein, 43 aa, Zea mays
  misc_feature: Ceres CLONE 1538441
MGDLPALRLWLCLLAAMAAAASAPWPADALGMNWGTQATHPLP

SEQ ID NO: 66182 - DNA, 674 bp, Zea mays
  misc_feature: Ceres CLONE 1538442
  misc_feature: Encodes the peptide sequence at SEQ ID NO. 66183
ctggagctccccgcggtggcggccgctctagaactagtggatcccccgggctgcaggaattcgtctcacccctagaaaaaaaccccaccttggatcgcggccgccgtgtgcgtgagcagcgacgtgccgacagccgaaggcccaaaccaattcgattcctcccccctgccggccgaatcaaatttctccgccgccgcccggagcaccgatccccgagagttccatggactcgccttccgcatcgaggtattagcaagcctcgccgcgtcgcgccgcactgccccgccccgacgcctgctgcgctggttttggaaggatccaagatgggtgtaatcagcacagtgcttggtttctttgggtttggatttgggttatctgctggcattgtaattggttacttcttcttcatctacgtacaaccaactgatgtcaaggatgtcaaggtccggccgcttgtagaatatgattcaaaatccttggagggcatccttcccgaaattcctttgtgggtcaagaatcctgactatgatagaattgattggttgaataggttcttggagttgatgtggccttatcttaacaaggctatctgcagaactgcacaagatatcgcgaagccaattattgctgagaatactgctaagtataacatagacactgttgagtttgaaaca

SEQ ID NO: 66183 - protein, 117 aa, Zea mays
  misc_feature: Ceres CLONE 1538442
MGVISTVLGFFGFGFGLSAGIVIGYFFFIYVQPTDVKDVKVRPLVEYDSKSLEGILPEIPLWVKNPDYDRIDWLNRFLELMWPYLNKAICRTAQDIAKPIIAENTAKYNIDTVEFET

SEQ ID NO: 66184 - DNA, 651 bp, Zea mays
  misc_feature: Ceres CLONE 1538455
  misc_feature: Encodes the peptide sequence at SEQ ID NO. 66185
gccgctctagaactagtggatcccccgggctgcaggaattcgtctcacccctagaaaaagacagcatcactgccgtgtagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatgctcctgctccagaactccgtcgagttcgtgctcgccttcttcggcgcgtccttcctcggcgccgtcaccacagccgccaacccgttctgcacgccgcaggagatccacaagcaattcagcgcctccggcgcgaaggtcgtcgtcacccactccgcctacgtcgccaagctccggcacgacgccttcccgaggatcggcgtggacggcaatgccctcaccgtcctcaccatcgacggcg

SEQ ID NO: 66185 - protein, 174 aa, Zea mays
  misc_feature: Ceres CLONE 1538455
  misc_feature: SWISSPROT Homolog: EC 6.2.1.12 4-coumarate--CoA ligase
MITVAAPEAQPQVAAAAVAAPEETVFRSKLPDIDIPTHLPLHDYCFSRAAEAAGAPCLIAAATGRTYTYAETRLLCRKAAACLHGLGVAQGDRVMLLLQNSVEFVLAFFGASFLGAVTTAANPFCTPQEIHKQFSASGAKVVVTHSAYVAKLRHDAFPRIGVDGNALTVLTIDG

SEQ ID NO: 66186 - DNA, 663 bp, Zea mays
  misc_feature: Ceres CLONE 1538456
  misc_feature: Encodes the peptide sequence at SEQ ID NO. 66187
  misc_feature (508)..(508): n is a, c, t, g, unknown, or other
  misc_feature (512)..(512): n is a, c, t, g, unknown, or other
  misc_feature (584)..(584): n is a, c, t, g, unknown, or other
tccccgcggtggcggccgctctagaactagtggatcccccgggctgcaggaattcgtctcacccctagaaaaaagttgagctgcgcacaccgacttcttttgcaaaggtacagcagcgcaggcgcggcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcggcccgggaaccgcgcgtccgtcgcccgcagcctgctgcttggagtgcgagtgcaggaaccaccgccccggcgccggggagaacacgctgctcccgggccgggtaccggcggctgggtgctctaaccncggncggcgtccgccgggggaaccccccggttcttgcgggagcttgcttgcgaaggacccccctgctcgtgttcgnccaaggccaagtacggcgtcccggacatgttctacgcccgcgcccagggcggaagcccccggacctgtttcagctgctg

SEQ ID NO: 66187 - protein, 166 aa, Zea mays
  misc_feature: Ceres CLONE 1538456
  misc_feature (115)..(115): Xaa is any aa, unknown, or other
  misc_feature (116)..(116): Xaa is any aa, unknown, or other
  misc_feature (140)..(140): Xaa is any aa, unknown, or other
MERSCYFPLRWESTGDQWWYASPIDWAAADGHYDIVRQLLHLDPNLLIKLTSLRRIRRLEALWDDDARFADAAREPRVRRPQPAAWSASAGTTAPAPGRTRCSRAGYRRLGALTXXGVRRGNPPVLAGACLRRTPLLVFXQGQVRRPGHVLRPRPGRKPPDLFQLL

SEQ ID NO: 66188 - DNA, 670 bp, Zea mays
  misc_feature: Ceres CLONE 1538459
  misc_feature: Encodes the peptide sequence at SEQ ID NO. 66189
  misc_feature (343)..(343): n is a, c, t, g, unknown, or other
  misc_feature (612)..(612): n is a, c, t, g, unknown, or other
  misc_feature (670)..(670): n is a, c, t, g, unknown, or other
cggtggcggccgctctagactagtggatcccccgggctgcaggaattcgtctcacccctagaaaaagccgtaccaatccccatcgccccagaccacagcgcgacagtgagtacagcagcagcagctgagagcgtgagagcgtgcgaagcaggagggaggacaagaagaagccgatggcggttgtgagcggcaccggcgggaggctgaacccctgggcggagcccttcgtgccttccggggcgcggtaccgcggcctgcggaccgtggaggcgacaccggagcaggaggtggaggacttctcccccgagtggtggcgcctggtgtccgcctccccggccttccncgaccgctggctgcgcgagtacggcgcgctctgcctactctacgccgaggacgacctggacgacgacgtcgacagcttcctccccgacgacttcttctcgcctccggccccgcgctactagagcgagcgggaggacgcctcgcgcaggagggcgggccgagggcttgatgtggcggcgtggggcatcaacaggtggtggagggcgcacagtggggcgcccgagaccactacgtactctgagaaggcgccgcgcagggtggccgcccccnccacggtgagcccccgccccatcagcagccgcgctgaaggaccagattcgttcatccn

SEQ ID NO: 66189 - protein, 96 aa, Zea mays
  misc_feature: Ceres CLONE 1538459
  misc_feature (57)..(57): Xaa is any aa, unknown, or other
MAVVSGTGGRLNPWAEPFVPSGARYRGLRTVEATPEQEVEDFSPEWWRLVSASPAFXDRWLREYGALCLLYAEDDLDDDVDSFLPDDFFSPPAPRY

SEQ ID NO: 66190 - DNA, 691 bp, Zea mays
  misc_feature: Ceres CLONE 1538463
  misc_feature (362)..(362): n is a, c, t, g, unknown, or other
ctccccgcggtggcggccgctctagaactagtggatcccccgggctgcaggaattcgtctcacccctagaaaaataaatgtgttcacggacctgtaatgcttgctccttgtcatatgaccttgctctaaacatttgtgatgaagctgtcaaggtaatatattttctctaaatatttagcctatattgcgataaaaaaaaaaaaaaaaagttcccttcgttgcgtcttgaaaggggagagagagagacaaaaaaaaaaaaaaaaccgagacgctcgaagtacccaatttccccctaatagtgagtcgtattacgcgcgctcactggccgtctttttcaacgtccctgactgggaaaaccctgnctttacccaacttaatcccctttgaacaaattccccttttccccacctcccctaataaccaaaaaggccccccccgattgccccttcccaaaatttgcccacccttaatggggaaaggaaaattgtaaccttttaattttttttaaaaccccggataaatttttgtttaaacccccccattttttttaaccaatggggccaaaatccccaaaaccccttttaaaattcaaaaaattcccccccaaaaaaggggaagactttttttccccttttgaaaaaaaggacccccctttaaaagaaatggggacccccccccgcctgggggaaaa

SEQ ID NO: 66191 - DNA, 601 bp, Zea mays
  misc_feature: Ceres CLONE 1538467
  misc_feature (222)..(222): n is a, c, t, g, unknown, or other
  misc_feature (223)..(223): n is a, c, t, g, unknown, or other
  misc_feature (249)..(249): n is a, c, t, g, unknown, or other
tccccgcggtggcggccgctctagaactagtggatcccccgggctgcaggaattcgtctcacccctagaaaaactcgtcgagagagtcgtccccccgcgtgctctccgcctgcggcctctgtatcccgcaccaaaaactaccccccaaaaaagaagaaaacccaaatcctcgagatctatcagtatcgagcgacttacccatcgattgctagggtttagttnncgaaaatctgaaaaaaattctggtcnaggggaggagcgatgtcgcgccagttgcggtgtggctaatgggggccgggggctgtccccccgtgggggttcccggaagtttttgggtggtttaaccccttccgacaccttgttttttttggggggacctggagggggcctctttggaatcccccttgtttaaaaacttttaccccccggggggagggggggttttttgcccctctttccggggggatcccccccccccccccccccggtaaacccccctttaaaaaaaaaaaaaacctttttttgtgctccggggaaaatttgaagggcgggaaattttttgtggtttttataaaaaaaaatttttcgggggggggggatt

SEQ ID NO: 66192 - DNA, 656 bp, Zea mays
  misc_feature: Ceres CLONE 1538473
  misc_feature: SWISSPROT Homolog: EC 3.6.3.44 Xenobiotic-transporting ATPase
  misc_feature: The sequence is a functional homolog of SEQ ID NO 3 in US patent 7041874
ctcccgcggtggcggcgctctagactagtggatcccccggctgcaggattcgtctcaccctagaaaaaaaaaaataatcttccggggattctctctttttctccctgctgggtaaacagttgcagtttgttggaggagtgggtctggaaagagcactgtttgtgggcttttgatagaaagggttctatgatcctaatgaaaggccaggtttttgctagacaatgtttgacataaagacactcccagctgagggtgggctttagagaaacagatttggtctggtaacccaagaccctgctctttttgcaacaacaatcctcgagaatatactgtatggaaagccagatgcaactattgcagaagttgaggctgcagcgactgcatccaatgcacatagtttcatatctcttcttccgaatggttacaacacaatggcaggtgagagaggcatccagctctctggtggtcagaaacaacgtatagcaatagctcgtgctatgctgaaaaacccaaagatcctgctcctggatgaggctaccagtgcattagatgcagactcggaaagcattgtgcaagaagctttagaccgtttgatggttgggaggacgactgtagttgttgcccaccgtctgtcgacgataagaaacgtgaacatg

SEQ ID NO: 66193 - DNA, 716 bp, Zea mays
  misc_feature: Ceres CLONE 1538476
  misc_feature: Translation starting site: 183
  misc_feature (393)..(393): n is a, c, t, g, unknown, or other
acccgcggtggcggccgctctagaactagtggatcccccgggctgcaggaattcgtctcacccctagaaaaaaagggcaccacacatccctatcctctctctctctcagtcaaggattcgtgctgctccgaccccaccgccacaagctcggcggaccggcgatctcgctcaccggcgggaacatgactacttctaggcgccttgctgaccggaagactgccttgttccagaagaacatcaccagcaggggttctgtgcccgacaccactgtcaagaatggaaaatgactaccctgttggccctctattgctcgggttcttcatcttcggcgtcattggatcatcgcctcttcatatttcccccccccccacggagggggggggggggtttganaacccgtcccacattctaatccccacctatacaaaaatacccttgtttttcctgccttccgggtaggcattgggtcccctcctaaaatgtctaaacccgaccaaatcctcccgcggatttccgtttaatttggggggacctggaaaacccgcatctgatactctcatgtctaaacccctttacccctaatatcacaccgtttaaaatgggttaaaaaaaaaaaaaaaaaataccaagtcccccctagtgcccccccccattgtcctttgacggggactcgctatttagccccccctcccctcttcccgctcgtccttatctcc

SEQ ID NO: 66194 - DNA, 673 bp, Zea mays
  misc_feature: Ceres CLONE 1538482
  misc_feature: Encodes the peptide sequence at SEQ ID NO. 66195
  misc_feature (354)..(354): n is a, c, t, g, unknown, or other
  misc_feature (360)..(360): n is a, c, t, g, unknown, or other
  misc_feature (399)..(399): n is a, c, t, g, unknown, or other
  misc_feature (490)..(490): n is a, c, t, g, unknown, or other
  misc_feature (556)..(556): n is a, c, t, g, unknown, or other
ctcaccgcggtggcggccgctctagactagtggatcccccgggctgcaggaattcgtctcacccctagaaaaatccgcacccgctgtttcgtgcaccgcacttcacaccccaccaaccttctcccccactgaaaaactatctaccccaccccaaaccacccctacccgccgacgagcgcgatcgattgattcgtttcgcgccgggcggcggcggagggagcccaccagatccggctaccgccgcggctacgatgaagtcgctgctgccgcggagcgagctgcggcgctcgtcggcggcggccgtgcggtcgtcggccggcggcgccgcggggggagacggtgctgtggccgacngcggcngggctggggcgcgagcgcccgcctcctccaccttctggntcctgctgcacgcgctctgctgcctcatctcgctcttcctcggcttccgcttctcgcggctcctcttcttcatgctcttctccacaacggngctctaccacttcacattcctcttctcttcgggcgcggtcctgggcgccaccacccggaagaccanaacacccaccacactaccaggacaccaaaacctttaggctcttcttttggggccgcaaacattcccccttcgggccggttaaacccacgggccttgaaggcggcacggagccaaaaa

SEQ ID NO: 66195 - protein, 113 aa, Zea mays
  misc_feature: Ceres CLONE 1538482
  misc_feature (35)..(35): Xaa is any aa, unknown, or other
  misc_feature (37)..(37): Xaa is any aa, unknown, or other
  misc_feature (50)..(50): Xaa is any aa, unknown, or other
  misc_feature (80)..(80): Xaa is any aa, unknown, or other
  misc_feature (102)..(102): Xaa is any aa, unknown, or other
MKSLLPRSELRRSSAAAVRSSAGGAAGGDGAVADXGXAGARAPASSTFWXLLHALCCLISLFLGFRFSRLLFFMLFSTTXLYHFTFLFSSGAVLGATTRKTXTPTTLPGHQNL

SEQ ID NO: 66196 - DNA, 699 bp, Zea mays
  misc_feature: Ceres CLONE 1538483
  misc_feature: Encodes the peptide sequence at SEQ ID NO. 66197
  misc_feature (477)..(477): n is a, c, t, g, unknown, or other
ccccgcggtggcggccgctctagaactagtggatcccccgggctgcaggaattcgtctcacccctagaaaaaatcctacctcctaccctctccacctctcctcccacccctcccctccccttccgtgtcctcccctcgcctggggatcgattcaggctacgcgtggggttgcgtccattgatgcgagggaggcaatggcggtgtcctcgccttcttctgctccggagaagaagaggaagtggctgctcagcaacaggaaggtgaccgataagtacctgcgtgaggcgaggaagattcttgcggcggcgccagagtgtggcggcggtgacgcggtggcggcgctcggcctggtcgacgcggcgctggagctgtcgccgcggatggaggccgccctggagctgcgggcgcgcgcgctcctcgcgctgcgtcgctacagggagggtcgcgagatgctccgcgaatacatccccagctgcngcaagtcgtgctctggcgaggacacctcctcgtcctcgtcggcgtccctcttggtcactggcttcggtgatcttcggacggatctcccgggggcaagtttctttttgcccgaacgccaacggttccgagaaaccggaaaactgaaggcccggccccgttccgttcctttccgttggttgggaattttccaaattaaagggccccggtcctttgcgggccttc

SEQ ID NO: 66197 - protein, 168 aa, Zea mays
  misc_feature: Ceres CLONE 1538483
  misc_feature (95)..(95): Xaa is any aa, unknown, or other
MAVSSPSSAPEKKRKWLLSNRKVTDKYLREARKILAAAPECGGGDAVAALGLVDAALELSPRMEAALELRARALLALRRYREGREMLREYIPSCXKSCSGEDTSSSSSASLLVTGFGDLRTDLPGASFFLPERQRFRETGKLKARPRSVPFRWLGIFQIKGPRSFAGL

SEQ ID NO: 66198 - DNA, 678 bp, Zea mays
  misc_feature: Ceres CLONE 1538484
  misc_feature: Encodes the peptide sequence at SEQ ID NO. 66199
ctccccgcggtggcggccgctctagaactagtggatcccccgggctgcaggaattcgtctcacccctagaaaaaatctttgcgcttggggcaatgacgcagcttatgaggtcataccgaggcgcgtcaattgctggttgaaaactatttccaaaccccctctttggcccactgggccactgagaatttctggaagggctccttttcctcggataaggtaaagccctacccctttcgctcctctcgccgctttgggttggggtttaagcgcgtgtaagggaggccggaggcgacgacgacggcgccggcgtcggagaagaagaagcagacaactctcgtatatgtcttcttgccccttttccgatctggtggtcgtagcgctcatcatcgccgtcgtcgccgtcatcctccgcgccctcgcttgctctggccgatctatgcgcaaggggctcaacggctggaacaaatcctcgtcgatgctcagggacgggttcggggtgaagtattccggattcctccacataaggccgtgcggcttctgtagaggagattgacggattcggccgatttgcgctcgtctccgtcatttttttttgcacccagagtttcttgtttttctttagaagttttccccccatagttttggcaattttggcgacaagttttggagttctccccg

SEQ ID NO: 66199 - protein, 70 aa, Zea mays
  misc_feature: Ceres CLONE 1538484
MSSCPFSDLVVVALIIAVVAVILRALACSGRSMRKGLNGWNKSSSMLRDGFGVKYSGFLHIRPCGFCRGD

SEQ ID NO: 66200 - DNA, 680 bp, Zea mays
  misc_feature: Ceres CLONE 1538485
  misc_feature: Encodes the peptide sequence at SEQ ID NO. 66201
ctccccgcggtggcggccgctctagaactagtggatcccccgggctgcaggaattcgtctcacccctagaaaaaatggccgcgctccttcagtcgtctttcctcttccctcacgccaccttccccaaccccaagccccaccacctcgccgccgccgccacgagacccgagtcacccaacgtggcccccaatcccgccagcgccccctccgccgcctcattgcccgcgaggacctcgccggtgccgcgcgcctcgtcgagctctccgcctcccgcgacggggaggcccccgacgtctacctctgcaccaagctcatccggaacctctgccgccggggccgcacctccgacgccgcccgcgtgctccgcgccgccgagggctccggctcctccgtcgacgtcttcgcctacaacaccctcgtagcggggtactgccgctacggccacctcgacgccgcgcgcaggctcatcggctccatgcccgtcgcgcctgacgcctacacatacacgccactgatccgcgtgctctgcgactgcggcagggtacgcgacgcgctcagcctgctcgacgatatgctctgcctgcgggtgcagccaaacgtcgtcacctacactgtgctcctggacgccatgtccaagacagtgggttcaagcagggcatggcagttctcgacgaaatggg

SEQ ID NO: 66201 - protein, 68 aa, Zea mays
  misc_feature: Ceres CLONE 1538485
  misc_feature (8)..(42): Pfam Name: PPR Pfam Description: PPR repeat
MPVAPDAYTYTPLIRVLCDCGRVRDALSLLDDMLCLRVQPNVVTYTVLLDAMSKTVGSSRAWQFSTKW

SEQ ID NO: 66202 - DNA, 567 bp, Zea mays
  misc_feature: Ceres CLONE 1538488
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (188)..(188): n is a, c, t, g, unknown, or other
  misc_feature (225)..(225): n is a, c, t, g, unknown, or other
  misc_feature (362)..(362): n is a, c, t, g, unknown, or other
ccccnnnnnnnnnnnnnnnggnnnnnnnaaccnnnnnnnaattnnnnnnnnnnnnnnnnnnnnnnnnnnnnnnnnnnnnnnnnnnnnnaaaaactggagctcaccgcggtggcggccgctctagaactagtggatcccccgggctgcaggaattcgtctcacccctagaaaaaatcgatggagctgtngagctgagctgagctgagctcaccaccaccacacacngggagatagctatagctagcatagcaagccagccagtcagcgacttagcagcagctagctagccatgctgccgtccttcgtgtcgccgacggcgagcgcccgcgcctcggtgacgcctccgcccgcgccgataccangcagctacgggcccaccgggtgctggggcccgctaccgggacccggctccgactacttcttgggttcagaagcccggaacgagtttccttcccggaaaaccccgcgggggggcacccccgcaagcccaccggtggttccccaacccaaaaattccccgccccacctttccccctttttttttgggggggcggggggacaccccct

SEQ ID NO: 66203 - DNA, 685 bp, Zea mays
  misc_feature: Ceres CLONE 1538493
  misc_feature: Encodes the peptide sequence at SEQ ID NO. 66204
  misc_feature (394)..(394): n is a, c, t, g, unknown, or other
  misc_feature (442)..(442): n is a, c, t, g, unknown, or other
  misc_feature (514)..(514): n is a, c, t, g, unknown, or other
tcaccgcggtggcggccgctctagaactagtggatcccccgggctgcaggaattcgtctcacccctagaaaaaggccccctcttctaacaagtcgtcgcctcggcccggcttcgcccccctcggcgcgacgacctctcccccaggagagcctaccccctccctcattccccgcgcgacgaggccgcttaatggcgggtcgcggccggcctcggccgggctcgcaccaggctctcgtcgtcgccgccgtcatcctactcctggccgccgcgtccggggccggcgctggatcccccgatcggcccgcgccggggccgccgctgttcctcccgctcacgcgctcgtaccccaacgccagccggctcgccgcctcgctgcggcgcggcctcggcgacngggtcccaccccacgcgcgcatgcgcctccacgacgatctcctcaccnacgggtactacacgacgaggctgtacatcgggacgcccccgcaggagttcgcgctgatccgtgactccgggnagccacgtcactacgtgccctgctcctcctgcgagcagtgtggcacccaccaggatccccgaattccaccctgacttctcccgttcattttccccagtaaaatgcaacgtttattgtacttgtgaaaggtgacaaaaaccggtgcctttttaaaggccattttcttaaatg

SEQ ID NO: 66204 - protein, 132 aa, Zea mays
  misc_feature: Ceres CLONE 1538493
  misc_feature (69)..(69): Xaa is any aa, unknown, or other
  misc_feature (85)..(85): Xaa is any aa, unknown, or other
  misc_feature (109)..(109): Xaa is any aa, unknown, or other
MAGRGRPRPGSHQALVVAAVILLLAAASGAGAGSPDRPAPGPPLFLPLTRSYPNASRLAASLRRGLGDXVPPHARMRLHDDLLTXGYYTTRLYIGTPPQEFALIRDSGXPRHYVPCSSCEQCGTHQDPRIPP

SEQ ID NO: 66205 - DNA, 661 bp, Zea mays
  misc_feature: Ceres CLONE 1538495
  misc_feature: Encodes the peptide sequence at SEQ ID NO. 66206
ctccccgcggtggcggccgctctagaactagtggatcccccgggctgcaggaattcgtctcacccctagaaaaagtcttctcttcccacttcccagtccccaatcgcgttctcttcctggccgacatggcggccgccaccggctacagcgacgccccaaccgacgagcaactgctggcgtactctgagctgcccatacatggccgcgacatggcggaggtgttcgccgtgcgcatcccggccatcgccggaggagacccgccgccccgtggcatcatctctttctacggcggccactgctgcagcgatttcatttacagctggaactcactggaagaggaagaagacacctcgaagcaaacctgcgacagccagggtaacctcgtgctaactgggccatcaatggccacctcggcagaaagtccaattgccttcaccttctacctccatgatggcagcccgcaagccggagaagccgctgaggacgacgaggacatcgggaggataatctgcgactgcatcggcgacgacttctccaactacaacagggccatagtcgagactgtccaaatgggctatggcctcgctgaagtgatctatgccgtgctgaacaacggcgtccaaggccgggtcgctgtcaaacttgctcgcctgccggtgtc

SEQ ID NO: 66206 - protein, 178 aa, Zea mays
  misc_feature: Ceres CLONE 1538495
  misc_feature: SWISSPROT Homolog: EC 3.2.2.22 rRNA N-glycosylase
MAAATGYSDAPTDEQLLAYSELPIHGRDMAEVFAVRIPAIAGGDPPPRGIISFYGGHCCSDFIYSWNSLEEEEDTSKQTCDSQGNLVLTGPSMATSAESPIAFTFYLHDGSPQAGEAAEDDEDIGRIICDCIGDDFSNYNRAIVETVQMGYGLAEVIYAVLNNGVQGRVAVKLARLPV

SEQ ID NO: 66207 - DNA, 656 bp, Zea mays
  misc_feature: Ceres CLONE 1538498
  misc_feature (656)..(656): n is a, c, t, g, unknown, or other
ctggagctccccgcggtggcggccgctctagaactagtggatcccccgggctgcaggaattcgtctcacccctagaaaaaatcttccccacctctctccgcactgcaggagcttgcgggcgtggcggcggccgtgaccggcgctggagatcttggacgcgcgcgacatcctggtctccgctctgtgcctctggtctccgaaggcgccgccaccctatttttttttaaaaaaaatcctaaggtgagatcgagctgctctttgctttgctttgcttagctgcttgcgcggaatctggccttgcttgctttcacagttccacttcgttgcgtgtttcggtttattgattgattgattgatagatttcaatcgaagcttgcagattaggtttcttttctagctagatcctgcagcatctacgagtccaggccacggtcgactggttctccttcgatctagtcttcctttcctttctttctttctgaatgcgcatggtaccacatccagttttctctgtctttgccaaagaaacacccccccctcccccggttattggtaatacaggcagaggtcgtcttgagaagacggatagctatggctggtttgtttttgctgcacatgtttattaccgagtgtccattgctctgacgaactgaagn

SEQ ID NO: 66208 - DNA, 704 bp, Zea mays
  misc_feature: Ceres CLONE 1538499
  misc_feature: Encodes the peptide sequence at SEQ ID NO. 66209
  misc_feature (416)..(416): n is a, c, t, g, unknown, or other
caccgcggtggcggccgctctagactagtggatcccccgggctgcaggaattcgtctcacccctagaaaagttcgaccacttcccatccccggacgcccactccagtactccactacgcctctgatcccgtgccgagtgccgccatttcccgtgccccccaccgccgccccgccgccgactcgatccccatcacgcgccgcccatggcgccccacctactcaccccaccagccctcaccgttacgggcgccgccgccccaggtcgcctctgcagcgccggatcggcggacccgcggacgcccaggaccacgcgcgccgggggccactttctgctcctcccccagcatagggcggcgggagctgaggaggaggaagggcttgagcgttttttcccccggggtaaccaattaaacccnggtggggaccgctgggggcgatgcgtgttcaaacgagtacatgggaggctgtggaaccgggcccttcggagtccgcgttccccctttgggggttaacggacaccctttttccgtttattttcccttaaaaagggggggcaaaccgccccagaagggccccggatcccttcatgggtcgagcttcaccccccttttttaaggggaaggggcgcccgaagggccaaaagggccttcctccccctattcggaggggccctcagggggtgccacggggaaaaacttgtccgc

SEQ ID NO: 66209 - protein, 102 aa, Zea mays
  misc_feature: Ceres CLONE 1538499
MAPHLLTPPALTVTGAAAPGRLCSAGSADPRTPRTTRAGGHFLLLPQHRAAGAEEEEGLERFFPRGNQLNPGGDRWGRCVFKRVHGRLWNRALRSPRSPFGG

SEQ ID NO: 66210 - DNA, 685 bp, Zea mays
  misc_feature: Ceres CLONE 1538500
  misc_feature: Translation starting site: 232
  misc_feature: SWISSPROT Homolog: EC 4.3.1.5 Phenylalanine ammonia-lyase
  misc_feature (376)..(376): n is a, c, t, g, unknown, or other
  misc_feature (472)..(472): n is a, c, t, g, unknown, or other
  misc_feature (479)..(479): n is a, c, t, g, unknown, or other
  misc_feature (596)..(596): n is a, c, t, g, unknown, or other
ctcaccgcggtggcggccgctctagaactagtggatcccccgggctgcaggaattcgtctcacccctagaaaaaaggaagagcctagctagctttccccagctcttcttccacagcactgtctgtctcgcaattagctgtactaatccgctagtggcactgctgctactctcgtgtactcccagctatctcctctctatactcttgtacgtacgcacgtgtcgcaaccgcaatggagtgcgagaccgggcttgtccgctccctgaacggcgagggcctgtgcatgtcggcggcggcggcggcgccgcgcgccgacgccctgaactggggcaaggccgcggaggacctgtccgggagccacctggacgaggtgaagncgatggtggtggagttccgcgagccgctggtgaggatccaggggcgcagcctgagcatccggcaggtggccgccgtggccgcgggcgccggcggcnaagcccncgtgaagcttgacgagtccgcccgcgggcgcgtcagggccagcagcgactgggtcatgaccagcatgatgaacgggcaccgacagctacggggtcaccaccggtttcggggccaagntccaaaggaggatccaaggagggcgggcccttcccaagggagcctaatcaaatccccaatggttggggcgttcgggacccgggcccaaa

SEQ ID NO: 66211 - DNA, 675 bp, Zea mays
  misc_feature: Ceres CLONE 1538501
  misc_feature: Encodes the peptide sequence at SEQ ID NO. 66212
  misc_feature (368)..(368): n is a, c, t, g, unknown, or other
  misc_feature (378)..(378): n is a, c, t, g, unknown, or other
  misc_feature (421)..(421): n is a, c, t, g, unknown, or other
  misc_feature (439)..(439): n is a, c, t, g, unknown, or other
ctccccgcggtggcggccgctctagaactagtggatcccccgggctgcaggaattcgtctcacccctagaaaaagctccatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccnagcgggtggnacgcgtcgcgatggtctccaacgcggagacggagacggagaanggagcaggagaggcggcngcccgcagcgaggagctgcccgtcatgccctgggccacctccgtcggcagcggttacaccctttttgaggatccacaccacaacaaggggcttgctttcccaggaggagaaaagggatgacacctactgccttggactgctcccctccgggagtcttttctcaggaactcccaattaagaaagttctgaaaccccctgggggaaaaccaaaacccttttggagggggtaataacct

SEQ ID NO: 66212 - protein, 118 aa, Zea mays
  misc_feature: Ceres CLONE 1538501
  misc_feature: SWISSPROT Homolog: EC 1.1.1.40 Malate dehydrogenase (oxaloacetate-decarboxylating) (NADP(+))
  misc_feature (56)..(56): Xaa is any aa, unknown, or other
  misc_feature (59)..(59): Xaa is any aa, unknown, or other
  misc_feature (73)..(73): Xaa is any aa, unknown, or other
MLSTRTAAVAASASPASPWKLGGRSEGGASCDGCRTYRNTLRRRAAPAKVRALPPXRVXRVAMVSNAETETEXGAGEAAARSEELPVMPWATSVGSGYTLFEDPHHNKGLAFPGGEKG

SEQ ID NO: 66213 - DNA, 669 bp, Zea mays
  misc_feature: Ceres CLONE 1538504
  misc_feature: Encodes the peptide sequence at SEQ ID NO. 66214
  misc_feature (512)..(512): n is a, c, t, g, unknown, or other
tggagctcaccgcggtggcggccgctctagaatagtggatcccccgggctgcaggaattcgtctcacccctagaaaaagacgtagactgatgggcgcgcacagagtagggtcgcagcctctcactcacaggtcggcacagggaaccgcattttcacttcaccactagcatcgcctcctcgatctctcatgcccctcccgtgggatgctcgccgcgaaccggggccgactagcaatcacattcgacatgcacgccgggcggagctcgctgctgcagcaatcggccacgacgccgcacgagctgaccccataggaggagctgcgtcgatcctgccactgtgcgtggcagaggcccagctcgcatggctagttctgactacagtaacgctgtctaatctgccgctggatccaccgtatgaccggaacgacgggagcggccccaccacatcccgcgctggacgataaagggcgaagacctgctcatgtcctcggcgtcgtacgggggcgctgcgtnggagaagaagtgcggcggagcgccaggccgagccgggacgggggcatctccgtgctggtcaccggcgccgcgggcttcgtgggcacgcactgctcgctcgcgctgagggcccgcggcgactgcgtcctgggcctcgacaacttcaactcctactacg

SEQ ID NO: 66214 - protein, 85 aa, Zea mays
  misc_feature: Ceres CLONE 1538504
  misc_feature: SWISSPROT Homolog: EC 5.1.3.6 UDP-glucuronate 4-epimerase
MTGTTGAAPPHPALDDKGRRPAHVLGVVRGRCVGEEVRRSARPSRDGGISVLVTGAAGFVGTHCSLALRARGDCVLGLDNFNSYY

SEQ ID NO: 66215 - DNA, 625 bp, Zea mays
  misc_feature: Ceres CLONE 1538505
  misc_feature (292)..(292): n is a, c, t, g, unknown, or other
  misc_feature (298)..(298): n is a, c, t, g, unknown, or other
ctggagctccaccgcggtggcggccgctctagaactagtggatcccccgggctgcaggaattcgtctcacccctagaaaaaaacggggatctgagcatccgaccggccgcttgctagggtttcgtccgtccgcctccctgccacagcaccactccgcatctccagccctagcctcgctcagcccgggatcccgcgggggccatggcggctgaagcgccaccgtcggcgtcggcgtcctcctcctcggctccgcggccgcctaccgcggccgcctccgcccccggcggcggcngcggcngggcgccccgcgtccgcggagtcgtacctcgggagcctcatcagcctgacatcgaagagcgagatcaggtacgaggggcgtcctctacgacatcaacaccgagggagtcagcctccgcctgggccatgggcggtccttttgaacccaaaggtcgaaagaaaaaacgaatgccaaatccctggcaccgaaaaaaatttccaaaataaatccccctttccggggaaaacgaaatccaggggattttccaagttaaaattttttccccccccaaggcccccccccaccaaaaaagaggttttcctctggaaaaaaaaaccccccccaaaa

SEQ ID NO: 66216 - DNA, 655 bp, Zea mays
  misc_feature: Ceres CLONE 1538508
  misc_feature: Encodes the peptide sequence at SEQ ID NO. 66217
ggagctccccgcggtggcggccgctctagaactagtggatcccccgggctgcaggaattcgtctcacccctagaaaaaaggagtacacagtcctccttataattggagttgcacaagccgctcagcaaccttcttcttcatcttctccagtcctccctcccgccccgtccatcgacacagcagcttgcttgtcaccaagctagccaagcaggaggagtaagagtacagccagagagagagagagagagagcaccaccctgattccacccaccgctgtcccttgcttatttacaggcgttcgtgatcaccaacagctactcgtcagctagagagagtgcaacgggccgggcagagctagagagagagagagagaaagcggccttctttttctgtgttcaccaagcaacaaccccagtccaagctctccgtgttggccgatcgtttccggcgaacagagcaagcaactcacagccccggaggcgactgactgactggcgcaactgtgttgctcgatccatcgaagcagacgcaggcggcggattcgcggaggagagatgatgagggagcagagcctcctggaggcgacgtgcggcgacctcttcgaccacatcgacgacctgctcgacttccccaaggaggactcggccgccgacgt

SEQ ID NO: 66217 - protein, 33 aa, Zea mays
  misc_feature: Ceres CLONE 1538508
MMREQSLLEATCGDLFDHIDDLLDFPKEDSAAD

SEQ ID NO: 66218 - DNA, 663 bp, Zea mays
  misc_feature: Ceres CLONE 1538509
  misc_feature: Encodes the peptide sequence at SEQ ID NO. 66219
  misc_feature (663)..(663): n is a, c, t, g, unknown, or other
cgcggtggcggccgctctagaactagtggatcccccgggctgcaggaattcgtctcacccctagaaaaaaaattgaagagccctaagaagcaagacctagagagaactgctgcatctgttctttttgactgggagacagaaatatatgtagcaagggcacctggacgtttggacgtcatgggtggcattgctgattattcagggagtcttgttttgcagatgcctcttcgggaagcttgccatgttgctgttcagagaaaccatcccagcaagcagaagctttggaaacatacaaaagcaagacagcttgttaacggaggcttggtacctgtgatacaaattgtatcatttggttctgatttgagtaaccgtgcaccaacttttgatatggacccctcagattttatggatgatggtaaaccaatatcctatgagaaagccaggagcttttctgtcaggatccatcccaaaaatgggcttgctatgttcctggacaaattctgttttgatgactgaaattggggccccagtcccctgaacgctttagcattctggtttcctcttccccggcccaaaggaaaagagggttcccccttcccgcatcaggggggggtgccaaaaatggtcgctataccccccccccccatggtttaaaacaacaan

SEQ ID NO: 66219 - protein, 171 aa, Zea mays
  misc_feature: Ceres CLONE 1538509
RGGGRSRTSGSPGLQEFVSPLEKKLKSPKKQDLERTAASVLFDWETEIYVARAPGRLDVMGGIADYSGSLVLQMPLREACHVAVQRNHPSKQKLWKHTKARQLVNGGLVPVIQIVSFGSDLSNRAPTFDMDPSDFMDDGKPISYEKARSFSVRIHPKNGLAMFLDKFCFDD

SEQ ID NO: 66220 - DNA, 668 bp, Zea mays
  misc_feature: Ceres CLONE 1538510
  misc_feature: Encodes the peptide sequence at SEQ ID NO. 66221
agctccccgcggtggcggccgctctagaactagtggatcccccgggctgcaggaattcgtctcacccctagaaaaaaccacgaaattttaacttgttgcttctctccctcttctgttctgtctcgtccccttcacgaatcacgacagtattgaagcaattcctgattgctgatcctccacaatttctcccgtggattggagcgatctgaattggagccgtttactgctgacatggcgggaactgatcgcctctaccctgaaattgggacgtatgacctggagcccccgcaggtcccagcctccgccgggggcagcggcgaggaggaggccggggtttgcgacgcactggtgatgtgggacgacgaatccgacgcgtgtccctcccatgaagcggcccccatcatatttgagaagggcactagggatcctcctcctaaagttttcaaggaagaaaggcttgatgttgtccattattcagagttcagcgatgagatggcgactgagaaggaattcggagaaaacaactatgacagtttcccttcttgtgaacaaacaggcatcatatgggtgcctccctctgttccacctatgccaaaacatgatcacgatgagtggcaaaagggctttggttacaatagtccgtgcttcccagaggaagaatataagtg

SEQ ID NO: 66221 - protein, 145 aa, Zea mays
  misc_feature: Ceres CLONE 1538510
MAGTDRLYPEIGTYDLEPPQVPASAGGSGEEEAGVCDALVMWDDESDACPSHEAAPIIFEKGTRDPPPKVFKEERLDVVHYSEFSDEMATEKEFGENNYDSFPSCEQTGIIWVPPSVPPMPKHDHDEWQKGFGYNSPCFPEEEYK

SEQ ID NO: 66222 - DNA, 639 bp, Zea mays
  misc_feature: Ceres CLONE 1538511
  misc_feature: Encodes the peptide sequence at SEQ ID NO. 66223
  misc_feature (295)..(295): n is a, c, t, g, unknown, or other
  misc_feature (343)..(343): n is a, c, t, g, unknown, or other
  misc_feature (383)..(383): n is a, c, t, g, unknown, or other
  misc_feature (499)..(499): n is a, c, t, g, unknown, or other
ccgcggtggcggccgctctagaactagtggatcccccgggctgcaggaattcgtctcacccctagaaaaaacgctactagtcagtactcagtacagtagtcacccccaaagctccgcctacgcacctcttcccactcgcccggccgcggctatggcggccaccacgtccacaacgccggccgtctccttctccctcccctcgcccccgcaccgccaaggggccccgcgccgccgcgcgcctttcctcctccgtgccgcctccaccgcggcgcccccctcccccgacctctccatncagctcttcggcccgcgcgtccccccccccgcgttcaacaaaaggggncgccaccgcgccttggacgccccgtgggcggcttctttcncccctacccgcgcccaagaaccttgcagcccgaagcccgcccccttgggccccccccgcccggggcccccatttaaaagcccaaaattccccgccctccgcgttaagcggtccccnccccttaaaagggggctcccgggcaagcaaagggctttcccaaactggggttctttttccgggggaaaagtccccctggaaaaacccgaaaaaagggggagtctccccccccaaaaaaaaacccccccaaaaaagggggg

SEQ ID NO: 66223 - protein, 162 aa, Zea mays
  misc_feature: Ceres CLONE 1538511
  misc_feature (48)..(48): Xaa is any aa, unknown, or other
  misc_feature (78)..(78): Xaa is any aa, unknown, or other
MAATTSTTPAVSFSLPSPPHRQGAPRRRAPFLLRAASTAAPPSPDLSXQLFGPRVPPPAFNKRGRHRALDAPWAASFXPTRAQEPCSPKPAPLGPPRPGPPFKSPKFPALRVKRSPPLKRGLPGKQRAFPNWGSFSGGKVPLEKPEKRGSLPPQKKTPPKKG

SEQ ID NO: 66224 - DNA, 648 bp, Zea mays
  misc_feature: Ceres CLONE 1538522
  misc_feature: Encodes the peptide sequence at SEQ ID NO. 66225
agctcctcgaggtggcttgcagctctagaactagtggatcccccgggctgcaggaattcgtctcacccctagaaaaacttcttctcgctccctcactagcccgtccctgcacctataagcggcctctccttgcctgccccctctcgcttgctgcttgctgcctttcacgcggagtgaggcagccgacggggttgctaaaggtagaacgaagcttccgcagcacagcgtcgtcgtcgaggagataaggtccagacagaggtctctagccgtgcagcggtgctgtcgttggtggcggccggcgacttggagctgtcgaggtaagcaagctggtgtggcggcgattggagctgtcgactggagcgcgcccgatccaccagagaccgtgaagctggcggccggcaagtggtgggagcggccagatgacacgggcatgcccggaatggacccaggcgggggcggcagctcgcgctacttccaccagctgctgcggccgcagcagcagcagccctcgccgctgtcgcccaattcccacgtcaagatggagcaccacaggatgtctccagacaagagccccgtcgttgggagcaggccaccttttttgggaagcggggccggcggcgaccagccgtcctcgtcggccatggtcca

SEQ ID NO: 66225 - protein, 72 aa, Zea mays
  misc_feature: Ceres CLONE 1538522
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
MPGMDPGGGGSSRYFHQLLRPQQQQPSPLSPNSHVKMEHHRMSPDKSPVVGSRPPFLGSGAGGDQPSSSAMV

SEQ ID NO: 66226 - DNA, 487 bp, Zea mays
  misc_feature: Ceres CLONE 1538528
  misc_feature: Encodes the peptide sequence at SEQ ID NO. 66227
  misc_feature (291)..(291): n is a, c, t, g, unknown, or other
  misc_feature (292)..(292): n is a, c, t, g, unknown, or other
  misc_feature (308)..(308): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (335)..(335): n is a, c, t, g, unknown, or other
  misc_feature (459)..(459): n is a, c, t, g, unknown, or other
  misc_feature (460)..(460): n is a, c, t, g, unknown, or other
tggagctccccgcggtggcggccgctctagaactagtggatcccccgggctgcaggaattcgtctcacccctagaaaaaattgcatttgcaagcccttttacattgcagagcgccagagcctcgctcgctctcggaacagagctaggcagctaacagacgaagaagaagcaagccaagcagaaattgagagagagggcgaggacgtggcgacgacggcagccgcgatggcgacgacgacggacctggggttcgaggcgacggagctccgcctgggcctgcccgcggggagnngtgggagggaaccggncttttnnnncggggaaaagggaagganctctttcctccgccctcccgggcaggaaggggggcttttccccaagaaccccttccaccccctaaaactaaaaactgggggcccccccccccttttaaaaaaagggggggcggagaaaaaaaannaagtttttcccccccaccccccctttt

SEQ ID NO: 66227 - protein, 87 aa, Zea mays
  misc_feature: Ceres CLONE 1538528
  misc_feature (22)..(22): Xaa is any aa, unknown, or other
  misc_feature (23)..(23): Xaa is any aa, unknown, or other
  misc_feature (28)..(28): Xaa is any aa, unknown, or other
  misc_feature (30)..(30): Xaa is any aa, unknown, or other
  misc_feature (31)..(31): Xaa is any aa, unknown, or other
  misc_feature (37)..(37): Xaa is any aa, unknown, or other
  misc_feature (78)..(78): Xaa is any aa, unknown, or other
  misc_feature (79)..(79): Xaa is any aa, unknown, or other
MATTTDLGFEATELRLGLPAGXXGREPXFXXGEKGRXSFLRPPGQEGGLFPKNPFHPLKLKTGGPPPLLKKGGAEKKXXVFPPHPPF

SEQ ID NO: 66228 - DNA, 614 bp, Zea mays
  misc_feature: Ceres CLONE 1538530
  misc_feature: Encodes the peptide sequence at SEQ ID NO. 66229
  misc_feature (48)..(48): n is a, c, t, g, unknown, or other
tggagctccccgcggctggcagccgctctagaactagtggatcccccngggctgcaggaattcgtctcacccctagaaaaaaaaaaaaaaaaaaaaaaaaagggcttcatcaaacgtgactgcccacacttcagtcttgtccggttgtcccatcacagctaaagcaaaaccaccacccatcgagctgatcctgatcatcactcttttcccgacacaaagagggcaccaagaatcccctccatcgacgacgaaggcgatggcgccgctgccgcaggccgtccacctcctcctcgccttcgccctcgcgcttggctgcctggcgggcggcgccaccgcgacggtggtgacgacgtgcagggcggcggcggacagcgacgcgcgcgtggactacgcgttctgcgtcgccgagctgggcatgcaccgcgagagccccgacgccgacacctggggcctcgccaaggtggccgcgctgacgggcgtcaacaacgccgacaacgccgtgtacgacatcaaggccctgctcgccaacaagaggcccgacggcccgacgcgcgcggcgctggagaagtgcgggaggctgtacggctccgtcgggttcgcgttcgccgaggcgg

SEQ ID NO: 66229 - protein, 119 aa, Zea mays
  misc_feature: Ceres CLONE 1538530
MAPLPQAVHLLLAFALALGCLAGGATATVVTTCRAAADSDARVDYAFCVAELGMHRESPDADTWGLAKVAALTGVNNADNAVYDIKALLANKRPDGPTRAALEKCGRLYGSVGFAFAEA

SEQ ID NO: 66230 - DNA, 720 bp, Zea mays
  misc_feature: Ceres CLONE 1538545
  misc_feature: Encodes the peptide sequence at SEQ ID NO. 66231
ggagctccccgcggtggcggccgctctagaactagtggatcccccgggctgcaggaattcgtctcacccctagaaaaaaaaaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcagggtgtaccgccccaacccggcccgcgaccgggacctgcggccgcttccacgcccaaggattgggccacccccccctgcgcttcggtaacgccggaaaacccacccgggacccaaatccgccctgctcaagcgcttcaaacgttggggaaggaactgcccccggtcttcaaagggccccttacaggcgtttctgccaaaacctaatggcggggtgccctcccttccgggggggggccctttaaggtttaaacccccgggcccacgaacatcccaaatttaacattgggccggggggggccccttccccctccccccaaaataaactgccaaaggcttccccgggttttctttcatcacctttaactacaactgtgggcg

SEQ ID NO: 66231 - protein, 133 aa, Zea mays
  misc_feature: Ceres CLONE 1538545
MDPSSAGSGGNSLPSVGPDGQKRRVCYFYDPDVGNYYYGQGHPMKPHRIRMTHSLLARYGLLNQMQGVPPQPGPRPGPAAASTPKDWATPPCASVTPENPPGTQIRPAQALQTLGKELPPVFKGPLTGVSAKT

SEQ ID NO: 66232 - DNA, 655 bp, Zea mays
  misc_feature: Ceres CLONE 1538551
  misc_feature: Encodes the peptide sequence at SEQ ID NO. 66233
tctagaactagtggatcccccgggctgcaggaattcgtctcacccctagaaaaaacggggtactgctacctcaacgagcatatctgctttttttttggtaaaagaatttgtttttgcaaagctagctcctacgctgccgccgccatgcaccgcttcgccgccgacagggcgcgccgcgcggtggccgcgtccctgcgcggcgcagcttccagagcagcagcagcgccgtcgcgtcacgctccggcgcctcgccatccaacctccccagtcggggcggcggcgccggttgctgccgccgccatggcgagggccgccatgtccacggcggcgcggggcgtgccaacaccggtgtcgctcgacaccatcagccccaaggtgccgccagtgtcgctcgacaccatcaaccccaaggtcttgaaatggcaatttgcagtccggggagagattgtcacacgtgctcagaaattgccacaagaaccgcagagaaatccagaatcgcttccctttgaagaaatactctactgtaaacttgggaaatccccattccatgggccaacagcccgtaccctaccttcgagaagttcctatctttatggggaaaatccagcctctccgggaaaaaagtgaaacgcctcgcttttaacggggcaaaagc

SEQ ID NO: 66233 - protein, 160 aa, Zea mays
  misc_feature: Ceres CLONE 1538551
  misc_feature: SWISSPROT Homolog: EC 2.6.1.2 Alanine transaminase
MHRFAADRARRAVAASLRGAASRAAAAPSRHAPAPRHPTSPVGAAAPVAAAAMARAAMSTAARGVPTPVSLDTISPKVPPVSLDTINPKVLKWQFAVRGEIVTRAQKLPQEPQRNPESLPFEEILYCKLGKSPFHGPTARTLPSRSSYLYGENPASPGKK

SEQ ID NO: 66234 - DNA, 665 bp, Zea mays
  misc_feature: Ceres CLONE 1538556
  misc_feature: Encodes the peptide sequence at SEQ ID NO. 66235
ccgcggtggcggccgctctagaactagtggatcccccgggctgcaggaattcgtctcacccctagaaaaaaagacctaaatcagctgggggttcaggaaaacagatgaaacattatcgcccaaccaccagaaaggtgtatgaccctgatagtcatgatccaacatatacttcacaatacaaggcaaggaattcctattcaaataaccggtattatttcttaaggaagagaacagttgtacctacaacgtacacagatcctcaacagcatgtgaaagttcagacatttggtgccaggtttggtcgcaagatttacaaggctgtgacctatcgggttaagccagcgactgcaacaacagaggtgctagatacttttaagagtacagagcagatgagtggtaaagcagaatcacaggtagcaaactcacaagcacacaatcctacctcaacagatcacaaaggaagtgagtcacatggaactttagttgcaagtagtggaaatgctccatcatacaaagatgttgcactagcacggcctggaacaatgccaagactcaaatacagaaacctagagacgatgtaccacagaacccaccctcacttggtcagattattgcccaggaatgaaagattcttttggtgattccctccagtggaacagggaact

SEQ ID NO: 66235 - protein, 178 aa, Zea mays
  misc_feature: Ceres CLONE 1538556
MKHYRPTTRKVYDPDSHDPTYTSQYKARNSYSNNRYYFLRKRTVVPTTYTDPQQHVKVQTFGARFGRKIYKAVTYRVKPATATTEVLDTFKSTEQMSGKAESQVANSQAHNPTSTDHKGSESHGTLVASSGNAPSYKDVALARPGTMPRLKYRNLETMYHRTHPHLVRLLPRNERFFW

SEQ ID NO: 66236 - DNA, 826 bp, Zea mays
  misc_feature: Ceres CLONE 1538565
  misc_feature: Encodes the peptide sequence at SEQ ID NO. 66237
  misc_feature (299)..(299): n is a, c, t, g, unknown, or other
ctagaacttgtggatctcttgggctgcaggaattcgtctcacccctagaaaacactcaccgtccgtccgtccagggagccatggcagcagcagcagcagcctgcatctgtctgcagctctctctcccaagcaaccattcttcctctgcatgtcctccagcatacaggaagcgtgtcgcgctagccccagggagaggaaaccgtcttctctgcactgcatctggggcctctgcttctttctctggggggggtgacccttgtacccggagaaaggaatctcttgattcctaaatcttttancaacaaaaacgaacccctacctttagcggggcctcccaagggctttcccccccgccaccattttgggggggggggggggggggggggtctaacgccgcgattccccccggctgtctctaaccccccccctccccaccccgttgccggagtggtgggggcccccataggggtggaaacctgttcttgcggtgtccgtgtgtcgctcccctacgccctggggcgggtgcccccccacgtggtggcgcgccaatggttcttctcccatataccacgcgactttttgctcgtgtcacgccctgtggcttagtacatctggatccctctctgtcgccttctgcacccacactatggagccctatctgcctcctccctcggccgccttattcttaccccgccatagaggagttgtgtggtatggcagacactctaccggcaggacgggcgccaaccggccagccggcgcccgccatcgcctctgtgcttgcgctgccgcggctcttctctacgtggctcctttcgccttcacc

SEQ ID NO: 66237 - protein, 69 aa, Zea mays
  misc_feature: Ceres CLONE 1538565
MAAAAAACICLQLSLPSNHSSSACPPAYRKRVALAPGRGNRLLCTASGASASFSGGGDPCTRRKESLDS

SEQ ID NO: 66238 - DNA, 687 bp, Zea mays
  misc_feature: Ceres CLONE 1538569
  misc_feature (500)..(500): n is a, c, t, g, unknown, or other
  misc_feature (547)..(547): n is a, c, t, g, unknown, or other
  misc_feature (565)..(565): n is a, c, t, g, unknown, or other
  misc_feature (613)..(613): n is a, c, t, g, unknown, or other
  misc_feature (625)..(625): n is a, c, t, g, unknown, or other
ggagctccccgcggtggcggccgctctagaactagtggatcccccgggctgcaggaattcgtctcacccctagaaaaagaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctggggttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactngacgccctctagtcagaatccaagctagcaaccggggcctctgctcngcgcccgccccggaccangttagggcgttcgcgccccaagggcccgtgccaatgggctcagcccgncccgggcgacgncgccggggcgggccgcctccaagctcccttcccaacggggggcgtgcttaatcctttgcaaa

SEQ ID NO: 66239 - DNA, 702 bp, Zea mays
  misc_feature: Ceres CLONE 1538572
  misc_feature: Encodes the peptide sequence at SEQ ID NO. 66240
  misc_feature (180)..(180): n is a, c, t, g, unknown, or other
  misc_feature (269)..(269): n is a, c, t, g, unknown, or other
  misc_feature (340)..(340): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (405)..(405): n is a, c, t, g, unknown, or other
  misc_feature (406)..(406): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
atatctggagctccccgcggtggcggccgctctagactagtggatctcttgggctgcaggaattcgtctcacccctagaaaaaaataaggcttttctatcgaccgcagattctgctgtgcaattactcacagaagccaccaaaccagtttcaggatggaaggggattgagtatcgagcancatttcctctacataagcctcccggtgctaacttctatcctcctgacatggacaaagcggagtttgaactttggaagagtaaactgacngataaagaaccaaatgatgtccctggggttttgcgccgtcctaaaacgccctgacttttctgtcttctccnccttaacccaatccgatggttttttttccccccccacgggggggggagggggggnntnnttcccnncctcccannanccccaccctttcgcaaaaaaaaccaccccaaccttcctgggaagggcggccgcgcccccccttttccccaaaccctagaaaattttgctcagaaaacctgggggaaggctcttcctcttacaaaggtatccccgggggccccctttaacccctggcggcggaccccgcccccttcttttaacatccgcccagtggtcccccatattagcaccccatagcagataagccccttattatttattatcgccagcgccccgtggggcctctccggcggggggccgcgcg

SEQ ID NO: 66240 - protein, 31 aa, Zea mays
  misc_feature: Ceres CLONE 1538572
MDKAEFELWKSKLTDKEPNDVPGVLRRPKTP

SEQ ID NO: 66241 - DNA, 651 bp, Zea mays
  misc_feature: Ceres CLONE 1538579
  misc_feature: Encodes the peptide sequence at SEQ ID NO. 66242
ggcggccgctctagaactagtggatcccccgggctgcaggaattcgtctcacccctagaaaaagtacgccagcctcaatggattttttcaccgcatctgcatcctctcgccatggcgccgccgcccgcgtcgcctgctgactcggtccctgatccaaggccgaccgccagcgcgcccgtgcccatcaccgtgccgagcccgcgtgaccacgcgcaccaccaccacctggtagatcgtcgggacacgccgcggggccgcgcgtgggaaccggagcggaaccggcgcggagaggcgatggacggtgctgcagcggtcaagctggtacccggtgaggccgggtacgtcttagaagacgtgccgcacgtgtcggactacctccccgatctcccgacctactcaaatccattacaagataacccggcatactctgttgtgaagcagtactttgtaaacccagatgacaccgtctgccagaagattgttgttcacaaggatgggcccagagggaaccacttccgtcgtgctggacctcgccaaaaggtatattttgaaccagatgaggtccatgcatgcattgtcacttgtgggagaatgtgcccctggacttaatactgtgattagagaaaatgtatgtggcttatctgacctgtt

SEQ ID NO: 66242 - protein, 165 aa, Zea mays
  misc_feature: Ceres CLONE 1538579
MAPPPASPADSVPDPRPTASAPVPITVPSPRDHAHHHHLVDRRDTPRGRAWEPERNRRGEAMDGAAAVKLVPGEAGYVLEDVPHVSDYLPDLPTYSNPLQDNPAYSVVKQYFVNPDDTVCQKIVVHKDGPRGNHFRRAGPRQKVYFEPDEVHACIVTCGRMCPWT

SEQ ID NO: 66243 - DNA, 694 bp, Zea mays
  misc_feature: Ceres CLONE 1538589
  misc_feature: Encodes the peptide sequence at SEQ ID NO. 66244
  misc_feature (678)..(678): n is a, c, t, g, unknown, or other
  misc_feature (690)..(690): n is a, c, t, g, unknown, or other
ctcaccgcggtggcggccgctctagaactagtggatcccccgggctgcaggaattcgtctcacccctagaaaaagcactcccccacaccacactcgagagccatctcccagcacacgagcgcgatggcttccaccaccaccaccaccttcctcgccatcttgctagtcgtggcagcttcggcggcgccggcacggtcctgctcaccgcgcgacatccacgcgctgctgagcgtgaagcaggcgctgggcaacccggcgtcgctgtcgacgtggacgccggcgtcgcccaactgctgcgcgtgggaccacctccgatgcaacgacgccgggcgcgtgaacaacgtcttcatcgacggcgcggacgacgtgcgcggccagatcccgtcggcggtgggcgggctgacggagctcatgtcgctgacgctgttccggctgccggggctgacgggcgccatcccggcctgcctcacggcgctgtcgaacctccagttcctcaccatctcccacaccaacgtgtccggcgccatcccggagtcgctggcgcggctgcgcggcctcgactccgtggacctgtccagcaaccggctgacgggcggcatcccggcggcgttcgccgacctgcccagccctcggtcgctggacctccggcacaaccagctgacgggccccatccccgcngggctggtgcangggc

SEQ ID NO: 66244 - protein, 190 aa, Zea mays
  misc_feature: Ceres CLONE 1538589
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (189)..(189): Xaa is any aa, unknown, or other
MASTTTTTFLAILLVVAASAAPARSCSPRDIHALLSVKQALGNPASLSTWTPASPNCCAWDHLRCNDAGRVNNVFIDGADDVRGQIPSAVGGLTELMSLTLFRLPGLTGAIPACLTALSNLQFLTISHTNVSGAIPESLARLRGLDSVDLSSNRLTGGIPAAFADLPSPRSLDLRHNQLTGPIPAGLVXG

SEQ ID NO: 66245 - DNA, 485 bp, Zea mays
  misc_feature: Ceres CLONE 1538600
  misc_feature (175)..(175): n is a, c, t, g, unknown, or other
ccccgcgtggggcgctctgaatagtggatcccccgggctgcaggaattcgtctcacccctagaaaaaattccacgctgcctcggccggcacctacctcccccacttcgccgccgcgggtggagtcgggccgacaccgctagctcgctctgttaccccaaaagacaaaaaaaattnaagagagagtccagcagccgccggcagctccgggaaaccatgggggaacggggttaggtggccttccacggggaaaaaaaacaattattttccgggggggcaaaggttggggaaccttaaaccctgtgaaaggtttttttggggggaaaaccttcttttttttcccgcggggggaaaatttttttaaaaaaatttttttcctccccggggagaaaaatccccccccccccaagggggccccccccccgggggggggggccccccataattttaaaaaaaccggggggtccccccccgaaacaccctttaa

SEQ ID NO: 66246 - DNA, 709 bp, Zea mays
  misc_feature: Ceres CLONE 1538604
  misc_feature: Translation starting site: 210
  misc_feature: SWISSPROT Homolog: EC 3.2.1.51 Alpha-L-fucosidase
  misc_feature (633)..(633): n is a, c, t, g, unknown, or other
ctggagctccccgcggtggcggccgctctagaactagtggatcccccgggctgcaggaattcgtctcacccctagaaaaacccactactacatcagtccaccgccaccgcgcaccgcgagtccgcgacagacatccgcgccccggcctcactctcactccccaccgtgccgccacaagcggcgcgacgcagccacgcagggagagggaaatggccacggccgcgactgccacggcggggagtagagcagccgtgctgctgctgctctcgctggcgctggcgctggcgctgcgggcctccggcgccggcgcgggcggcgactgccacttcccggccgtgttcaacttcggcgactccaactcggacacgggcggcctgtcatcgctcttcggcgccgcaccgccgcccaacggcaggaccttcttcggcatgcccgccggccgctactgcgatggccgcctcgtcatcgacttcatcgctgaaagcctggggctgactcacctcagtgcgtacctgaactcgattgggagcaactcacacagggagccaattttgcaacagctgggtcgtcgatcagaagacagatacatcggctgtcctctctggcttcagccccatttccttggacgggcantccttgggagtttgaacaattccttcaaacgggccaactcggctacaaaacaaaggcgttcctccaaggaaacccc

SEQ ID NO: 66247 - DNA, 690 bp, Zea mays
  misc_feature: Ceres CLONE 1538611
  misc_feature: Encodes the peptide sequence at SEQ ID NO. 66248
  misc_feature (537)..(537): n is a, c, t, g, unknown, or other
  misc_feature (590)..(590): n is a, c, t, g, unknown, or other
aagctggagctccccgcggtggcggccgctctagaactagtggatcccccgggctgcaggaattcgtctcacccctagaaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttcctcgccgaggtctccgacaccaccgcggccggcgccggcgccggcagcggcatgcccaccggcggcgagttcaccatctcgctctacgaggtgctggcgcgggtgcacggccgcaacatcggtggcccgcaagattcgggcaacaatcatgggcccacccatcatgtgcacgctctccntcagcggggggctctttcccgcttcacaaggctggctccaaggtggtgcccgncattcgggcggaggggattcaaccccctcccggcccaaaggggaaaaagggccggaattaattgcctccctcttaggggcccttttgaaacgggcctttt

SEQ ID NO: 66248 - protein, 155 aa, Zea mays
  misc_feature: Ceres CLONE 1538611
  misc_feature (105)..(105): Xaa is any aa, unknown, or other
  misc_feature (123)..(123): Xaa is any aa, unknown, or other
MGRSLSPLLRQELDNLDKDADSRRAAMKALKSYARHLDSKSIPHFLAEVSDTTAAGAGAGSGMPTGGEFTISLYEVLARVHGRNIGGPQDSGNNHGPTHHVHALXQRGALSRFTRLAPRWCPXFGRRGFNPLPAQRGKRAGINCLPLRGPFETGL

SEQ ID NO: 66249 - DNA, 689 bp, Zea mays
  misc_feature: Ceres CLONE 1538612
  misc_feature: Encodes the peptide sequence at SEQ ID NO. 66250
  misc_feature (689)..(689): n is a, c, t, g, unknown, or other
tccccgcggtggcggccgctctagaactagtggatcccccgggctgcaggaattcgtctcacccctagaaaaaactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtcctctcaccagctcaccgatttcctcacctccgccacttccacctccaccttcctcactgacgactccgtgctgcgcaccggggaggactttcactgcggggggggcgggggccgccggcgaggtcgccgcctgggggtgtccaagtcgtccccgaggcctccccgttctcaagctctccaaattggccccaaggcccaaaaaaacggaccccaaaacggaccgggccgtccccgtcaacctggatgcggccccccggcaaagggtcccacggggggcggagaaaacccccctttgcggagggggtttcctggcccccctggaggtcccccttgggtttgctcgggaaaaaagggaattcctttccccccggctctgtggggggggggcattggggggtggtccccctcctccn

SEQ ID NO: 66250 - protein, 196 aa, Zea mays
  misc_feature: Ceres CLONE 1538612
MLGRAAALSAPRWRGGVPDLRAALRSGGNLLFALFVAAVLAFTLLAAFHSPDDPLLHPSSHQLTDFLTSATSTSTFLTDDSVLRTGEDFHCGGGGGRRRGRRLGVSKSSPRPPRSQALQIGPKAQKNGPQNGPGRPRQPGCGPPAKGPTGGGENPPLRRGFPGPPGGPPWVCSGKKGIPFPPALWGGGIGGWSPSS

SEQ ID NO: 66251 - DNA, 721 bp, Zea mays
  misc_feature: Ceres CLONE 1538613
  misc_feature: Encodes the peptide sequence at SEQ ID NO. 66252
  misc_feature (449)..(449): n is a, c, t, g, unknown, or other
  misc_feature (586)..(586): n is a, c, t, g, unknown, or other
  misc_feature (642)..(642): n is a, c, t, g, unknown, or other
aaagctggagctccccgcggtggcggccgctctagaactagtggaacccccgggctggaggaattcgtctcacccctagaaaaaacaattccccaatttttttgtttccattccacaaaaccacaaccgcgcggttttctccctccccggctcccgcggcgcaagcgcagcccacccaagcgccatggccgccgccgcccccgacgccgacgcctacgatatcccgtgggtggagaagtaccgcccctcccgcgtcgctgacgtcgtcggaaactccgatgccgtcgcccgcctggaggtcattgcccgcgacggcaacatgcccaacctcatcctctccgggcctccggggaccgggaagacgacgagcatcctggcgctggcgcatgagctcctcgggcccagctatcgtgatgccgtgctggagctcaatgcctcagatgacaggngtttggatgttgtgcggaacaagatcaagatgtttgcacagaagaaagtcaccctacagccagggcggcacaaaatcgtgatcttggatgaggctgacagcatgacatcaggagcacagcaagctctgcgaagaacnatggagatctattcaaacaccactagatttgcacttgcatggcacacatcatcaangataatttgacccattccaaggcgatgggcttattcgccggttcctcaggctctctgatccgaaaatctccgggccccc

SEQ ID NO: 66252 - protein, 155 aa, Zea mays
  misc_feature: Ceres CLONE 1538613
  misc_feature (89)..(89): Xaa is any aa, unknown, or other
  misc_feature (153)..(153): Xaa is any aa, unknown, or other
MAAAAPDADAYDIPWVEKYRPSRVADVVGNSDAVARLEVIARDGNMPNLILSGPPGTGKTTSILALAHELLGPSYRDAVLELNASDDRXLDVVRNKIKMFAQKKVTLQPGRHKIVILDEADSMTSGAQQALRRTMEIYSNTTRFALAWHTSSXII

SEQ ID NO: 66253 - DNA, 598 bp, Zea mays
  misc_feature: Ceres CLONE 1538617
  misc_feature (598)..(598): n is a, c, t, g, unknown, or other
ccccgcggtggcggccgctctagaactagtggatcccccgggctgcaggaattcgtctcacccctagaaaaagtcattttccccgcagcgacgacgattcagtgaggcacccctctcctggcctcttctcgccttctccgtttccgcgaacccagctgcctcgtagccccaccacaccgccgagcacgcggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttggggtccagcatataactcatgcccataaaatttgcactagaaaatatgtcgacacaagcctctaaccggtcatacagatatccagacagaaccccaactggcggtacaccattggcaaatcaattgcatggtgggggcaatgggtaattccggggtggcacaaaatccccgaagaatgttacctaccttccctctggaggatgggatccccgaagcagttagn

SEQ ID NO: 66254 - DNA, 700 bp, Zea mays
  misc_feature: Ceres CLONE 1538622
  misc_feature: SWISSPROT Homolog: EC 1.10.99.1 Plastoquinol--plastocyanin reductase
tggagctccccgcggtggcggccgctctagaactagtggatcccccgggctgcaggaattcgtctcacccctagaaaaaatgtctgtggacgccggtgagtgatcactaggcgagttggcccgcttctttcctgactgtcgtcggggggaccttcgcggagatctcgagagccgcctagtccatgcaggtctggaggtccatcgctgccctgggcaagccagtgaatgggattgacatgacgatggggcggtagtcctcatgccagactaccatgacgtggaaggcttgccagcatgatgaccgccgaccacgactcctatatggagaagcagaagctgatgaacgtactcgacctgggcaccatatccctgcacaccgacggcatgaccgtccactacagcatcttctatagtgccggcggctacgggaacagcagcagccggacctactaccaacgacaagctggggaacaacatcgctgtggaggagtggctcgacacgcagagctccaacaacgtcacgctgcggctgggtgtcattgatgagcccgcataccaggatgtgaaccaggacaagacgctggacacctgcgacatgcatgacaagtgaacactccttactacgtcgtgacgtgcacggtgacgacatcgaataatctgcctctgcactgtagtccagacgacaaccatgtgcagatgt

SEQ ID NO: 66255 - DNA, 825 bp, Zea mays
  misc_feature: Ceres CLONE 1538624
  misc_feature: Encodes the peptide sequence at SEQ ID NO. 66256
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (45)..(45): n is a, c, t, g, unknown, or other
  misc_feature (825)..(825): n is a, c, t, g, unknown, or other
tccctttttttnncgnnncgaaaggacggggtnnnncatcaananaaaacactcgggctccccgcggtggcggccgctctagaactagtggatcccccgggctgcaggaattcgtctcacccctagaaaaaaacctcgtgttcgttcggagcgcacacacacacaaccagatctcctccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggagggggggacgcttgctgactaccacatccacaaagagaagaacccttttttttgtgctccccctcggggggaggggcgcccttcttttcttgaaaacccttgccccggctaaaccatcccccccccccagggggaagcccctctttacgccctttggtatatgttccaaggcccgcaattccccgcactagcaagggggcatcccctccctggacccagcacgggcgctcccctttttatcccggagaaagaccccgcgcgaaccagtgccagcctatctttttggcccttcttcccccccatgtgaggaggtggtaactcctctcacccagcggacggcggccccgtctctttggaattgcgctctcatcccatctacccctctgaggaccctgcgtccccttctcgaagcatcttctgagcctctgcccgcgtagaagggggcgcctgcgcaacgcccn

SEQ ID NO: 66256 - protein, 88 aa, Zea mays
  misc_feature: Ceres CLONE 1538624
  misc_feature (6)..(68): Pfam Name: ubiquitin Pfam Description: Ubiquitin family
MQIFVKTLTGKTITLEVESSDTIDNVKAKIQDKEGIPPDQQRLIFAGKQLEEGGTLADYHIHKEKNPFFCAPPRGEGRPSFLENPCPG

SEQ ID NO: 66257 - DNA, 650 bp, Zea mays
  misc_feature: Ceres CLONE 1538625
ggcggccgctctagaactagtggatcccccgggctgcaggaattcgtctcacccctagaaaaagtctctcccctgtccaaaagtctctcgaatctccaccctggttccgcaccggttccagaattttctcccatttccagggtctccccgtttctgtccggcggttctgccgttccactgcttttgatttcggagtgtgagcttacatcttgctggacaataaagattggattttaagcgatttggggggtgcttgcctgatctccccctgcgaggtactgccggggggatgggatttcggggaagttttggtgggttgaatatcggcttggccggagcaggattgaccatcgacatgtccattcccgggagctccgggctgctgaaagctgccgggaaaaaggacttaaagtttttaggaacccttagtgtttggcctcccggggcctgaaagaaatcgggggatccccttttgggtccaaaaaaggggttaaaatttggagccccttctttaatcccccaaaattttccccggggaaaaggaaattactttttaaaaaaaaaaaattggtaaaaagggctctttacgggaaaattaatttgaaaccctctgggggggggtgtaaaaataaagaaacaaaccgccccaa

SEQ ID NO: 66258 - DNA, 699 bp, Zea mays
  misc_feature: Ceres CLONE 1538627
  misc_feature: Encodes the peptide sequence at SEQ ID NO. 66259
  misc_feature (451)..(451): n is a, c, t, g, unknown, or other
  misc_feature (509)..(509): n is a, c, t, g, unknown, or other
ccccgcggtggcggccgctctagaactagtggatcccccgggctgcaggaattcgtctcacccctagaaaaaaccaaaccgtttcacccggacctgcccccaacaccctgctctatcctcatagcaaaccaccgcctgaattgggcggcaattgggagaggattcgcggcaggtagggcgctgatccgttggcgagatgattgcggctgtcaaccgagtgccggcaggctggggcgaggatgagatgtccgtgctgccgcggcacaccaaggtggtggtcaccggcaacaaccgcaccaagtcggtgctcgtgggcttgcacggagtcgtgaagaaggccgtcggtctcggaggatggcattggctggtacttactaatggaatagaggtaaagctgcagcggaatgctttaagtgtgattgaacctccgacaggcaacgaggatgatgantaatttgattgtgaaaacctgcggtggaatagttcagacttggtctccgatgatgcancatcaccaaagccacaaagtcaaggagcaggcagcataggggtttccacagaaatcctttagccgtcaatgtcatgtgactccaatctaagacgtcggttcatcttccctcaaactcccccgaaagtgacctggaccagttaacctgactgccctgttaaattttggcccctttcaatcccaaggaggcc

SEQ ID NO: 66259 - protein, 84 aa, Zea mays
  misc_feature: Ceres CLONE 1538627
MIAAVNRVPAGWGEDEMSVLPRHTKVVVTGNNRTKSVLVGLHGVVKKAVGLGGWHWLVLTNGIEVKLQRNALSVIEPPTGNEDD

SEQ ID NO: 66260 - DNA, 660 bp, Zea mays
  misc_feature: Ceres CLONE 1538630
  misc_feature: Encodes the peptide sequence at SEQ ID NO. 66261
gcggtggcggccgctctagactagtggatcccccgggctgcaggaattcgtctcacccctagaaaagtgtgggtgtgcccacggcatggcgttcttcagcagcggatcccgggtggtggtcgaaatcctgacgaggatgcagagcgctgaaagaccaatgcctgtcgaccacaccttcttcgagttgggatccattcgctaccatgtggaggcttcagcgtcggatcccgagaacgtgttcctatcgatatcgacgccatcgctctcctacgactacgaggaggctgcagctgcaccctcgtcgagccgcctgcctgagctgaccctgcaggaggcgaggaagacgtatcacacgttcgccgagatggtggagccgccgagggaaaggtacgtcctgacgctcagctcaacttctccgggctcaccgggccaaaggttgttggcttctacccgtttgtttggctgcagctgggactgggaatattttttatgtaccccttctgacatttgttaaaaattaaatggcgttcaaggccattaaccaagtggtcctttgcgccaatccgggggtgctggaccccccacctaaaagccagtgctggggaacccccggtccccccgggcccattaaggggttcggttcccccaacccgggggccg

SEQ ID NO: 66261 - protein, 142 aa, Zea mays
  misc_feature: Ceres CLONE 1538630
MAFFSSGSRVVVEILTRMQSAERPMPVDHTFFELGSIRYHVEASASDPENVFLSISTPSLSYDYEEAAAAPSSSRLPELTLQEARKTYHTFAEMVEPPRERYVLTLSSTSPGSPGQRLLASTRLFGCSWDWEYFLCTPSDIC

SEQ ID NO: 66262 - DNA, 722 bp, Zea mays
  misc_feature: Ceres CLONE 1538633
  misc_feature: Encodes the peptide sequence at SEQ ID NO. 66263
  misc_feature (685)..(685): n is a, c, t, g, unknown, or other
  misc_feature (686)..(686): n is a, c, t, g, unknown, or other
ctggagctccccgcggtggcggccgctctagaactagtggatcccccgggctgcaggaattcgtctcacccctagaaaaatgtaggcgtgtcagcgtgtgtggtcgagaggcgcgagcgaacctttgccagtccatagatagtacaggtccccgtgagtcgattgtgtgtgtgctggtgaccgccgaccgacaagtcaagaaatggcaacgagcgagctgccgtcggagtcggacgcgttcaccttcccgtgcggggacgacggaacgacgtcaccggcgctgtcgccgccggtcgtgatctcagtgctcgcgtccatcctggagcggcacatcgccctcaacgagcgggccatggcggccgcgagcggcctcgaccagtcggcaccgggcgacgacgacgacaactcggacccggcggccgcggctgcgaggaagcgggcacgggcgttcgacggcggcacggtgctggacatgagcctgcacgcgttcctggagcgtttctcccgctacgcgcacgtgtcgcccgcagtgtacgtggttgcgtacgcgtacctggacaagctccggcccaacgccggggtggcgcgtcgtggcccccaaccgcagcgcctgttaaccagggcattccttgtccgttccagatcggggggggacgggaacttaggggaaccccctattttcccnncctgtgggccggtttggccgcggggggatcttaacc

SEQ ID NO: 66263 - protein, 173 aa, Zea mays
  misc_feature: Ceres CLONE 1538633
  misc_feature (162)..(162): Xaa is any aa, unknown, or other
MATSELPSESDAFTFPCGDDGTTSPALSPPVVISVLASILERHIALNERAMAAASGLDQSAPGDDDDNSDPAAAAARKRARAFDGGTVLDMSLHAFLERFSRYAHVSPAVYVVAYAYLDKLRPNAGVARRGPQPQRLLTRAFLVRSRSGGDGNLGEPPIFPXCGPVWPRGDLN

SEQ ID NO: 66264 - DNA, 729 bp, Zea mays
  misc_feature: Ceres CLONE 1538635
  misc_feature: Encodes the peptide sequence at SEQ ID NO. 66265
  misc_feature (467)..(467): n is a, c, t, g, unknown, or other
tggagctcaccgcggtggcggccgctctagaactagtggatcccccgggctgcaggaattcgtctcacccctagaaaaagttgcacttcaagcttcctccgcggcctcccgtcgagcaaccatggcggcggcggtaaccctcctccgccttcctctcgcccgactctcctaccacctccgctccgtaccttcctctcgtctgccgtctccgcgcctacgtatctttgcctcccatcgccttttctcctccctggaccatgtctccgcctctgcttccgcctccgcggccgtggccgaggttgtaggcgtgccggacgcggaggagtcggtagaggaggaatctgcggccgaggcggaggcggaggcgcccaggtcgttcgtgctcccacggctgccgcggccgaagctgagcgtgaaggagcggaaggagctggcctcgtacgctcacggcctcggcaaaaagctcnaatcgcaacaggtcggtaagagcggcgtcacaccgaaacttgtctccgccttcagtgacaacctcgagtccaacgagctcctaaagctaaaaattcatgggaactgccctggggagctacctgatgtgatactgcaacttgaggagtcaacaagatccatcgctgttgacccaatggtcccccctgttattcggaaaggcccttcccccgccaaatgaaaaaaaacacacgggtgatgaaaatgccaggaggtttcccaaac

SEQ ID NO: 66265 - protein, 187 aa, Zea mays
  misc_feature: Ceres CLONE 1538635
  misc_feature (96)..(180): Pfam Name: CRS1_YhbY Pfam Description: CRS1 / YhbY domain
  misc_feature (116)..(116): Xaa is any aa, unknown, or other
MAAAVTLLRLPLARLSYHLRSVPSSRLPSPRLRIFASHRLFSSLDHVSASASASAAVAEVVGVPDAEESVEEESAAEAEAEAPRSFVLPRLPRPKLSVKERKELASYAHGLGKKLXSQQVGKSGVTPKLVSAFSDNLESNELLKLKIHGNCPGELPDVILQLEESTRSIAVDPMVPPVIRKGPSPAK

SEQ ID NO: 66266 - DNA, 723 bp, Zea mays
  misc_feature: Ceres CLONE 1538636
  misc_feature: Encodes the peptide sequence at SEQ ID NO. 66267
tggagctcaccgcggtggcggccgctctagaactagtggatcccccgggctgcaggaattcgtctcacccctagaaaaagtgccgcacggtcagatgagttaagccctaaacccatttccccctcgtctccactactctggtcgtcctcgcgccgccgccgccgccgccgccgccgcagcagcagcagcagcagcgacgcgaccgccggtaatggcttccaccgttgtgctccggaacgcctgctcccgccgactcttctgctactccactctccgcgccgccgcaatattgggacccgccgcgccacctgatgcgcccgcggcggcgtcggcccagccgccaccgatggcaggaaccctctgggcgaggtccatggccactttcacgcgcacgaagccacatgtgaacgtcggcaccattgggcacgtcgatcacggcaaaaccacactcactgctgccattaccaaggttctggcagaggcagggaaggccaaagcagttgcttttgacgagatcgacaaggccccggaagagagagccagaggaatcaccattgcaacagctcatgtcgagtatgagactgctaaaaggcattatgctcatgttgattgtccaggtcacgcagattatgtcaagaacatgatcactggagctgctcaaatggatggtgggtattctgtcgtgtcagctcctgatggccccatggcacaaacaaaggagca

SEQ ID NO: 66267 - protein, 125 aa, Zea mays
  misc_feature: Ceres CLONE 1538636
  misc_feature (17)..(125): Pfam Name: GTP_EFTU Pfam Description: Elongation factor Tu GTP binding domain
  misc_feature: SWISSPROT Homolog: EC 2.7.7.4 Sulfate adenylyltransferase
MAGTLWARSMATFTRTKPHVNVGTIGHVDHGKTTLTAAITKVLAEAGKAKAVAFDEIDKAPEERARGITIATAHVEYETAKRHYAHVDCPGHADYVKNMITGAAQMDGGYSVVSAPDGPMAQTKE

SEQ ID NO: 66268 - DNA, 733 bp, Zea mays
  misc_feature: Ceres CLONE 1538641
  misc_feature: Encodes the peptide sequence at SEQ ID NO. 66269
  misc_feature (355)..(355): n is a, c, t, g, unknown, or other
  misc_feature (411)..(411): n is a, c, t, g, unknown, or other
tggagctcaccgcggtggcggccgctctagaactagtggatcccccgggctgcaggaattcgtctcacccctagaaaaagcatctccatccacctgtcctcgcgtctcccttcccagatccatcgactcgctcgggccgcccctcccgtcgtccccgttcgaaggtgcggcagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttttgattcaaattcgcacagtggagcangatgggaagaccataaaacttcaaattggggatactgctgggcaagagccgctcangggacatccctagcagcttctaccgcggagctcagggaatcattattggtattgacgtgccaaaccaaaaagctttcataatgtaaaccaatggtgaaacaaaataacccttttgccagtggaatatgtatacaaccccccttgtggggaacaaaaaggcccttttcgccccaaaaattttggggaaataaaaaacaaaaaagttttttttaaaaaaggggcccccccttttgggggggaggggggaaaaaaccccccttttggggggggggctccttgtgggttgtgggcccccccaaagaggagagggggggcccccccc

SEQ ID NO: 66269 - protein, 74 aa, Zea mays
  misc_feature: Ceres CLONE 1538641
  misc_feature (10)..(75): Pfam Name: Ras Pfam Description: Ras family
  misc_feature (52)..(52): Xaa is any aa, unknown, or other
  misc_feature (71)..(71): Xaa is any aa, unknown, or other
MNPEYDYLFKLLLIGDSGVGKSCLLLRFADDSYLDSYISTIGVLIQIRTVEXDGKTIKLQIGDTAGQEPLXGHP

SEQ ID NO: 66270 - DNA, 682 bp, Zea mays
  misc_feature: Ceres CLONE 1538642
  misc_feature: Encodes the peptide sequence at SEQ ID NO. 66271
  misc_feature (236)..(236): n is a, c, t, g, unknown, or other
  misc_feature (254)..(254): n is a, c, t, g, unknown, or other
  misc_feature (296)..(296): n is a, c, t, g, unknown, or other
ctggagctccccgcggtggcggccgctctagaactagtggaatcccccgggctgcaggaattcgtctcacccctagaaaaaaaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcngccgtctctaggtcgtcngcgaagaaggcgcccttcgtcgtcagggccagctccagcccntccagccaagcaagggtgcgaacgggcagctgttggttcgcgtccaagcagtcccctctcctaccctcaattggacccctgcccggggaacttttgctttcaaaccggtggggcttcttcggacccggaggggaaccgggggggcttaatcggacccccaaatggtttggccctttgcaagggggatataacggcccccttcccccatggtggggggcccgggggggccccttccccccccggaaaatttcccgcgaaaaaggggaaattttccccccccaaaaaaccgcctttcccctgggttaaaaaaaaagggggtttttccccccccccgggggggcacttaaaaaatttggggggggcaaaaactttacaacccttttttc

SEQ ID NO: 66271 - protein, 140 aa, Zea mays
  misc_feature: Ceres CLONE 1538642
MAAQALLSGRQLLGRPVQSAVSRSSAKKAPFVVRASSSPSSQARVRTGSCWFASKQSPLLPSIGPLPGELLLSNRWGFFGPGGEPGGLNRTPKWFGPLQGGYNGPLPPWWGARGGPFPPRKISREKGEIFPPQKTAFPLG

SEQ ID NO: 66272 - DNA, 2621 bp, Zea mays
  misc_feature: Ceres CLONE 1538646
  misc_feature: Encodes the peptide sequence at SEQ ID NO. 66273
ctccctcatttgatggtgatgcgtccgtccgttcagcttcgcaaatcctctcagcccttgcggtgcccggtacggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggaatataccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaaactcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatgaaaaaaaaaaaaaaaaa

SEQ ID NO: 66273 - protein, 768 aa, Zea mays
  misc_feature: Ceres CLONE 1538646
  misc_feature (303)..(726): Pfam Name: DUF221 Pfam Description: Domain of unknown function DUF221
MASLGDIGLAAGLNVLTAVAFLLAFAFLRLQPINDRVYFPKWYLRGMRDNPIVSGAAVQKFVNLDARSYLKFLNWMPAALKMPQDELINHAGLDSVVYLRIYVTGLKIFVPITVLAFLVLVPVNWTNDTLGRINVVYSPIDKLSISNVPNGSKRFIAHLGMAYAITFWTCYVLLKEYEIISNMRLRFLASEKRRPDQFTVLVRNIPPDPDESISELVEHFFLVNHPDHYLQHQVVYNANKLADLVEKKKKMRNWLDYYLLKYERNSSLRPTTKTGFLGCFGSKVDAIDYYKSEIEKIGKQEAEERKNVMKDPKSVVPAAFVSFRSRWGAAVCAQTQQTSNPTLWLTEWAPEPRDVYWNNLSIPFVSLTIRRLIVAVAFFFLKLFYVIPITFVQSLANLEGIEKALPFLKPLIDLPFIKSFIQGFLPGIALKIFLIVLPTILMFMSKFEGLISQSSLERRSASKYYIFLFFNVFLGSVIAGSALEQLKTYLHTSANDIPRIIGDSIPMKATFFITYVMVDGWTGIAGEILRLKPLIFFHLKNFFLVKTEKDREEAMDPGSICFDSTEPRIQLYFLLGLVYAAVTPFLLPFILVFFGFAYVVFRHQIINVYNQQYESAAQFWPSVHGRIITALIVSQLLLLGLMSTNDFEQTTPVLLVLPVLTFGFYKYCKNRFEPAFVRNPLQEAMKKDTLERAREPNLDLKAYLANSYLHPVFKGDEGDDRYSVMDDDGWMEEEVIVPTKRHSRRTTPAQSKHEGSDSLSVLESSLQR

SEQ ID NO: 66274 - DNA, 683 bp, Zea mays
  misc_feature: Ceres CLONE 1538647
  misc_feature: Encodes the peptide sequence at SEQ ID NO. 66275
  misc_feature (683)..(683): n is a, c, t, g, unknown, or other
ggagctccccgcggtggcggccgctctagaactagtggatcccccgggctgcaggaattcgtctcacccctagaaaaagtcataaatagccagccccatccccagcttctttccccaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccgctccacttggtgttgcgtctcacgtggcgcatgcatatatttgtgaagactctgactggcaan

SEQ ID NO: 66275 - protein, 163 aa, Zea mays
  misc_feature: Ceres CLONE 1538647
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTAPLGVASHVAHAYICEDSDWQ

SEQ ID NO: 66276 - DNA, 645 bp, Zea mays
  misc_feature: Ceres CLONE 1538648
  misc_feature: Translation starting site: 157
  misc_feature: SWISSPROT Homolog: EC 3.6.3.14 H(+)-transporting two-sector ATPase
ggagctccccgcggtggcggccgctctagaactagtggatcccccgggctgcaggaattcgtctcacccctagaaaaatccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatccgccaagtgtgccaggtgatcggcgccgtcgtcgacgtgcgctacgatgagggcctcgccgcccatcctcactgggctcgagggtgctcgacaacgacatccgcctcgtgctcgaggtggcgcatcaccttggcgaagacatggtgcgcaccatcgctatggacggcacggaggggctcgtccgcggccagggcgtccttcagactggctcccccatcaccgtgcctgttggcagggctaccc

SEQ ID NO: 66277 - DNA, 784 bp, Zea mays
  misc_feature: Ceres CLONE 1538651
  misc_feature: Encodes the peptide sequence at SEQ ID NO. 66278
  misc_feature (600)..(600): n is a, c, t, g, unknown, or other
  misc_feature (784)..(784): n is a, c, t, g, unknown, or other
ggccatcggatgaggtgggttgaatgtaagatgttccgcttggtgggcggggggggggggggctccccgcggtgggcggccgctctagaactagtggatcccccgggctgcaggagttcgtctcacccctagagaaagtccttgaggaccgacgccgccctactcgcagcttcctgggtttcgtcggatcctctgctggcgacgagcaccccttacaccaggccgttgcttgggcgccggtgccatgcccggcgggtcttcgggtcctcatggtgaagtggatgcaggatttccgaagctccagggagagcatttcgagtattacctgcggacggactccatgatgctgggacgcaccagcgagccatcaacggtggatgtggatctctcgagcctcggtggggattggggacgagaagtgctacttcctactgccaacacgggccatcttcgcttcggctgcagctgctcggggtggtcctattattccacggcagcttcctcctccgacgtatgcacatgcacgggcaggccgttcctctttagtccgagtttcatgaccgctccttctaatgtgatttatggcgggatcttcatganactgggcaatggggtcagggactctggggtgtaggggtaatcctggtgaagagttacacggaagtcttctggctacttggaatattctgtggtgggcttagatatcgtatgtggtaaccaataggggacgcggggggaaagaccgttaaattttagcataggatcatacggtgtggcttgtggn

SEQ ID NO: 66278 - protein, 129 aa, Zea mays
  misc_feature: Ceres CLONE 1538651
  misc_feature (119)..(119): Xaa is any aa, unknown, or other
MPGGSSGPHGEVDAGFPKLQGEHFEYYLRTDSMMLGRTSEPSTVDVDLSSLGGDWGREVLLPTANTGHLRFGCSCSGWSYYSTAASSSDVCTCTGRPFLFSPSFMTAPSNVIYGGIFMXLGNGVRDSGV

SEQ ID NO: 66279 - DNA, 639 bp, Zea mays
  misc_feature: Ceres CLONE 1538657
  misc_feature: Translation starting site: 182
  misc_feature (639)..(639): n is a, c, t, g, unknown, or other
tccccgcggtggcggccgctctagaactagtggatcccccgggctgcaggaattcgtctcacccctagaaaaagccaccacgcagctcccacgctcaccgacgccactgcttgtgcgcgcgcaatggcactcgtgtccgcctcctcgtcctccaccaccgccgtcgcggcgctccccaggaatggggcagcagcgggcgtcgtcttcgttgttctcctcctcctcctcttcctccttcctcgtcagcaagacgctgctgaggcaggccgaggcagcccggccgtcgttcgccatgcgcaccgcggcggattccgacaggccgatctggttccccggcagcacctcctccgacgtggctcgatggcagccttcccggcgacttctcgctttgatccctgaggcctcgaatctgacccagagagcctgcggtggaacgatgcaggaggagctggtgcactgccggtgggccatgctcggcgcgtacggtatcttcatcccggagttcctgaccaagatcggcgtcctcaacaaggacttctggtacaacaacagcgagcagcacgtcttcagctgaacctccaccctcttcgtcatcgagctcatcctcatcggctggggcgagggccagcgttgggttgn

SEQ ID NO: 66280 - DNA, 712 bp, Zea mays
  misc_feature: Ceres CLONE 1538661
  misc_feature: Encodes the peptide sequence at SEQ ID NO. 66281
  misc_feature (40)..(40): n is a, c, t, g, unknown, or other
  misc_feature (394)..(394): n is a, c, t, g, unknown, or other
  misc_feature (395)..(395): n is a, c, t, g, unknown, or other
  misc_feature (428)..(428): n is a, c, t, g, unknown, or other
  misc_feature (468)..(468): n is a, c, t, g, unknown, or other
  misc_feature (541)..(541): n is a, c, t, g, unknown, or other
  misc_feature (542)..(542): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (629)..(629): n is a, c, t, g, unknown, or other
  misc_feature (695)..(695): n is a, c, t, g, unknown, or other
  misc_feature (696)..(696): n is a, c, t, g, unknown, or other
  misc_feature (712)..(712): n is a, c, t, g, unknown, or other
tccccgcggtggcggccgctctagaactagtggatttctngggctgcaggaattcgtctcacccctaggaaaggtgctcatcatcaccagttcaccacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcatctcccaggatatggaaaaaattgcccctaacctgatgtttatcttcctggaaccaaatgtcaaaaacctcgggatttttttcccccccccccaggggggggagaggggaggaccannttttttcaaacccccttgtgtggtttggcactnaccaaaaaaaactacctcttagagtggggggggaaaattncctatagcaacattactacctctaggccaaagggaaaataccccccctcccctccccaaagaaaaaagacaanntggtgttcaaagcaccacccaaccttctgtcaccccccccaacctcgggtcctaaaaccaannnncnacactacgcgccctccccanccggcactacctccaaaacgacaaccgcctattaaatatttgttgtcctttgtacccgtaccccgnngcctccacgaaaaaan

SEQ ID NO: 66281 - protein, 86 aa, Zea mays
  misc_feature: Ceres CLONE 1538661
  misc_feature: SWISSPROT Homolog: EC 2.1.1.14 5-methyltetrahydropteroyltriglutamate--homocysteine S-methyltransferase
  misc_feature (69)..(69): Xaa is any aa, unknown, or other
  misc_feature (80)..(80): Xaa is any aa, unknown, or other
MASHIVGYPRMGPKRELKFALESFWDGKSISQDMEKIAPNLMFIFLEPNVKNLGIFFPPPQGGERGGPXFFKPPCVVWHXPKKTTS

SEQ ID NO: 66282 - DNA, 667 bp, Zea mays
  misc_feature: Ceres CLONE 1538664
  misc_feature: Encodes the peptide sequence at SEQ ID NO. 66283
  misc_feature (469)..(469): n is a, c, t, g, unknown, or other
  misc_feature (545)..(545): n is a, c, t, g, unknown, or other
  misc_feature (597)..(597): n is a, c, t, g, unknown, or other
ctccccgcggtggcggccgctctagaactagtggatcccccgggctgcaggaattcgtctcacccctagaaaaaaggccgcctgcgctccttgcccctaagcctcgtttccggtgtacgactccaacgacgacgagatggcctccccgctccgtcggagcttcccctccctcggccgcgcgcttctcacgccggcgccggcgcggatgctctccgcggaggcctccgatgccctcgttgagatcaagcccagggagattgggatggtctccggcatccccgaggagcacctccgccgtaaggttgtaatttattcaccagctaggactgcatctcagcaaggttcaggcaaagttgggagggtggaaattaactttttgtcaacccaaaagtgggagaacccattgatgggatggacatctactggggatccatatgctaatgtcggtgaagcaggacttacattcaancagtgcggagtcagcaaaagcatttgctgaaaaacatggatgggaattatgtgggtacggaaacggcatacacctncttctgaagccctaggcctacgctgagaacttcaaagtggaaaggccccccngaagcggagcaagcatgagctcaaggcctcccacagcatgtgaccctgacactgggaatgatgttatttt

SEQ ID NO: 66283 - protein, 120 aa, Zea mays
  misc_feature: Ceres CLONE 1538664
  misc_feature (54)..(120): Pfam Name: ETC_C1_NDUFA4 Pfam Description: ETC complex I subunit conserved region
  misc_feature (111)..(111): Xaa is any aa, unknown, or other
MASPLRRSFPSLGRALLTPAPARMLSAEASDALVEIKPREIGMVSGIPEEHLRRKVVIYSPARTASQQGSGKVGRVEINFLSTQKWENPLMGWTSTGDPYANVGEAGLTFXQCGVSKSIC

SEQ ID NO: 66284 - DNA, 554 bp, Zea mays
  misc_feature: Ceres CLONE 1538672
  misc_feature: Encodes the peptide sequence at SEQ ID NO. 66285
  misc_feature (449)..(449): n is a, c, t, g, unknown, or other
  misc_feature (474)..(474): n is a, c, t, g, unknown, or other
  misc_feature (477)..(477): n is a, c, t, g, unknown, or other
  misc_feature (533)..(533): n is a, c, t, g, unknown, or other
tggagctccccgcggtggcggccgctctagaactagtggatcccccgggctgcaggaattcgtctcacccctagaaaaaatccgacgggcagaagcagagcaccaccaccatacgccgccaccgcaagcagacgtccccatggccatggcttccaccgccaccgctgctgcatctctccgcctcgccttacctctcctctcctcgccggcttcctcctcctcgtcctctaatacccttcgcttccctctccgccgccgcagctcccgcccgcccccatcgccggtccttccggccttttcaaagaaaaaggccctttcccccaaaaagggggggtttccccccccccgggtgggcccccacatcccccccccctgggggggggaggcccccccccccccggggggggggccccccccccccccccggggggggggggggggaaaaacgnaaaagaaaaggggggggggaagagnatnttttcttttttttcttggggggcccccccaccccccaaacaaaaaaaaaaaaaaangaggaggggggggtgtttttt

SEQ ID NO: 66285 - protein, 138 aa, Zea mays
  misc_feature: Ceres CLONE 1538672
  misc_feature (104)..(104): Xaa is any aa, unknown, or other
  misc_feature (112)..(112): Xaa is any aa, unknown, or other
  misc_feature (113)..(113): Xaa is any aa, unknown, or other
  misc_feature (132)..(132): Xaa is any aa, unknown, or other
MAMASTATAAASLRLALPLLSSPASSSSSSNTLRFPLRRRSSRPPPSPVLPAFSKKKALSPKKGGFPPPRVGPHIPPPWGGEAPPPPGGGPPPPPRGGGGGKTXKKRGGGRXXFLFFLGGPPHPPNKKKKKXGGGGVF

SEQ ID NO: 66286 - DNA, 619 bp, Zea mays
  misc_feature: Ceres CLONE 1538673
  misc_feature: Encodes the peptide sequence at SEQ ID NO. 66287
  misc_feature (279)..(279): n is a, c, t, g, unknown, or other
  misc_feature (296)..(296): n is a, c, t, g, unknown, or other
  misc_feature (362)..(362): n is a, c, t, g, unknown, or other
  misc_feature (376)..(376): n is a, c, t, g, unknown, or other
  misc_feature (379)..(379): n is a, c, t, g, unknown, or other
  misc_feature (390)..(390): n is a, c, t, g, unknown, or other
  misc_feature (404)..(404): n is a, c, t, g, unknown, or other
  misc_feature (407)..(407): n is a, c, t, g, unknown, or other
  misc_feature (409)..(409): n is a, c, t, g, unknown, or other
  misc_feature (411)..(411): n is a, c, t, g, unknown, or other
  misc_feature (428)..(428): n is a, c, t, g, unknown, or other
  misc_feature (430)..(430): n is a, c, t, g, unknown, or other
  misc_feature (435)..(435): n is a, c, t, g, unknown, or other
  misc_feature (437)..(437): n is a, c, t, g, unknown, or other
tccccgcggtggcggccgctctatcaactagtggatcccccgggctgcaggatattcgtctcacccctagaaaaaactccttattgccgccgctgccctgctccaaccccccgcctcctctttcctcgcaagaccacgtcctcatccactacatccaccagctagacgagcaagaagccgccaccatggtccgcaagcgccccgcgcccgacatggacctcccgccgccgcgccgtcacgtcacgggcgacctctccgacgttacggccgcagccgccnccgctggtggtcctggngcgccgtcctccgctagcgcgcagctacccgcgctgccccacccaatccactagctgcccaaaatntttaagaaaaaagnggnggaagtggacntgcccccagaaccnaangngncgggccatttgaaggcngnaagcnantctccctcttccacaaccccgtgggtggacggaatcatccgaaacatcatggggagcagcggcagcagaaatatcttcataacgcagctcatccaaaggtcctccatgtttccttctctgcctctcttccatgggaaagctgggatgcagcatggacaacttttgagctggtaaacactcgg

SEQ ID NO: 66287 - protein, 115 aa, Zea mays
  misc_feature: Ceres CLONE 1538673
  misc_feature (93)..(93): Xaa is any aa, unknown, or other
PAVAAALSTSGSPGLQDIRLTPRKNSLLPPLPCSNPPPPLSSQDHVLIHYIHQLDEQEAATMVRKRPAPDMDLPPPRRHVTGDLSDVTAAAAXAGGPGAPSSASAQLPALPHPIH

SEQ ID NO: 66288 - DNA, 818 bp, Zea mays
  misc_feature: Ceres CLONE 1538686
  misc_feature: Encodes the peptide sequence at SEQ ID NO. 66289
  misc_feature (29)..(29): n is a, c, t, g, unknown, or other
  misc_feature (32)..(32): n is a, c, t, g, unknown, or other
  misc_feature (39)..(39): n is a, c, t, g, unknown, or other
  misc_feature (49)..(49): n is a, c, t, g, unknown, or other
tttttttttttttttttttttttaatttnccnaagcacnaattaacaanggcccaaactggaactccacgcggtggcggccgctctagaactagtggatcccccgggctgcaggaattcgtctcacccctagaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgcctccgcgcccaaaccggcttggcaggaagcttgtggtccgggccgatgaggagttccccggcagatcctagcgcccatggcggaaatgggagggcgccgtggccaccaagccccaaaggccgataagccgccgcccgatcagggcaccaaataggggcgccaagggttgataaatcactgagggcggggaggccctactgggggttaaaaccgggtatctgggcaaccgccgtctcaccccttccaatcaatgtattccctaaacaacccccttaacccggctgcgtgtggtgccggtttccaccacgggagaaaactaaccgacagggcgtgtaactaccaaagaaacttataaacctcattaacaaaaaaaccctgcgaagtatgaaaaatgaaaacgcaggcccaacgccctggcaaaaacaaaccacgttgaagaccccgctgttgaacttagagaccattcactatcaacattatgcacgctcccgagcccaaagcgatgcccacaggacaggg

SEQ ID NO: 66289 - protein, 47 aa, Zea mays
  misc_feature: Ceres CLONE 1538686
MASTNMASATSRFMLAAGVPTASSGSGRVSFASAPKPAWQEACGPGR

SEQ ID NO: 66290 - DNA, 777 bp, Zea mays
  misc_feature: Ceres CLONE 1538689-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (586)..(586): n is a, c, t, g, unknown, or other
nnnnttggcaattgggtacctcgagcgtctcgtttttttttttttttttggcgctagaaatagtacacatgtaggtttcgatgaccaggcaaggatgtgattacaatccgtgtaaactctgcttgaaaattgaaagatactacaaatcaaagatgagcacggactctggccgaaacactgggctattgtacaacaacaaggcggcattgccatcgcagttgcagtactagcaattgccatcgggattgcggttgcggacttgcggtgttgcagtagtagtactgtagtactatcaagtgagtctgatgcatgaccagagcagatggagtagttaaacggaggcgccggtgagcttgccgttgacgatgtggtggttgtcgtcgtccatgtagcgcttccagaaccagtgctgcttccacaccctctcggtcatctcctcgatgggcacgttcttggtctccggcaggaagaagaggacgaagagcgacatgacgaggacccaggcggagaagaagacgaagatggcgtacttgaggtggcagagcatggagaggaaggcctgcgcgatgaccaaggtgaagagcangttgacgcagacggtgacgctctgccccgccgaacctggtctccagcggggaaggtctccgctgggggatgaagcagcccagggggccccccaggacccggcgaaaggagggagacgaaaggtgcagaacattggacgaccaaccctgatggccccagcccgtggggcccaaggtttgtccggaaatgggc

SEQ ID NO: 66291 - DNA, 461 bp, Zea mays
  misc_feature: Ceres CLONE 1538698
  misc_feature (196)..(196): n is a, c, t, g, unknown, or other
  misc_feature (231)..(231): n is a, c, t, g, unknown, or other
  misc_feature (232)..(232): n is a, c, t, g, unknown, or other
tggcggccgctctagaactagtggatcccccgggctgcaggaattcgtctcacccctagaaaaagtccgcttctcccctctcctcctcacgtcacgcaccccatctcttctctccccctctcgtctcgtccagtcgtccccctctcccccactctacccagctgccctggctctgcgtcgctcgccatggcgtccntccacggggaagcttggagcacggggggggttcanncgttcacgcccgccggccctttcattaacctccctttaacgaaagttggttcctccggggccagggggaaaatggctagggaacccggggccccaaattaaagaaacggggccctcccccaaaaggggggggttttttcccccccggggggcccccggggggggggggccccccaaaaatttaaaaatggtggggggggaaaaaaacccccccccaaggggtggggggg

SEQ ID NO: 66292 - DNA, 581 bp, Zea mays
  misc_feature: Ceres CLONE 1538707
  misc_feature: Encodes the peptide sequence at SEQ ID NO. 66293
ggcggccgctctagactagtggatcccccgggctgcaggaattcgtctcacccctagaaaaaactcctaagcgccgtcgcgatctgctgcggtggccgctgccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctcccgggtctcctcggacgcggagctccgcaagtacgcgggctacacgctgctgcttgtcggctgctgagccgcgacctactactccttcccgttccgcgccgacgcactgctcatgaaggccgtgccgttccggtacgcgccgctgccggaagacctacatgccgtctgcaactgggacggctcgcagaggtgcacacccgcgtctgctacagccgaatcgctcccgccctcaaggcgctctcgcggccgccacaggaacgccgcagcacagtcgcc

SEQ ID NO: 66293 - protein, 58 aa, Zea mays
  misc_feature: Ceres CLONE 1538707
MRHLLLSRFLRRGGGSGIPNGHYHHLPLLRALSSSPSRVSSDAELRKYAGYTLLLVGC

SEQ ID NO: 66294 - DNA, 852 bp, Zea mays
  misc_feature: Ceres CLONE 1538712-R
ttagcgtcttctgtttatgattttgcatcgcacgaataaactgtaatcaccggtagattactgtaggttcatcgacgggatgagtggaggatgcgatggaactccataagggagtagagaaaaaaaaaaaaaaaaatcaacgtctcgacggtgttcccgactagcactacagaaacgctaaggtctgattgcctgatgctccagcgacggtggatggccagcgactcgtcagataggcagccgttactcgcgcttcctgacaaggacgcacacctcccggctctgcaagtttccatgcgtccattggtgtcgcctcaacgctgcttcaagctttgcctcgcacaatgctaccgccactgcgttttgcccgttacttccatggatgaaaccactggtgacaaagcctatcggccatctgaacgcctcccgtgcgacgacatccgtaggctactggaggctgctcgtgctgggatcaaatacggagaagtggaactcacatgggactgaggaagctggagctcccattttgcgacgcattcttccacggctaccaatgatctgattttgcgaggtgacagatctggaagcaatgcggtaacacaatggttgcctcttagaagacacttccttgaaagctggatcataaacgtatgccacgcataattgcttcgcgagccaagtcatgtcaaccgggtcatcaggaactgggttagggttcatcggaatcgccctttggtgtctgagaaggacttcggattacttcttatcaaaatccttccacctattgggcttaaaattttggggtgggaggttggcaccagggaggtcccttggtaggcgaacaatttgcct

SEQ ID NO: 66295 - DNA, 601 bp, Zea mays
  misc_feature: Ceres CLONE 1538712
  misc_feature: Encodes the peptide sequence at SEQ ID NO. 66296
tgtggatcccccgggctgcaggaattcgtctcacccctagaaaaaaaccaaacaagtcggagaagcagccctcgcaaaaccctcccctcgatggccggtgtgccaccgccgccgcggcagctcgatgtgcggcgcttcgcggccgcccgcgccagcgaactccgctccctctacgcagccgtatcgtcccgactcgacgacgccggcggccggcatcagccccgttcggcgcgccgccgcaccacagggcacctacccagcaagcgccgccgccggggagccggagaggtgggccccggggatgacgatggcctcccggcgcggaaacagtccaggagggtgaggcggcggcgggagctcgctgccaaccccgcggaggggttctcggtcgccggcgacggtgcgcggcggctgcgcacgcacctgtggtatgcgaaaaggttctccatggagaggcggtggacattcatcttgcccgtcggcgcccaggggaagggtaagggctcaaggagtgttctcaagcgtctgaaaatgggacaactatccatgatgctggctacttcattccaatagagctggatggtcccaaagacgccctgtt

SEQ ID NO: 66296 - protein, 160 aa, Zea mays
  misc_feature: Ceres CLONE 1538712
  misc_feature (16)..(154): Pfam Name: POP1 Pfam Description: Ribonucleases P/MRP protein subunit POP1
MAGVPPPPRQLDVRRFAAARASELRSLYAAVSSRLDDAGGRHQPRSARRRTTGHLPSKRRRRGAGEVGPGDDDGLPARKQSRRVRRRRELAANPAEGFSVAGDGARRLRTHLWYAKRFSMERRWTFILPVGAQGKGKGSRSVLKRLKMGQLSMMLATSFQ

SEQ ID NO: 66297 - DNA, 615 bp, Zea mays
  misc_feature: Ceres CLONE 1538720
agctccccgcggtggcggccgctctagaactagtggatcccccgggctgcaggaattcgtctcacccctagaaaaagaaccaaaaacgatagagaaagagagcctgtcagcccaagaaaaggttcctcccctccttccccacctcgccctcagccctcatcatcctctaacatccgattgtgccctgtgctctgcggttctcggatccaagatttcgccggccggccgccggcggcggctccgggagcgggagaaagactggatttttcgggccatggaggcgtggcctgatcccgtcaggcccgggcggtggggtggctttctgagcaggtctgattcgtatcggtttcaatgatctccgcggcctggatgggtcgggtccgcttcccccggggggatcggaactagggccggtggttttttgggccggccgggggattcatcgggttcggggcctgggggggatctttgggggttgcggggttccaccacaaaaacccccagggcctgccaaaaaacccccctttttccctttccggggggggggattttgtaccacggcccaggggtttttgtggtgggggcccggggggggaaaaaaaaaaaattaaccca

SEQ ID NO: 66298 - DNA, 670 bp, Zea mays
  misc_feature: Ceres CLONE 1538722
  misc_feature: Encodes the peptide sequence at SEQ ID NO. 66299
tcaccgcggtggcggccgctctagaactagtggatcccccgggctgcaggaattcgtctcacccctagaaaaacctctctccccatccccgtctcgccgctagctttccctttccccctgctgctcctcccctccgtcctcctcctcaccctccccgcgggccgcgcgactcggcagccaagcaagcaacagcacaacacccccgcaccgccgccactcctctctctctctctctctctctctctctctctctctctctcgcaccaccaccatggcgtcgggcggctgcgctctcgccccgaggctatgactcggcgccgcccgtggccgtggctctccgtattctccgtctccccgcgacgacgacaacccctcctcctccgactccgactcctccctgggcggcggtgctagccagatgtcgacggcgctggcggtggtcgggggcggcaaggaccggccgtcgcccggcggcggcggggcgccgcaggtggacacgggcaagtacgtgcgctacacccccgagcaggtcgaggcgctcgagcgcgtctacagcgagtgccccaaacccagctcgctgcgcaggcagcagctcatcagggagtgccccatactcagcaacatcgagcccaagcagatcaaggtctggttccagaaccgcagatgccgc

SEQ ID NO: 66299 - protein, 84 aa, Zea mays
  misc_feature: Ceres CLONE 1538722
  misc_feature (29)..(84): Pfam Name: Homeobox Pfam Description: Homeobox domain
MSTALAVVGGGKDRPSPGGGGAPQVDTGKYVRYTPEQVEALERVYSECPKPSSLRRQQLIRECPILSNIEPKQIKVWFQNRRCR

SEQ ID NO: 66300 - DNA, 647 bp, Zea mays
  misc_feature: Ceres CLONE 1538729
  misc_feature: Encodes the peptide sequence at SEQ ID NO. 66301
agtggatcccccgggctgcaggaattcgtctcacccctagaaaaagttctccttcaccttctccctgctctgggtgtgggtgcgccctcccctgatacacttctccggcgctgacatgacgtccacggcgtactcgttgtcttccaagctgccgggcggcgagcggcggctgccaccccgcatcatgcgggggttggtgtgcaagatcgagtccataaaactgggcgtcggcctcgtcaccggctgctgcatcgggctcctcacataggtctacgatcgcaagatcttcgcaatctactcccctgtcttaattcggtcggccaagaagatcgtggctgatggcggaagaaacggtcggccgaagctcttccaaacccccccgtgtgtcggagacggtagacctatccccgccgaaaggatatcactaggcaggcggtcggaaaacaccccggaatccggcccaactgacgctgagggccgctaacgttcttccaaagacccccggccttggcagggaaaaccggccctcccaaagcaaggaaaaatgtcgggccgggatccctaataatcccggttttttgcccccccattaaggtaaaaagaggcgaaggaatcctggttgccaaaaaaccaacccacgagagccg

SEQ ID NO: 66301 - protein, 50 aa, Zea mays
  misc_feature: Ceres CLONE 1538729
MTSTAYSLSSKLPGGERRLPPRIMRGLVCKIESIKLGVGLVTGCCIGLLT

SEQ ID NO: 66302 - DNA, 662 bp, Zea mays
  misc_feature: Ceres CLONE 1538730
  misc_feature: Encodes the peptide sequence at SEQ ID NO. 66303
  misc_feature (284)..(284): n is a, c, t, g, unknown, or other
  misc_feature (390)..(390): n is a, c, t, g, unknown, or other
ctccccgcggtggcggccgctctagaactagtggatcccccgggctgcaggaattcgtctcacccctagaaaaagtgctttcttagacgtgggttggcttctcctccccctccggttcgggttctggttcgtgaggtatctcccgggttcggtttcatgggtgagcggatccagatggcgcgctcagatgtatgagtaccgctgcttcgtcggcggcctcgcctgggccacggatgaccatttcctctacaacgccttcatgacctacggcgaggtcctcgagntgaagatcatgctcgatcgggagacgcatacgtccggcggcttcggcttcgtcagcttctgcagggaggacgcgatgcggaacaccatcgagggcatgacggcaangagctggacggcccaacatcacggtcaagaggcccttcccccgtcggcctgaaggcggcgcgtgggtacgggggtgcccttgaagaggggcctacggggtgggggggcccccggggcgaccgcccctccgggggtgccccgggggaccccgggggacccggggggcccggggggggtggggcggcgcccacggggggggaaccgggggggggggccctcaggaaccccccccggaaaaggggagaaataaaggggggggtgccccccggaag

SEQ ID NO: 66303 - protein, 84 aa, Zea mays
  misc_feature: Ceres CLONE 1538730
  misc_feature (6)..(69): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (33)..(33): Xaa is any aa, unknown, or other
  misc_feature (68)..(68): Xaa is any aa, unknown, or other
MYEYRCFVGGLAWATDDHFLYNAFMTYGEVLEXKIMLDRETHTSGGFGFVSFCREDAMRNTIEGMTAXSWTAQHHGQEALPPSA

SEQ ID NO: 66304 - DNA, 598 bp, Zea mays
  misc_feature: Ceres CLONE 1538734
  misc_feature: Encodes the peptide sequence at SEQ ID NO. 66305
  misc_feature (319)..(319): n is a, c, t, g, unknown, or other
  misc_feature (326)..(326): n is a, c, t, g, unknown, or other
  misc_feature (327)..(327): n is a, c, t, g, unknown, or other
  misc_feature (568)..(568): n is a, c, t, g, unknown, or other
  misc_feature (569)..(569): n is a, c, t, g, unknown, or other
  misc_feature (580)..(580): n is a, c, t, g, unknown, or other
gcggtggcggccgctctagaactagtggatcccccgggctgcaggaattcgtctcacccctagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctnggtgggnnccttgtggtgcgtcgtcgaccgcatttcggtcctcaatcgggcctcccccatttattaattcgccaaaagttcccttccccgcccaaaaaaaaaaccccaggggcccccccccccccccccccccacatttttttttttcccccaaggggggcgggccttccacaaaaaaggaggggggggggcttttttttttttttttatcacccacaaaaaaaaatgcggggcgccctcctctttttnngaaaccacaanaaaaaaaagagagggtgg

SEQ ID NO: 66305 - protein, 96 aa, Zea mays
  misc_feature: Ceres CLONE 1538734
  misc_feature: SWISSPROT Homolog: EC 3.2.1.4 Cellulase
  misc_feature (75)..(75): Xaa is any aa, unknown, or other
  misc_feature (78)..(78): Xaa is any aa, unknown, or other
MYSANHWGGSFEIADGAAEDDHSRNMDLDRGALSARQHHELDETQQSWLLGPPEAKKKDKYVDLGCVVVKRKLLXVGXLWCVVDRISVLNRASPIY

SEQ ID NO: 66306 - DNA, 658 bp, Zea mays
  misc_feature: Ceres CLONE 1538740
  misc_feature: Encodes the peptide sequence at SEQ ID NO. 66307
ctggagctccccgcggtggcggccgctctagaactagtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgaaggcccgtcgtgacgccgcgccgatacagacaacaaaaagaagggtgttcaacttcggcaaggggcagagcgagggcaacaagacatgaaggaactgctgggcggcaggggcccgacctggcggaaaatggaaacatcgggcttccgggccccccgggttcacggggtccaaggaaggttgccccca

SEQ ID NO: 66307 - protein, 90 aa, Zea mays
  misc_feature: Ceres CLONE 1538740
  misc_feature: SWISSPROT Homolog: EC 2.7.9.1 Pyruvate, phosphate dikinase
MAASVSRAICVQKPGSKCTRDREATSFARRSVAAPRPPHAKAAGVIRSDSGAGRGQHCSPLKARRDAAPIQTTKRRVFNFGKGQSEGNKT

SEQ ID NO: 66308 - DNA, 658 bp, Zea mays
  misc_feature: Ceres CLONE 1538741
  misc_feature: Encodes the peptide sequence at SEQ ID NO. 66309
acccgcggtggcggccgctctagaactagtggatcccccgggctgcaggaattcgtctcacccctagaaaaagcaaaacaaaacaccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggacgtggacgggcacccggtcctgctggacgtgccagccaacatccgtctcaccccggcgtcgacgctcgtgcccgccgcggacgtccccgcagcgggcggcggcagcttcctcggcttctacacggcggcggccgagagccagcacatggtgcccgtcagagagctccgtgacattcggttcatgagcatcttccgtttcaaggtgtggtggactacgcactgggtaggggacagctgcacggacgtcgagaactagacgcatatgatggctgctcgaccgctcctgcgggcaatgccgtctgtctgcagccgaactttacgtgctgctgctacccatcatc

SEQ ID NO: 66309 - protein, 121 aa, Zea mays
  misc_feature: Ceres CLONE 1538741
  misc_feature: SWISSPROT Homolog: EC 2.4.1.67 Galactinol--raffinose galactosyltransferase
MAPNLSKKTPAGLLGDEVAPVEGLKPSRFTLKGKDLDVDGHPVLLDVPANIRLTPASTLVPAADVPAAGGGSFLGFYTAAAESQHMVPVRELRDIRFMSIFRFKVWWTTHWVGDSCTDVEN

SEQ ID NO: 66310 - DNA, 660 bp, Zea mays
  misc_feature: Ceres CLONE 1538745
  misc_feature (516)..(516): n is a, c, t, g, unknown, or other
  misc_feature (517)..(517): n is a, c, t, g, unknown, or other
ctggagctccccgcggtggcggccgctctagaactagtggatcccccgggctgcaggaattcgtctcacccctagaaaaagaaacacacagccgtgcttctgtgtatgatcagtgctctggcgcctacaagctctacttcaagatggggcactcgtcgatggcgttgtcgctctaccgcgaccaattcttcgcctttccatcggccggaaccactcaggctgggcagctcagctccatcacccacctctgcactagcgcaattccgatcacagacaacccgtcccgcttggcggcggagacaaagagagcgcaaagcgctcggaaacggacgctatcttgctccacaagttcactctcgcgttcaaaactaagaccatgtagttattctactaccatgactaagaccagtactccgagcggttagcgcgctctccggcgccaggtgctgatggcgtccttgcctaacagccagtggtcctgctgaagcacgacattctaatcatagcctaccggtnnggaaaaggggaaaagcccctgtaacactataacccagttaaaccttaagaagcgtcggctccgaactccaagtaccttgccaccgttcctggccatgggagacagagtgcgacatttgccctcttaaattgtcaattgacgaa

SEQ ID NO: 66311 - DNA, 597 bp, Zea mays
  misc_feature: Ceres CLONE 1538746
  misc_feature (568)..(568): n is a, c, t, g, unknown, or other
tggagctccccgcggtggcggccgctctagaactagtggatcccccgggctgcaggaattcgtctcacccctagaaaaaagcaaagcacctccgactccgagtcgcgagagccttctcattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagaacagaaattggactcattcagtagatggagatgactccntctgggcgagaaactgtggtaaaggtaaa

SEQ ID NO: 66312 - DNA, 1085 bp, Zea mays
  misc_feature: Ceres CLONE 1538747-R
ccaattgggtacctcgagcgccccccaggtcgacggtatcgacaaagcgcgtaatctaagccgtggaaaatggtattgctatattttctgaaaaaattaggtacacaacttgagataccgatccccagaaaaatccatagaaatgtatccttcgggaatgaagagtgtggtcctgtttgtgtataagccagtcgcatgattctcaatgagtgtagctattcacgctgcacagtaacagctcaaattcacctgaatatgtacatcctacctcaactgcggctgtttgcatatacttttgtttcttctgctacctttgtccatatgggagcaatatgatccgaaaatgtggcctgatccccaaagaaagccttttaaaaatcatcccccaaatttttgggcgccttttcccaacccccacaccttctaattttccattaacgggttattttctccaattactgcgggtatcctggcccctttcccggaagaggggcgtaaagggggtgtaccgcccctcccccattatttttttgtttatttccaccaccatttgttataggttgcaacaaattttccttttgagattggcaaccaaaatggttttttttgcgcatacctcttcccccgaggaggcggaccttttataacaggactttatccccttcccaaaaatctgccgctcaccctatttatcttcttttttagaatataaaacactctcgcatatctcgccccccgcggcgcgatggtcgatgttgctcgccctcccctgcggtttgtgagaaactgctacaataaaaccgagcgtatttgttcctctcctctcaccccgcgaggcgcaacgtcctgtaatagacaataaatacagagattatctctttgggggggcaaaaacactcttgttgttcttcgtggtaaacacataacaaaacaactgctggggacaacaatttcccctgtgtggagaagactctattatgtgataaaacaacaaccccactgggtgtgtgtcccaccattattctctctgcggggaatataacaccaccccggtcgttgttgctaaacactccgcgcggggtgtt

SEQ ID NO: 66313 - DNA, 658 bp, Zea mays
  misc_feature: Ceres CLONE 1538747
ctggagctccccgcggtggcggccgctctagaactagtggatcccccgggctgcaggaattcgtctcacccctagaaaaagtcagattttattctttccactatcttaatcgctgaaagtggaattgataggctgataggtactgtctagtgggagactcgtcacaggtttagagagagagacagagaactagtgatggagaggaggatgggttacagttccactggaccggtgagctggttcgtggtgccggatctggacatcgaccagttagaacggagggacgtctctggacgacgatgactacgatctggtgtatgaagcgcgcggtcctgtggcttccggtgagggtctgcgtcgagcacagtcccgtgagctacacctgtgctgacatcaaatgctgtgtccgagcctagcatgcagcgtagcgcgctatcggatccgcgcggaagattggctgctgtgatagctactaatgctacggctgtctatgaaggtgacttagtgatgcaatgtcaggagctgttgtgaactgcgtgaatatttggctatacgccaagacatagcataactccttgaacactctttgtacaaggttgggatggtgaaacaatattctagggcctagcctaaaaatggctgaatatattggccagaa

SEQ ID NO: 66314 - DNA, 670 bp, Zea mays
  misc_feature: Ceres CLONE 1538748
  misc_feature: Encodes the peptide sequence at SEQ ID NO. 66315
  misc_feature (639)..(639): n is a, c, t, g, unknown, or other
ctccccgcggtggcggccgctctagaactagtggatcccccgggctgcaggaattcgtctcacccctagaaaaactcttccgcggttccgccatcgcgtcgcgaacggcggccagaaaaaagaaaaagaaaaaaaaaaacagctcgccgcaccaatctcccctaccatatcgatcgaccctgcaaggtttaatccaacagaattccaccggaaatttggtgaagtgctaatcgcttgcggcttgcctgcccggtctcgtggctttgtgctgctcccgctgtggtgagggaccctaggatggcgggggtttcgatggcggcggcgcctgagggggtgctgcaccgccggattgagtttcatcttgcacggagaccgcatggctctgtggcggtgggcggcggcgggttccggatggagacgctgaacccggacgccgctggtaaggtggggcccggagaggctgtcgggagcagctagggggatgcgatgaggccggataagggagacagtggcgcgatcgatctggagctcagcgtcgcaaggatctacctcgggagaattggtgctggattgagaaatacttggactacctgctatctcaactcagttctgcaatgcttgacgtacacggaagcgttncgctgactatttgcagaggcggaagacacgc

SEQ ID NO: 66315 - protein, 59 aa, Zea mays
  misc_feature: Ceres CLONE 1538748
MAGVSMAAAPEGVLHRRIEFHLARRPHGSVAVGGGGFRMETLNPDAAGKVGPGEAVGSS

SEQ ID NO: 66316 - DNA, 672 bp, Zea mays
  misc_feature: Ceres CLONE 1538749
  misc_feature: Translation starting site: 119
  misc_feature: Pfam Name: IlvN Pfam Description: Acetohydroxy acid isomeroreductase, catalytic domain
  misc_feature: SWISSPROT Homolog: EC 1.1.1.86 Ketol-acid reductoisomerase
tccccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgaggagggatctgttctcgctgtgaccggaggccttcgagggaatcaaacagatcggtgtaatcggctggggctcgcagggtcctgcgcaagctcagaacttgagagactcacttgttgaggcaaagtcagatattgttgttgagattgctctccaggaaggttctgaatcttttgaagaagcccgagcagcaggattcaccgaacagagggcgacgctgggtgatatatgggagactgtatcaaacagtgatcttgatttgctactgatatctg

SEQ ID NO: 66317 - DNA, 701 bp, Zea mays
  misc_feature: Ceres CLONE 1538751
  misc_feature (213)..(213): n is a, c, t, g, unknown, or other
  misc_feature (237)..(237): n is a, c, t, g, unknown, or other
  misc_feature (255)..(255): n is a, c, t, g, unknown, or other
  misc_feature (268)..(268): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (310)..(310): n is a, c, t, g, unknown, or other
  misc_feature (312)..(312): n is a, c, t, g, unknown, or other
  misc_feature (328)..(328): n is a, c, t, g, unknown, or other
  misc_feature (333)..(333): n is a, c, t, g, unknown, or other
  misc_feature (340)..(340): n is a, c, t, g, unknown, or other
  misc_feature (348)..(348): n is a, c, t, g, unknown, or other
  misc_feature (349)..(349): n is a, c, t, g, unknown, or other
  misc_feature (356)..(356): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (432)..(432): n is a, c, t, g, unknown, or other
  misc_feature (448)..(448): n is a, c, t, g, unknown, or other
  misc_feature (463)..(463): n is a, c, t, g, unknown, or other
  misc_feature (471)..(471): n is a, c, t, g, unknown, or other
  misc_feature (481)..(481): n is a, c, t, g, unknown, or other
  misc_feature (500)..(500): n is a, c, t, g, unknown, or other
  misc_feature (548)..(548): n is a, c, t, g, unknown, or other
  misc_feature (563)..(563): n is a, c, t, g, unknown, or other
  misc_feature (597)..(597): n is a, c, t, g, unknown, or other
  misc_feature (601)..(601): n is a, c, t, g, unknown, or other
tccccgcggtggcggccgctctagaactagtggatcccccgggctgcaggaattcgtctcacccctagaaaaactctttggagccacctcacgcgccggagccttctgctcctccccggcggcggtggtcaggacctatccccggtactggcgctcgccttcaaggagttcgggccccccttctttatcctgcgggagcccgagaagaaaacncgccttcgggggcttgacccgcanaacggcaaaatcacctcngccaaggccctcncgcggatcctcggaaggttggtgggannnaggggtttggacnanatgggcgagtcccccnacggnaacgtcntcttcccnnatgatgnaccgacccnnntggagcagatgggtgtttgacggcggggtggggggaccctgacccnnnacctggtcccctagtgnggagggtttaaatccngggatggaaccaccnagggtggntgttcttggncaggggcgtcttcttctancccggctgagaaagcttggtggcgcggtgggtattcaccccgatttantgttgacttgaaggntattagagagggagtcgaaagggtgcgcttttgnaccnaccctagaagcatatgagccccaaaacgctctggatgtttgggcgaaaaccgggagtggaaacccctggggcccgaaacccggcccgtgcatgatctttc

SEQ ID NO: 66318 - DNA, 728 bp, Zea mays
  misc_feature: Ceres CLONE 1539147
  misc_feature: Translation starting site: 70
  misc_feature: SWISSPROT Homolog: EC 3.6.4.3 Microtubule-severing ATPase
  misc_feature (680)..(680): n is a, c, t, g, unknown, or other
ccgcggtggcggccgctctagaactagtggatcccccgggctgcaggaattcgtctcacccctagaaaaatgctcagggaagagttgcagttgcttcaagagcctggctcatatgttggtgaggtggtgaaggtcatggggaaatcaaaggttctggtgaaggtacatcccgaaggcaaatatgtggtggatatagaataaaacattgatatcactaagatcacaccttcaacaagaattgctccttcggaatgacagctatatgctccatcctgatcctaccaagcaaagttgatcccattggtcaatcctcatgaaagttgagaaggttccggattctaccctatgatatgattggaggccttgaccagcaaattaaagaagatcaaagaggtcattgagcttccaatcaaacatcccggaactgtttgagaagccttggaattgcgcaaccaaagggtgtcccttcctttatggacctccgggcacaggaaagacattgttggcacgtgcggttgctcatcacactgactgcaccttcatcagggtgtctggttctgagttggttcagaagtatattggtgagggctcccggatggttagggaactctttgttatggccagggaacatgcaccatccattatatttatggatgaattgactctatcggatctgctanaatggagtcctgaaactgcaacggtgacagtgaaagtcagcgtactat

SEQ ID NO: 66319 - DNA, 711 bp, Zea mays
  misc_feature: Ceres CLONE 1539151
  misc_feature: Encodes the peptide sequence at SEQ ID NO. 66320
  misc_feature (379)..(379): n is a, c, t, g, unknown, or other
  misc_feature (393)..(393): n is a, c, t, g, unknown, or other
  misc_feature (399)..(399): n is a, c, t, g, unknown, or other
tccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtactagaggtacaagaaggaggagaaggagcacaagcacaagcagcacctctgtgaggccggcgccatcggcgggggcgccttcncactctacaaaaancaccangcgaagaaggaccccgagcacgcgcacaggcacaagatcacggaggaggtccctgccgcggcggccgtcggcgcctgcggctacgtatccccaagcacccgagaagaaaaaggaccccaaggaccccaagaaggctaccggcgagaaaaaacaccaccccctctttcgctgaccggaataccggccggcgcgcgaccgaactagctaactcccgggcacaaaaaccaacccctggtttaattcgccacggcaagcgggggctaatttaagggcgccaaaaaaggagcccccccccgggaccttggtaaccgc

SEQ ID NO: 66320 - protein, 40 aa, Zea mays
  misc_feature: Ceres CLONE 1539151
MSEEKHHHFFNHHKKDEEQPAGEYGYSETEVVTATGEGEY

SEQ ID NO: 66321 - DNA, 761 bp, Zea mays
  misc_feature: Ceres CLONE 1539152
  misc_feature: Translation starting site: 148
  misc_feature (1)..(1): n is a, c, t, g, unknown, or other
  misc_feature (245)..(245): n is a, c, t, g, unknown, or other
  misc_feature (313)..(313): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (413)..(413): n is a, c, t, g, unknown, or other
  misc_feature (435)..(435): n is a, c, t, g, unknown, or other
  misc_feature (443)..(443): n is a, c, t, g, unknown, or other
  misc_feature (444)..(444): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (479)..(479): n is a, c, t, g, unknown, or other
  misc_feature (480)..(480): n is a, c, t, g, unknown, or other
  misc_feature (487)..(487): n is a, c, t, g, unknown, or other
  misc_feature (521)..(521): n is a, c, t, g, unknown, or other
  misc_feature (522)..(522): n is a, c, t, g, unknown, or other
  misc_feature (627)..(627): n is a, c, t, g, unknown, or other
  misc_feature (656)..(656): n is a, c, t, g, unknown, or other
  misc_feature (664)..(664): n is a, c, t, g, unknown, or other
nacgcctggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcctctctcttcggcgaggcccgcgtgacgatgcncaagacggcggcgaaggcaaagccggcggcgagctccggcagcccgtgggagggccccgaccgcgtgntctacctgtgcccgctgtccggcgcgcccccgagctacctgattttccccccccccggggagggagagggggagnnnnnnnnnntnnncnncnnaccccntaaattttctacaataaacagntatctggnngtcgtcggggtccccctgggccatgctgggnnncnnttggttncctggttcccggaactgccccccccacaacgganntcaaattcgggcaaggccgtgtggtttcagaggccggggtcccaaattcttaagggaagggggggcctggcctacccccggaaatcctgaactttattccaggcnaaaaaaatttttttcgtattctggggccnggccagtntcggggcacaaggaagcgacatgtaatgagaacaccgctccgtccggtgaggagctgttaaagaaagatcatcttacgcccacctccaccccaggcg

SEQ ID NO: 66322 - DNA, 796 bp, Zea mays
  misc_feature: Ceres CLONE 1539158
  misc_feature: Encodes the peptide sequence at SEQ ID NO. 66323
  misc_feature (577)..(577): n is a, c, t, g, unknown, or other
gctctataactcgtggatcccccgggctgcaggaattcgtctcacccctagaaaaactctctgtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcaaagcctggcgctgagtttcctaatgccggccgctggtacaaaaacatctctgccgctgtagccagcgggaggggcgtggtaaaggctggttggtgaacaccccccccacggggatcagcttcctcgccgcagcctgctcctagtgtaagtaaggcctaataatcgatcaatggaccctggattctcttttggtgggacgaagaactgatcgcggtaacacctaattgcaccgttttaaagtatcgcgtgtgagtgggcccgctcaaagggccctctttctacaaaagaaaaaggagnagtgggggtagactctcttccccccccctcattgcgacggtctatacacccgggcctccgaccaacgatcgtacacgcaatcaaatcctataatatgtgctttgggtcccagcatggcgtgagtggtgaaggtcgaggactttgagtgaagcaaataacagctctaagctcgctctaccctcccgcatcaccggaagggcgaccgatgacgggcacgac

SEQ ID NO: 66323 - protein, 75 aa, Zea mays
  misc_feature: Ceres CLONE 1539158
  misc_feature: SWISSPROT Homolog: EC 2.5.1.18 Glutathione transferase
MAVFSDLHTADGLKSLEAHLAGKTYVSGDSITKDDIKVFAAVPSKPGAEFPNAGRWYKNISAAVASGRGVVKAGW

SEQ ID NO: 66324 - DNA, 632 bp, Zea mays
  misc_feature: Ceres CLONE 1539160
  misc_feature (195)..(195): n is a, c, t, g, unknown, or other
  misc_feature (261)..(261): n is a, c, t, g, unknown, or other
  misc_feature (262)..(262): n is a, c, t, g, unknown, or other
tggcggccgctctagaactagtggatcccccgggctgcaggaattcgtctcacccctagaaaaagcacgcgcacgcgcatcccggcagtcagtagcgcagctgcctctcctctctttgccccccggagccggagcaagagcgccgccaacagctcgctaccggcgcccgtgtcatgggcggggggctgggagacnagggtgggacctaccgtcttttcaagggggggggggctttgaattttggggggaaactttcctcgnngggggtggggaaggggcaaaaatacttccccccctttttcccccaaaaaagatttattccctccaaaatccaaagggccccccttgggggggaaatttttaaaacacccccccttcttttttcaaaaggagggtggggggccccatttttgggcaccccccccccggaaaaagaaacaacagggggggaggggtttttttttaaagagggggggggggggttttttttttttttttttattttttttcacaccccgaggtttttttttttttccccccccgcgggggggaagaaacccccccccccccccgcgccaaaaaaaaaaaaatttattttttttgtgtgtgtgggaaaaaaaaaaaaaaatcaa

SEQ ID NO: 66325 - DNA, 727 bp, Zea mays
  misc_feature: Ceres CLONE 1539162
  misc_feature: Encodes the peptide sequence at SEQ ID NO. 66326
  misc_feature (727)..(727): n is a, c, t, g, unknown, or other
ccccgcggtggcggccgctctagaactagtggatcccccgggctgcaggaattcgtctcacccctagaaaaaactgaaaagaccccacgaacttttactctagccctcccggctcccagggtctctcttcggcggcggcgatgtctctccccccggacccggcgggcggcggcgccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaacaccaatgatgttttcaaggagcccaatgatgtcttcaaggagcctggcagcaataagcgtttgaggtcaggatccaatgatgtgcatgtgccaacatctaaagcttctagggaaaaaatgaggaggaacaagctgaatgacaggttccttgaattggggtctacattagaaccagggaagccagtaaaagctgacaaagctgctatcctaagtgatgctactcgcatggttattcagcttcgttcagaagcacagcagctgaaggaaactaatggtagtcttgaagaaaagatcaaagaactcaaggccgagaaggatgaacttcgtgatgagaagcagaagctgaaattggagaaggagagtttagaacaccagatgaagctgatgacatcgactccaacctacatgcctcn

SEQ ID NO: 66326 - protein, 195 aa, Zea mays
  misc_feature: Ceres CLONE 1539162
  misc_feature (88)..(139): Pfam Name: HLH Pfam Description: Helix-loop-helix DNA-binding domain
MSLPPDPAGGGAGTGTGDDWFLDCGILDDLPAAACGAFPWDASPSSSNPSVEVGSYVNTNDVFKEPNDVFKEPGSNKRLRSGSNDVHVPTSKASREKMRRNKLNDRFLELGSTLEPGKPVKADKAAILSDATRMVIQLRSEAQQLKETNGSLEEKIKELKAEKDELRDEKQKLKLEKESLEHQMKLMTSTPTYMP

SEQ ID NO: 66327 - DNA, 630 bp, Zea mays
  misc_feature: Ceres CLONE 1539171
  misc_feature: Encodes the peptide sequence at SEQ ID NO. 66328
  misc_feature (47)..(47): n is a, c, t, g, unknown, or other
  misc_feature (393)..(393): n is a, c, t, g, unknown, or other
  misc_feature (409)..(409): n is a, c, t, g, unknown, or other
  misc_feature (455)..(455): n is a, c, t, g, unknown, or other
  misc_feature (456)..(456): n is a, c, t, g, unknown, or other
accgcggtggcggccgctctagactagtggatcccccgggctgcagngaattcgtctcacccctagaaaaactgctggtactgctcctctctttcgacaagttcctcttccactacctgaagcgccgctggttctccggcggcagcggcgccaccgtcccaagggcccccgccaaatcgaggcggaacatggcggccgccaagtggagcgagacggccatgctcgttatcgacatgcagaaggacttcgtggacccggcgatgcgcagtccgatgctggtagccggtggcgaggccgtcgtccctgccgttgccggggccgtcgccgtcgcaagggagcgcggcattttcgtcgtctgggttgtcagagagcatgacccttctggaagagatngtgaacttttccgtangcaccattattctgggggaaaggtccaacagtgaaaggtctgaaanngagcgaactgcctgatgggctttgtatcaaagaaaggggaatacaagtgggtgaagacagatttaatggctttcttcccaccccatcttgatttctgtcctgaaaactggcaggaataaagaacttggttattgtttggaagtcaaaaccccaaattggctttcgggaaaatgg

SEQ ID NO: 66328 - protein, 84 aa, Zea mays
  misc_feature: Ceres CLONE 1539171
  misc_feature (69)..(69): Xaa is any aa, unknown, or other
  misc_feature (74)..(74): Xaa is any aa, unknown, or other
MAAAKWSETAMLVIDMQKDFVDPAMRSPMLVAGGEAVVPAVAGAVAVARERGIFVVWVVREHDPSGRDXELFRXHHYSGGKVQQ

SEQ ID NO: 66329 - DNA, 725 bp, Zea mays
  misc_feature: Ceres CLONE 1539177
  misc_feature: Encodes the peptide sequence at SEQ ID NO. 66330
  misc_feature (614)..(614): n is a, c, t, g, unknown, or other
acccgcggtggcggccgctctagaactagtggatcccccgggctgcaggaattcgtctcacccctagaaaaatctcccgcagagccgccgacaactctctctaccgtaccgataccccaagcaccagcgcggcggcggcgaccatggctgtcagagagaacaagaggatctccaagggaaagaagggtggcaagaaaaacaccgtccaccctttctctaagaaggattggtatgacatccaagcaccgtctgtgttcagtgtgcgcaacatcgggaagactctcgtatccaggacacagggtaccaggattgcttctgagggtctgaaccacagagtctttgacgtttgcctacctgatcttcaaggcgacgaggatcaggcttactggagaatccggctccgtgctgaacatgtgcagggcaggaatgtgctcacaaacttttggggtatgaattttaccactgataaactgagatccctagtgaagaagtggcagacattaatcgaagcccatgttgatgtcaagacaaccgacaactacatgttgcgtttgttctgcatcgggttcacgaagaggcgcccaaacccggtcaagagaacctgctatgctcangcatcccacatccgtcagatctgccggaagatggttgagaatatgaatcacccggcctctacatgtgaccttgaagagcttgtttccaaattcattcccggaagtaattgg

SEQ ID NO: 66330 - protein, 194 aa, Zea mays
  misc_feature: Ceres CLONE 1539177
  misc_feature (11)..(192): Pfam Name: Ribosomal_S3Ae Pfam Description: Ribosomal S3Ae family
  misc_feature (157)..(157): Xaa is any aa, unknown, or other
MAVRENKRISKGKKGGKKNTVHPFSKKDWYDIQAPSVFSVRNIGKTLVSRTQGTRIASEGLNHRVFDVCLPDLQGDEDQAYWRIRLRAEHVQGRNVLTNFWGMNFTTDKLRSLVKKWQTLIEAHVDVKTTDNYMLRLFCIGFTKRRPNPVKRTCYAXASHIRQICRKMVENMNHPASTCDLEELVSKFIPGSNW

SEQ ID NO: 66331 - DNA, 758 bp, Zea mays
  misc_feature: Ceres CLONE 1539179
  misc_feature: Encodes the peptide sequence at SEQ ID NO. 66332
  misc_feature (758)..(758): n is a, c, t, g, unknown, or other
tccccgcggtggcggccgctctagaactagtggatcccccgggctgcaggaattcgtctcacccctagaaaaaagccgcacaatccatccatccatctattctccagtccacccattccattccactaccgacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcatcggggtcgtgttccagcccttcgaggagatcaagggggagctcgccctccccccccaatccccagacaagtcgctcgcgcgccacaagttcgtcgaggactgcgaggccgcccctcacgagcagatcaacgtggagtacaacgccctcgtatgcataccactcccctcttcggctaatttcaaccgcgacaccgtgggctctcaaagggatttggccaggtttcttcaaggaattccccgacgagggagaggtaccccgtttgacaagctcaatggagtaccagaaacaaaaggggaaaggcgggaaaggcttcaaatcgagtggaaacggcctttaacccaaggtttaaccacccctgaaaaacggggaggcctcggaacccccatgcggggttgtgtttcgggaccctgn

SEQ ID NO: 66332 - protein, 192 aa, Zea mays
  misc_feature: Ceres CLONE 1539179
  misc_feature: SWISSPROT Homolog: EC 1.16.3.1 Ferroxidase
MMLRVSPSPAAAVPTQLSGAPATPAPVVRVAAPRGVASPSAGAACRAAGKGKEVLIGVVFQPFEEIKGELALPPQSPDKSLARHKFVEDCEAAPHEQINVEYNALVCIPLPSSANFNRDTVGSQRDLARFLQGIPRRGRGTPFDKLNGVPETKGERRERLQIEWKRPLTQGLTTPEKRGGLGTPMRGCVSGP

SEQ ID NO: 66333 - DNA, 806 bp, Zea mays
  misc_feature: Ceres CLONE 1539184
  misc_feature (388)..(388): n is a, c, t, g, unknown, or other
  misc_feature (392)..(392): n is a, c, t, g, unknown, or other
gcggtggcggccgctctagaactagtggatcccccgggctgcaggaattcgtctcacccctagaaaaatactcgtctccacggaatcgatcgatcggtgctttgatctctgagcctgagcaagcggtcgagctcaccaaccgccacgctcaagacaggtcgagtagctagctagctgccggagtggaaaaggaggcggtgcactggcctggggaggccgccgtgctgctacaagatgggggtgaagaaaggcccgtggacccccgaggaggacctcatgctcgtgtcctatgtcccaagagcacggtcccggtaaatggcgcgccgtgccaaccaacaccagttgtgtaaagaaccaaccgggggagggggggggtagaagacacaanaaanaccaccccccccctcgttttatagattctacttcccaacctcacctgaatttttgcgctccgccctctagtccacgtcgaggccgtggcctgcacttgtgtctatcgccacaagactctacgcatccaccaagatcgttccattcttcgcaagaccactccctccgctccagcttcgacacaccccactacggctccagttctatctcagccccggcgcaaaacactctgcgagggccggccgtcccgatgcttccgcccttaggaaatattattcaccagatcccgcgtctctgtcaacagtcacgtgcttataactgtctctcgcgcccgcaacgagcggctcctcaccccccgtgtgatctaccgtgctctgccagagaaggctacttaatccgccctccctcctccgagg

SEQ ID NO: 66334 - DNA, 701 bp, Zea mays
  misc_feature: Ceres CLONE 1539188
  misc_feature: Translation starting site: 308
  misc_feature (383)..(383): n is a, c, t, g, unknown, or other
agctcaccgcggtggcggccgctctagaatagtggatcccccgggctgcaggaattcgtctcacccctagaaaaacccaagacacagagcgtcagagcccgatcccgatccagcgaggcggcgaccctccctcctccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaggcgtgcagcttgcancgagggttatcgttgccatcgagaacccgcaggacatcatcgtccagtccgcccgcccctatggccagcgtgctgtcctcaagttcgctcagaacactggcgctcatgccatcgctgggaggcacacccctggtaccttcactaaaccgctccagacctccttccgcgaggctcggctgctccatccttaccgaacccagggactgaacctctagcccattaaaggagcctgctcctggggaaacatcccccccattgcctttccggggaaactgactctcccccatgcggaatggaccaaatccgcttccccaccga

SEQ ID NO: 66335 - DNA, 691 bp, Zea mays
  misc_feature: Ceres CLONE 1539189
  misc_feature: Encodes the peptide sequence at SEQ ID NO. 66336
cgcggtggcggccgctctagaactagtggatcccccgggctgcaggaattcgtctcacccctagaaaaacactcgcggcttctgagcatctacctgcacttcttcaattacctgcagctttcatcgtatttcctttgcattgcataccgtgcagccacctctgcacatgatgtttcggatgttatcttattattaaaaaactagatttactcatgtttttcttcctctgtcattattgctgatatggtaactaatctttctgtggggtttatgcactgttaatttttccctgccattttacgtctaatttgtattcgacactctcatcgtactaactgcctcataggttttgtgcccactggatacatctctatcgactccaagtccaaggcactgcaccaaccttttgatatcaggttttaaaccggctttagcaattgtacacatggatcaatttgtggcaggggaaattagagcacatttctgtgcttttttttttccaacacatctgccacactagtatcatcagcaattgtccatcgcagcataaatctctttctcatcgtcgatggacgtgggtatagtaccagacaacatggcaacgacagacatgccaagctccggcatcctgctgacgcctgctggggccatcagcctgttctcgtcgggtcctccgctccagatgccgctt

SEQ ID NO: 66336 - protein, 41 aa, Zea mays
  misc_feature: Ceres CLONE 1539189
MDVGIVPDNMATTDMPSSGILLTPAGAISLFSSGPPLQMPL

SEQ ID NO: 66337 - DNA, 730 bp, Zea mays
  misc_feature: Ceres CLONE 1539190
  misc_feature: Encodes the peptide sequence at SEQ ID NO. 66338
  misc_feature (377)..(377): n is a, c, t, g, unknown, or other
agctccccgcggtggcggccgctctagaactagtggatcccccgggctgcaggaattcgtctcacccctagaaaaaatcggcgcatcaaccaccccttccgctcatcctcttccctcccaccgattcgcccgctggctcgccgcccgcccgtagcctgcgcccgctcgagatctagaccagacgccgcagccgcggccgcgggctgacaggatctctgtcctccctacgcggcgaaccgctaggacggcgccgaagacgacgagggagacggggtcatggaggcgtcttcctgggacgcccttcgcaagcaggcacggaggttggaagctcagttagatgaccaaatgatcgcataccgtaaattggtttctatganatcagatggttcaaagaatgacccccactctgatatagaaagatcactgaagcagttgcagcaagtaaattcgcaaatgcaaacttgggtatcatcaggaggttctgaagttctttctcatactctgactcgtcatatggagattttggcagaccttactcaggaattctatcggcttcgatcaagtctcagggtgaaacaacagcatgcttctctccttgacctgagagattttgaccgagcaaagtttgatgttgaaaaaccatcaaactccgctgatcaaggctccttctccaggaacaacctgccattggccggagtactggaacgatggataacgggatacccaagcc

SEQ ID NO: 66338 - protein, 151 aa, Zea mays
  misc_feature: Ceres CLONE 1539190
  misc_feature (34)..(34): Xaa is any aa, unknown, or other
MEASSWDALRKQARRLEAQLDDQMIAYRKLVSMXSDGSKNDPHSDIERSLKQLQQVNSQMQTWVSSGGSEVLSHTLTRHMEILADLTQEFYRLRSSLRVKQQHASLLDLRDFDRAKFDVEKPSNSADQGSFSRNNLPLAGVLERWITGYPS

SEQ ID NO: 66339 - DNA, 702 bp, Zea mays
  misc_feature: Ceres CLONE 1539191
  misc_feature: Translation starting site: 187
  misc_feature (366)..(366): n is a, c, t, g, unknown, or other
  misc_feature (398)..(398): n is a, c, t, g, unknown, or other
  misc_feature (404)..(404): n is a, c, t, g, unknown, or other
  misc_feature (542)..(542): n is a, c, t, g, unknown, or other
tagctggagctccccgcggtggcggccgctctagaactagtggatcccccgggctgcaggaattcgtctcacccctagaaaaactgctccaattcccaaagcttctggaaaacacctactcgtctctcatcccttccccgccgtcgcgtcctcttcgaactgaatcgcgccgcgatcacccaccttatggcggacaaggagcctgtcgtggagcgatccgaggcgtctgaggaggaggacgcctccgccgcggccgccgcgggggaggaagaggacacgggtgcccaggtggcccccatcgtgcggcttgaggaggtactcgtcaccaccggtgaggaggacgaagacgtcctgctcgacatgaangcgaagctgtaccggtttttgataagacgggnaatcantggaaggaacggggcacggggcaccgtcagctttctcagaacaaggagaccggcaaggtccggactcgtcatggcgcaagcccaagacgctttagaatctgcgcgaaccacctcgctgccccccacccccaaaatgcnggaaatggccggcagcgacaaatcgggcgtctggccacccttctgacttttgcggaaggcgaatccagggagaaaagtttgcccatcaggttggggtcgcgagaaaaatgcaaaatttcagggagttggtagagaaaattctaaaccccttcaggaaaga

SEQ ID NO: 66340 - DNA, 728 bp, Zea mays
  misc_feature: Ceres CLONE 1539194
  misc_feature: Encodes the peptide sequence at SEQ ID NO. 66341
  misc_feature (1)..(1): n is a, c, t, g, unknown, or other
  misc_feature (381)..(381): n is a, c, t, g, unknown, or other
naaagctggagctcaccgcggtggcggccgctctagaactagtggatcccccgggctgcaggaattcgtctcacccctagaaaaaatcgaatcacgtgacttctcctccccttctcccctctccgctccatcgtcaaggaaggaacacgggcctaactaaaccctagctaatggaagggaaacaggaccatgaatgcctccgagctccgcgagctacgagacttcgtcgaggcgtgcaacaagaatccttccctcctcagcgaccccgacctctccttcttcagggattacctccagagtttgggtgccaaaattcccgccaccgccccctctttctaaaggcccaagagatcttccatttacgacattgatgatgaaggngatgacgaagaccattagaatactacggatcccacacccgatcgagactagctcgatgaagatattgctgattctgatcttgagctcgaaggataaattgtacagtctgaccatgatgacccaccacagaatatgggaaatccttcagtggatgtgactgaggaaaaccgtgatgcttcccaagaagcataaggctgggctatggtagcaatttctgaaggaaaacttgaagatgctattgaacaacttagctacgcaatagtgctgaatccactctcagcagtcatgtatggtactagagcatctgtgtttataaagatgtaaaaacccgctgctgccattcttgg

SEQ ID NO: 66341 - protein, 49 aa, Zea mays
  misc_feature: Ceres CLONE 1539194
MNASELRELRDFVEACNKNPSLLSDPDLSFFRDYLQSLGAKIPATAPSF

SEQ ID NO: 66342 - DNA, 722 bp, Zea mays
  misc_feature: Ceres CLONE 1539195
  misc_feature: Encodes the peptide sequence at SEQ ID NO. 66343
  misc_feature (328)..(328): n is a, c, t, g, unknown, or other
  misc_feature (398)..(398): n is a, c, t, g, unknown, or other
  misc_feature (403)..(403): n is a, c, t, g, unknown, or other
  misc_feature (406)..(406): n is a, c, t, g, unknown, or other
  misc_feature (427)..(427): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (484)..(484): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (501)..(501): n is a, c, t, g, unknown, or other
  misc_feature (552)..(552): n is a, c, t, g, unknown, or other
  misc_feature (588)..(588): n is a, c, t, g, unknown, or other
  misc_feature (589)..(589): n is a, c, t, g, unknown, or other
  misc_feature (618)..(618): n is a, c, t, g, unknown, or other
  misc_feature (715)..(715): n is a, c, t, g, unknown, or other
tctgaactagtggatcccccgggctgcaggaattcgtctcacccctagaaaaaataggccagtccgacacatacgtacgcgtcatccggtcaagtgcatggtccacgagtgcccctgctcaacgattagccgccgccgccgtgtcgtcgtcatcgagtccgcctttttctttttagttagctcgggggatctttcccaagattttgttcctctgcttatttatcggcctgtattcctattagccgcctaaaattgatggtctgaatcctggattggagggagtggggggggaggtgcttgatagggcgggggatcctgggggttcttncccatttttttgtgtttttggtgggggggggggggggattttctcttgggttgtggggggggcccccccnttcgnttnctggaaaggattttatagtgngggcgaggagcccnnnnagccacggagggccgcttcctcccccccccaaaccccgcnaaaggannntgtggtanggttgttacagagggcgccccgttgcgttgggatgaaagagaatgcgaagntggcaagcacaaggtaagagaaaatatcgcggccgnncagacttgtaagcgcgggcgcaaacacgnaccctgattacggagacctcatgatgggtggctgtaaagagcgccagacgagagcgaaactaccggcaccacataatagacgactaccagaccctcnctcgtgg

SEQ ID NO: 66343 - protein, 50 aa, Zea mays
  misc_feature: Ceres CLONE 1539195
MVHECPCSTISRRRRVVVIESAFFFLVSSGDLSQDFVPLLIYRPVFLLAA

SEQ ID NO: 66344 - DNA, 696 bp, Zea mays
  misc_feature: Ceres CLONE 1539200
  misc_feature: Encodes the peptide sequence at SEQ ID NO. 66345
gctctagaactagtggatcccccgggctgcaggaattcgtctcacccctagaaaaaagcagatcttgtgaccctccctcagccgcgtcgcgtcgcatcctacgatccaaagctctctctggttgcaggtcgcagccatggtgaagaactacccgaccgtgagcgcctagtacagctaggctgtggacaaggccaggcgcaagctccgaaccctcatcgcccataagagctgcgccccggtcatgctccgcctcgcgtgggactccgcggggacgttcgacgagtcgtcgaggaccggcggtccattctgttcgatgaagcatacctcggaattgcctcacggcgctaacgcggggctggacatcgcggggcggctgctccaacccataaaggaagagttcccaatcctctcttacgccgatttctaccagctcgcgcgatttgtgaccgtgaaggtcaccggcgggcctgagattctcttccacccacggtaggaggacaagccctcacccccacttgaagggcgtcttcctgatgccactaaaggttctgaccacctgggggaagtttttggaaagccatgggcttgagcgatcaggaaattgttgccctctctggtggccccaccttggggagggtcgccccaatagcttatctggttttcaagggggccccggtactaaccagcccatttgga

SEQ ID NO: 66345 - protein, 83 aa, Zea mays
  misc_feature: Ceres CLONE 1539200
  misc_feature: SWISSPROT Homolog: EC 1.11.1.11 L-ascorbate peroxidase
MLRLAWDSAGTFDESSRTGGPFCSMKHTSELPHGANAGLDIAGRLLQPIKEEFPILSYADFYQLARFVTVKVTGGPEILFHPR

SEQ ID NO: 66346 - DNA, 789 bp, Zea mays
  misc_feature: Ceres CLONE 1539207
  misc_feature: Encodes the peptide sequence at SEQ ID NO. 66347
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (405)..(405): n is a, c, t, g, unknown, or other
gagaactgaaagtgtgttgggcggccaaataaannngggggataaagaggtggagctccccgcggtggcggccgctctagaactagtggatcccccgggctgcaggaattcgtctcacccctagaaaaagcaccaccaccgtcactcaacatagcacaggcagctcgagagagagagagaaggatgtcgtggttcgggcaccaccaccacaaccagccggctcccccggcgtcaggccccagccaggtgttcaagatcttctgccgcgccaacgagaactactgcctggccgtccgcgacggcgccgtcgtgctggccccgggcagccccaaggacgaccaccgacactggtacaaggacatgcgcttcagcacccgggtcaaggacgaggaaggcatgcctacnttccccctccccaacgagggctacggggctcgccatcaagcactccctcacccacccccacccggtcaagctcgcgcctttcagcccggagcaggaggacgcgtcggtgctgtggacggagagcaaggacgtgggcaagggcttccgctgcatccgcatggtcaacaacacccgcctcagcttcgacgccttccacgaggacaaggaccgctggcggcgtgcacgacgggagccgtcgacatgctctgggtagtggtgcaatggccagaaccaaacctggaggatcctgccgtgggggcccggaggccgactccggctctggtcctgagcggtgaggcccgcaggacctaggcgcgtcttacggcagggcctgccggctaagac

SEQ ID NO: 66347 - protein, 36 aa, Zea mays
  misc_feature: Ceres CLONE 1539207
MLWVVVQWPEPNLEDPAVGARRPTPALVLSGEARRT

SEQ ID NO: 66348 - DNA, 673 bp, Zea mays
  misc_feature: Ceres CLONE 1539209
  misc_feature: Encodes the peptide sequence at SEQ ID NO. 66349
tggcggccgctctagaactagtggatcccccgggctgcaggaattcgtctcacccctagaaaaaccaattatcaccatcttgctgatctaccaacacacttgttcatggagcattgcttgcgttgactccagaccctgcacttccgctgttttggggttcctcctcgacgaacattttccggacccaacagttggcaatttgggacacccctgtgatggccttggatctacacgagggcgccactacagattgctatctctactctcgacgtatagaatgtgctgtcgctccgtgactctactagtggcggcatccgggctctagtgcatctgacagatgattcaacgtccggaagcttctttaaaaactgggtttcaattgcgacgaccgccgggctaaccgcaacagctgcagcaggaactttgacttttgacatgcactgcacacattgtgaaaaggaatcatcacctacctctctgttgaacttgttcacatacccatggatacataaaacggcgaatgaagggacttttaatctccacggaggctactacagctctcgttgatcgcccgtttacgatatggacctttttcgacctcgaagggtcctgaaggtgcaaaccagcacgctaataagaatatgtccacctggccttgaccaatgaacgcctc

SEQ ID NO: 66349 - protein, 43 aa, Zea mays
  misc_feature: Ceres CLONE 1539209
  misc_feature: SWISSPROT Homolog: EC 4.2.1.1 Carbonate dehydratase
MHCTHCEKESSPTSLLNLFTYPWIHKTANEGTFNLHGGYYSSR

SEQ ID NO: 66350 - DNA, 726 bp, Zea mays
  misc_feature: Ceres CLONE 1539210
  misc_feature: Encodes the peptide sequence at SEQ ID NO. 66351
acccgcggtggcggccgctctagaactagtggatcccccgggctgcaggaattcgtctcacccctagaaaaaggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccagcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttccgggggctttcgtggcggacccccaacctcggggtagcaggggggcgcggtttcaaggcccaaccttccaggggcacccgggtgggggcccccgcctccgtcaatacaacccggcgcaaggggaccaaaaccggttcct

SEQ ID NO: 66351 - protein, 193 aa, Zea mays
  misc_feature: Ceres CLONE 1539210
  misc_feature (28)..(187): Pfam Name: SOUL Pfam Description: SOUL heme-binding protein
MARRASLLLAAALLVAVAAAAVPPTCERIECPAYEVVDSANGFEIQRYTDAMWITTAPIEDISFVAATRTGFLQLFDYIQGKNAYNQTIEMTAPVLTRVSPSDGPFCASAFAVSFYVPAKNQADPPPAEGLRVDRWAGARYAAVRRFRGLSWRTPNLGVAGGRGFKAQPSRGTRVGAPASVNTTRRKGTKTGS

SEQ ID NO: 66352 - DNA, 880 bp, Zea mays
  misc_feature: Ceres CLONE 1539212
  misc_feature: Encodes the peptide sequence at SEQ ID NO. 66353
  misc_feature (22)..(22): n is a, c, t, g, unknown, or other
  misc_feature (25)..(25): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (106)..(106): n is a, c, t, g, unknown, or other
  misc_feature (495)..(495): n is a, c, t, g, unknown, or other
ttttctttacttcccccctccntcnatatnnngngnnnnncccccnnnnnaaatagctggagctccccgcggtgggcgcgccgctctattactagtggatcccccngggctgcagggaattcctcctcacccctaagaaaaagacgcaggcaccccagcgagctcctggcggatcgtgcctcaccccgcgtgcccaccgcatcggatgtcaacgattgagaagctctcctgctcgcatggtgaccatggaccaataactcgccaaccggtgagcgccgagtacagcgaggccgtcgagaaggcaaggcgcaagctccgcgccctcttcggcgagaagagctgcgcgcccgtcatgctccgcctcgtgtggcactccgcgtggaagttcgatgtgtcagcaaggagcgggggtccctgctggattaggaagtgtccggatgcatctggctcgcggggccaattggtgtttgagaataaaacccaccctcgctttangtcttcttgggatggaggttggaaatcatgtttgaggggcgaactcctaccggacatgccgggagttgctggactctctgaggtcggcccgggggcaggtgtcgatgcacttttcctcgcaagtctggggccgggagcagcctcaatgcccgcccagtggcatgaccctcctctctctgaagcctaccatggcagcttgggaagctcatggaccgacgctctccttctgagccgtatgagaggggcttttacatgaggtccggccggaccagctgtatggaccttctgtaggagggtctcagtctcgctttagtggggaggtgtcaccgtctctgcgagggcgggacgtggcttagttctgctagggactgctcttatcggtttg

SEQ ID NO: 66353 - protein, 181 aa, Zea mays
  misc_feature: Ceres CLONE 1539212
  misc_feature: SWISSPROT Homolog: EC 1.11.1.11 L-ascorbate peroxidase
  misc_feature (97)..(97): Xaa is any aa, unknown, or other
MSTIEKLSCSHGDHGPITRQPVSAEYSEAVEKARRKLRALFGEKSCAPVMLRLVWHSAWKFDVSARSGGPCWIRKCPDASGSRGQLVFENKTHPRFXSSWDGGWKSCLRGELLPDMPGVAGLSEVGPGAGVDALFLASLGPGAASMPAQWHDPPLSEAYHGSLGSSWTDALLLSRMRGAFT

SEQ ID NO: 66354 - DNA, 689 bp, Zea mays
  misc_feature: Ceres CLONE 1539215
  misc_feature: Encodes the peptide sequence at SEQ ID NO. 66355
  misc_feature (393)..(393): n is a, c, t, g, unknown, or other
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcgnggctgtcggcggacccggagacgttcgccaagaaccgggagctggaggtgatccactcccgctgggccatgctgggcgcgctcggctgcgtcttcccggagctgctcgcccgcaacggcgtcaagttcggcgagggcgtgtggttcaaggccggcttccagatcttcagcgaggtggactgaactacctccgggaacccaacccctatcacgcccagagcatcctctccatctggggcctgcaggtcgtggtcctgggccccctccaggggtaccccatcgccggcggcctgcttg

SEQ ID NO: 66355 - protein, 143 aa, Zea mays
  misc_feature: Ceres CLONE 1539215
  misc_feature (65)..(142): Pfam Name: Chloroa_b-bind Pfam Description: Chlorophyll A-B binding protein
  misc_feature (84)..(84): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAXLSADPETFAKNRELEVIHSRWAMLGALGCVFPELLARNGVKFGEGVWFKAGFQIFSEVD

SEQ ID NO: 66356 - DNA, 721 bp, Zea mays
  misc_feature: Ceres CLONE 1539216
  misc_feature: Encodes the peptide sequence at SEQ ID NO. 66357
  misc_feature (721)..(721): n is a, c, t, g, unknown, or other
ggagctccccgcggtggcggccgctctagaactagtggatcccccgggctgcaggaattcgtctcacccctagaaaaaagtccccccactgtgtccgcgccgcctcattaattaacctcgctaccgcgcgcggcggcatccaccgctctccctccgctgcggccagccagccatgaagccgccggcggcgagcccgggccgcgcggagaagccgcagctggcggcgccgggcctggcgcgcctgctgctcagcaagagccgccggggcgcgcggtcgcgccgggcgccgccggccacgtcgcccatgttcgtgtcgcgcggcgcgcgcacccgcgccgccaacgacggggagccctcgtcgcccaaggtcacctgcattggccaggtgcggatgcgcaaggggaagaagcctgcgacggcgccggcggtggggaaggcggccgcgcgggacaagggcgccgccaggggcggctactactactactgccgctgcctcaagagggcgttcctgtgcggcgggctgttcgcgtccgacgcgcggaagcggaggcacgagccgccggcggagcgtgggcgccgctcgccctgggtgttcagcagcagggacgtcgctgttgctgccgcgcccaagccgcccgcggacccgagcagcggccgccgggcggaggacgaggtgcagctcggcgtcggggacttggggtcgaccggccgggacggagan

SEQ ID NO: 66357 - protein, 182 aa, Zea mays
  misc_feature: Ceres CLONE 1539216
MKPPAASPGRAEKPQLAAPGLARLLLSKSRRGARSRRAPPATSPMFVSRGARTRAANDGEPSSPKVTCIGQVRMRKGKKPATAPAVGKAAARDKGAARGGYYYYCRCLKRAFLCGGLFASDARKRRHEPPAERGRRSPWVFSSRDVAVAAAPKPPADPSSGRRAEDEVQLGVGDLGSTGRDG

SEQ ID NO: 66358 - DNA, 787 bp, Zea mays
  misc_feature: Ceres CLONE 1539220
  misc_feature: Encodes the peptide sequence at SEQ ID NO. 66359
  misc_feature (755)..(755): n is a, c, t, g, unknown, or other
ggcggccgctctagaactagtggatcccccgggctgcaggaattcgtctcacccccagaaaaaggtcgatcgccttatctcctcctctcccagtcctcccgcccctcgccccatcccccaccacccagtcagtgtctgtcaccgcctcaccgaccacacggcaagggaagaagcagcagcgccatggccgcgccgctcacggccgtccgggtccgcctcctcctcctcacagtgacctgcacggcagccggtaccaccggtcggccggcccctcaggtcaagatcaacatgtctcttctactaccaccaggcaccaaccggtgccggtgctccttgccccccccgcaaggggggggggggcgggtggtcttcttccggctttcccccgccccccccgcttgatgactcgtcgaatctctctttttgccggtgtccggctgatcttgctgcactattctagtggccgttagtctttctctcattgtcatgtccccgtccccctctttacgtgcaggcgataacttccgccataaccccccttttgtatccgtcgtttttccttcttaattgttacttactacacctctgggcggtctcttctgctctggacctatctagattttcttctcctttggcctgtatgttctctcttactcatccctcccccctttcgctcttgcctccctgcggttattgtcgttctcgctctggtcagctattattagcgcgcttgtcccagctccttccttgttgcntcccgcgttgctgtgctagcttatatcttcgc

SEQ ID NO: 66359 - protein, 72 aa, Zea mays
  misc_feature: Ceres CLONE 1539220
MAAPLTAVRVRLLLLTVTCTAAGTTGRPAPQVKINMSLLLPPGTNRCRCSLPPPQGGGGRVVFFRLSPAPPA

SEQ ID NO: 66360 - DNA, 620 bp, Zea mays
  misc_feature: Ceres CLONE 1539222
  misc_feature: Translation starting site: 167
  misc_feature: SWISSPROT Homolog: EC 5.3.1.1 Triose-phosphate isomerase
cgctcttaactagtggatcccccgggctgcaggaattcgtctcacccctagaaaaaatcatattcccacctcgcgaacgaggacgaactgctacccccctcgcctcgccctcgccgcctcctctcccgttcccccaccaaccgcagcagcgagagcgagactgagaatggccgcggcgccgtcgtccctcgtgtcctcccatctctctcgcctcgccgacctccgccgcgcggcggcgccggccactcccaccgtcccacagcagcttcgcgtctgctgctcgcgccgccgcgcccagagcgtcgtcgccatggctggatccggcaaggtcttcgtcggaggctactggaaagtgcaactgaacaaaggactccgttaacaaacttgtctctggactgaatgctgctaccctccaaactgatgtaaatgttgggggggcctctcccttcttccatttcgatcaggtcaagaattccctaacgggccccattgaggtttctggcccaaaatggggggttggaaaaggggggacccaacccggaaaaaatcttgggcaaaacaccgggggggaaaccggtgggcaagggggttttttttggggacccctccaggggtaaaat

SEQ ID NO: 66361 - DNA, 804 bp, Zea mays
  misc_feature: Ceres CLONE 1539233
  misc_feature (360)..(360): n is a, c, t, g, unknown, or other
  misc_feature (403)..(403): n is a, c, t, g, unknown, or other
  misc_feature (475)..(475): n is a, c, t, g, unknown, or other
  misc_feature (480)..(480): n is a, c, t, g, unknown, or other
  misc_feature (481)..(481): n is a, c, t, g, unknown, or other
  misc_feature (499)..(499): n is a, c, t, g, unknown, or other
  misc_feature (500)..(500): n is a, c, t, g, unknown, or other
  misc_feature (540)..(540): n is a, c, t, g, unknown, or other
  misc_feature (562)..(562): n is a, c, t, g, unknown, or other
  misc_feature (585)..(585): n is a, c, t, g, unknown, or other
gtttgcccccccccccccttgtactcggaaagaagtgtggagtaatttgttaaaaatggaactccacgcggtggcggccgctctagaactagtggatcccccgggctgcaggaattcgtctcacccctagaaaaatcataagcacctcactaattaagtagcttcttctaagtctagcgaggctcgtttgatgccagaaggtaactactaccagatatggaggggaaggaggaggatgtccgccatggtggcccaccagttctaggagggccatcacgtcggctctgaggagcagggcacggaccactaggactacaaggaggatccgccagcgccgctcttcaagcccgggtagttcanatcttggttgttagtattgggggggttttgttgagtttggcgncaccttcctcttcctctacatcgtgagtcctcggggtcgttgggggttgttctggtccccccccccaagtgngccannagtcggcactccatgggnntccgcggggaagccttcagcggtttggatttttcggaccncgtgctactgcatccggcaagnaatcttccgtggggtgacatatncccgagtggaagaaacttcggagcgtgttccctggcctacggaaggttgtgcccattgccaaggccgtggaatataacattcaaagaagaaatggtctgggtcgctcgtgatgtcgtcccagcacaattatttaaaggatgagcacataaagggagtgttaactcggtacaatgagtaggagggtgccccaagcttcctattacaaacaacgataaacg

SEQ ID NO: 66362 - DNA, 711 bp, Zea mays
  misc_feature: Ceres CLONE 1539246
  misc_feature: Encodes the peptide sequence at SEQ ID NO. 66363
  misc_feature (347)..(347): n is a, c, t, g, unknown, or other
  misc_feature (462)..(462): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (638)..(638): n is a, c, t, g, unknown, or other
  misc_feature (639)..(639): n is a, c, t, g, unknown, or other
  misc_feature (655)..(655): n is a, c, t, g, unknown, or other
  misc_feature (677)..(677): n is a, c, t, g, unknown, or other
  misc_feature (678)..(678): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
tacccgcggtggcggccgctctagaactagtggatcccccgggctgcaggaattcgtctcacccctagaaaaagtccctgtccatccgtagcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcgccagcaccagggccccgcgccgcagggggctcaggctgaggaccgtcacgtgcttcntgccgcacgacacggcgggcgcggcgcggtcccgtgccggcgctggacaaagaggcccaggccgcggcggcccggcgcgtctcggagaaggaggcgcggaagcggtcctagcggncgacgtacctgggggccgccgtgatgtctagcctcggagtccgtccatggccgtcccccgcgggtactaccgctccagctggnnnttggaagggtgcgaggtgccgggggatcgagaccctggggccgttcccggtctccgnnngggggggcgtcccccaaggcattcgtaggcgnnctgcgccccccgggcnttgcggcacccccccctggggnnattgcccgaggtgggagnnnggggtgggggacg

SEQ ID NO: 66363 - protein, 103 aa, Zea mays
  misc_feature: Ceres CLONE 1539246
  misc_feature (56)..(56): Xaa is any aa, unknown, or other
  misc_feature (94)..(94): Xaa is any aa, unknown, or other
MAAAMTSFVAKNPLLAAAARRRAPPLAGRALPFSPLASTRAPRRRGLRLRTVTCFXPHDTAGAARSRAGAGQRGPGRGGPARLGEGGAEAVLAXDVPGGRRDV

SEQ ID NO: 66364 - DNA, 753 bp, Zea mays
  misc_feature: Ceres CLONE 1539256
  misc_feature (753)..(753): n is a, c, t, g, unknown, or other
agtgctggagctccccgcggtggcggccgctctagaactagtggatcccccgggctgcaggaattcgtctcacccctagaaaaaaggacggacgggaggaggagaggacagagcccaccacccgcgaccgcgaccgcgacctaacccggagacctccctaggctagatcccctcccagaccccatgctctcccagctacctttcccctctccctccctcctcccgggcccacgccgccgcagccccgcctggatgcttgggtggtactccgccgtagactgcgacgttgtacgagcttgatgcgggacccctgtcccctgcggagtcaggatgcacctgcccacgccgcccaccgggggtttctgcccacccccccaggggggggcggggggaggtgccaaccatccatgtccccccgcgagccacattactataagggccgaatgccacgatgtgcgcctctccatcggtccttctgaacgctccagggggtttctattggtggggggacgcaagccatctcacattggatcccccccatagctgggcaaccctccccgaacggttgcctcggcttgctcggcggcttcatccgctttaccgggtgatctttctcgttgcgttcttccaccagcttgctggggctgagtagtacgacctacttttgggcgctatcctagtctgtttttttagacccctccgtccgggcctacttccggatgggtctgccctgcccacccctgacacttaccn

SEQ ID NO: 66365 - DNA, 721 bp, Zea mays
  misc_feature: Ceres CLONE 1539268
  misc_feature: Encodes the peptide sequence at SEQ ID NO. 66366
  misc_feature (721)..(721): n is a, c, t, g, unknown, or other
ggcggccgctctataactagtggatcccccgggctgcaggaattcgtctcacccctagaaaaaacgcctctccttgctcaccattctcttctaaccggtcaagccaaggcgcatctagagagctgagcagcaatggcgcctgcaacttcttgtaggcgccttgcagctgctcagctggtgctgtcaacagatcacgaggaccggtacgtcaacagttccaggtacccgacgatggtgccttatctgtgccacaactattagaagaaaaattgtcccacggcggagtcactctaccatcacatcctggcgctggtgagccccctgaacatggggatcgccgtggcgcacatccggatccagtgcgagcactgcttgaccatccactccatacccccctccctgttgctcgcacctatacctcagatcagatcatatcatcccccgcctcaactcagactaagccccgccacagtccaaggatcgccaagtacattccaatatcgcctccacaaagtctaaggagagcaaagtcattctgaataaacatcgcttgttctctttacggagattgagtacttagccaagaccaatttgcccaaaaagctgcatctcgtcatgagagaaaaacttgccaaggaaataccaacataacttttattaaagattacactggtcctgagtgaaattgtcttgagtggggattgcctccccacaaaaatcn

SEQ ID NO: 66366 - protein, 42 aa, Zea mays
  misc_feature: Ceres CLONE 1539268
MAPATSCRRLAAAQLVLSTDHEDRYVNSSRYPTMVPYLCHNY

SEQ ID NO: 66367 - DNA, 711 bp, Zea mays
  misc_feature: Ceres CLONE 1539269
  misc_feature: Encodes the peptide sequence at SEQ ID NO. 66368
gcggtggcggccgctctagaactagtggatcccccgggctgcaggaattcgtctcacccctagaaaaagagccgagctggctcgttatccacccctaactaccagcgcaccgcgagctcccgtttccgccgatacgagcgcgcagatcgcggaagcccagcgggtcacagtccagggggagggagctcgcggcggctgaggaaggcgttcaccaccgtcgcggatttcattgacgaagagatggagctctcctttgggaagctgttcagccgcctcttcgccgagaaggacatgaggattctcatggtcgggctcgatgccgccggtaacaccaccatcctctataagctcaagctcggcgagatcgtcaccgccatccccaccattggattcaatgttgaaactgttgagtacaagaacattagcttcaccgtttgggatgtctggtggtcagaacaagatcaggcccctgtggaggcactactttcagaacacacggggacttatttttgctgtcactccaatgatacggaacgtgttgttgaggctacagatgagctccacacgatgctgaatgacgatgagctgcgtgatgccgtgctgcttgtattagaaacaaacatatcttcccatgctatgaatgctgctgaactactgacagactggtctgcattctcttacacagcggcctgggtacgtcatgagggcttt

SEQ ID NO: 66368 - protein, 157 aa, Zea mays
  misc_feature: Ceres CLONE 1539269
  misc_feature (5)..(148): Pfam Name: Arf Pfam Description: ADP-ribosylation factor family
MELSFGKLFSRLFAEKDMRILMVGLDAAGNTTILYKLKLGEIVTAIPTIGFNVETVEYKNISFTVWDVWWSEQDQAPVEALLSEHTGTYFCCHSNDTERVVEATDELHTMLNDDELRDAVLLVLETNISSHAMNAAELLTDWSAFSYTAAWVRHEGF

SEQ ID NO: 66369 - DNA, 694 bp, Zea mays
  misc_feature: Ceres CLONE 1539273
  misc_feature: Encodes the peptide sequence at SEQ ID NO. 66370
tggcggccgctctagaactagtggatcccccgggctgcaggaattcgtctcacccctagaaaaaatctcctcctctcccagtcctcccgcccctcgccccatcccccaccacccagtcagtgtctgtcaccgcctcaccgaccacacgccaagggaagaagcagcagcgccatggccgcgccgctcacggccgtccgggcccgcctcctcctcctcccagtgacctgcacggcagccggtaccaccggccggccggcccctccgtccaagagcagcaggccgcgtctactaccaccaggcaccacccggtgccggtgctccaggcctcccatggaggcggtggcgccggtgtccgcggcggcagtggcggcgctgctgctgctgccggcggacgcagcgctggcggtgggcggcgagttggggatcctcgagggccgcatcttctcgctgctgcacccgctcatcatgggcgggctcttcgcgtacacgctctgggcggggtacctcggctggcaatggcgcctggtgcacaccgtccaggacgagatcaacgcgctcaagaatcagctcaagcccgccgccgaggccactctcgcggcggacggcgccggcgcggactcctcctcaccacaagctcgccgcccgctgcggccagtaagtctccgtcgccggcggaagcccggatcgaggagct

SEQ ID NO: 66370 - protein, 121 aa, Zea mays
  misc_feature: Ceres CLONE 1539273
MEAVAPVSAAAVAALLLLPADAALAVGGELGILEGRIFSLLHPLIMGGLFAYTLWAGYLGWQWRLVHTVQDEINALKNQLKPAAEATLAADGAGADSSSPQARRPLRPVSLRRRRKPGSRS

SEQ ID NO: 66371 - DNA, 745 bp, Zea mays
  misc_feature: Ceres CLONE 1539277
  misc_feature: Encodes the peptide sequence at SEQ ID NO. 66372
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
nggcatnnnnggcgcgctcgcactccccgcggtggnngncgctctattctagtggatcccccgggctgcaggaattcgtctcacccctagaaaaaaccagcggcatctatagcaaccggtccagcactttcacgctcagctccagcaatggctgcctccaccatggagatctcctccacggcgatggccggcacccccatcaaggtgggctccttcggcgagggccacatcaccatgcgcaagaccgtgggcaagcccaaggtggcggcgtccggcagcccctgatacgaccccgaccgcgtcaagtacctcggccccttctccggggagcccccgagctacctcagcggagagttccccggcgactacggttgggacaccgccgggttgtacgccgacaccgagaccttcgccaagaaccgcgcaatgcaggtgatccactccacctgggccatgctgggcactctcggctgcgtctacaccgagctgctctcccacaccggagtccctctcggagacgccgccaggtgcaagcgcacctaccagatctatagagaacgcggactggactatcacacacaggccagcgtgactcacgcccagagcagggtcgccacaagggcctaacaggaccgaccaatgggtgccaacaaaggttaaggaaatgtggcgcgccatctaggagagggagcggatccgcctcacacaggggatagatgtcagccccttcaccagcaggaacaac

SEQ ID NO: 66372 - protein, 45 aa, Zea mays
  misc_feature: Ceres CLONE 1539277
MAASTMEISSTAMAGTPIKVGSFGEGHITMRKTVGKPKVAASGSP

SEQ ID NO: 66373 - DNA, 703 bp, Zea mays
  misc_feature: Ceres CLONE 1539283
  misc_feature: Encodes the peptide sequence at SEQ ID NO. 66374
cgctcactactggatcccccgccgtgcatgcaattcttccacccccataaaaaaattacgcccgggattcgaccgatcgtcctgtctctatcttcacgcaggtattgcgttgaccgtcggggaatttatcgtatcccgggatacgtatgggttccaaagtgtccttctgtgtcacgatccacgtgtgctcgccgccgccttggtacctgtcgagcatgttgctgaactcacgtacccttcacctattactttcaacgagaaggcttattctaccgagattactgttcgtttcaatactggtaccccgctttgctcagcctgtgataacttcacgagaaaagatgacaataatgtgcttgagaaacagagacatgataatgtcatggcattccttcatgacgcttgctctcaggcatcacattagaacagaagtgtgatgaattgagggactcttaggcaaccgtcctgttagcctaaattgctcagatgaaatccgaaccgttctgtcaacagaatggactgtgtacgagcacaggtcttttctctggtgtgacaattgacctcagatgtgtattgtgccacgctatgtcttgatgaacgtatgtacaaaatagcagatccggacacgagagttagaaataaatcagattcttatctaggagtgagagtaaatttaaggcctcttgctagcagtgcgaaccaa

SEQ ID NO: 66374 - protein, 140 aa, Zea mays
  misc_feature: Ceres CLONE 1539283
AHYWIPRRACNSSTPIKKLRPGFDRSSCLYLHAGIALTVGEFIVSRDTYGFQSVLLCHDPRVLAAALVPVEHVAELTYPSPITFNEKAYSTEITVRFNTGTPLCSACDNFTRKDDNNVLEKQRHDNVMAFLHDACSQASH

SEQ ID NO: 66375 - DNA, 738 bp, Zea mays
  misc_feature: Ceres CLONE 1539285
  misc_feature (738)..(738): n is a, c, t, g, unknown, or other
gacggtggcggccgctctataacttacgaataccccgaggctgcaggaattctctctcacccctagaaaaaccccgctccgcctcctgctctctctcgcctctgggtgggagagctctcttgaagcctcgagactcgtctcgccgctgctacctcacttctgcggctggatgcctccattgcctgttgcattgaagcgcaaccccggcagcctagagctcgctactccgcctatcccatacacctcggacatggagttcaaagacctcggccacatggccacggaggcgaagtccgagagcccgtgcttccacgtgtacgataacgtggttgcccctgaagagcgggattcttagcatcaaaagaagaaaactcgaacatttgcctggttttatctgagccacacccacaacacatgaagtttgaactgggctattttggtaccgccaaaagcaacaggtctgtaccatgttggtctgccttccagaactcggtggagcatgatgaagtatctcatcctctcatcctattaaacaactagactgggcatatattctcctataaccagtcccctgcgggaataggcgttgttttggtgggctaagatgatactgcctcctattctcccaggaagtatgtagacaatcccctacgcctgggtatttgttttattacgagacaggctactcttttaaatgggagagcttcttgcattctgaattctgctagaccgcatgcn

SEQ ID NO: 66376 - DNA, 806 bp, Zea mays
  misc_feature: Ceres CLONE 1539290
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
ggggggtgcgatatattagcccggatnnntcccannnnnnnaaaaatgagactccccgcggtggcggccgctctttttcttcctatcccccgggctgcaggaattcctctcacccctagaaaaaatcccatcccctcaggcctcagtcgtcagtccctcacacactccctatacactgctctgctggagtaagaaggaataagctagcgcctccctagctctcgttgtcagcaatggccaccaccgccgcgtccagcctcctcaaagtcctcctacgcgggctcccggctcccttcggccatgcgcaccaccaccccgtgcgtccagggacgtggttacctggtgcggcgggtgttggctaacgctggtggtgtatctgctgttcgggctgtctgacacgaaggattatgccccttcctcgttaggggggtggggggtgctcctttatgttcaggggttttccccccccctgttagctagcgggctgacacagcatggcgggagtgagcgggtatgcgtgcgcccagactgatgctgtgggagccgacaggtgattcttacgtattgacgttctggatgcgcagttgatctttgaggttgtagtcttgtatcgtacgcttatgggtagcctccgcagcgcgcgtgcgctcatcttcctctctctatgccttgtagggctatggtcatagactgactatatcgatgcacgcctaccccggtgcggattaggagaggctttcgtgttagggcttcaagggactggacgtacaatggggcggtcttcgttctgttgcataacagcacat

SEQ ID NO: 66377 - DNA, 791 bp, Zea mays
  misc_feature: Ceres CLONE 1539294
  misc_feature: Encodes the peptide sequence at SEQ ID NO. 66378
tttatattaatcagatgcgagtaatagtaattcatttcttttctataactggagctccccgaggtggcggccgctctagaaatagtggatcccccgggctgcaggaattcgtctcacccctagaaaaaaagctagccagacacttaactcacagggttggagatataagatgcaggcctcaatgttggagatttacaatgagactatacgcgacttgctagcaacgaatcgcatggctgctcaggatgttggtgcttcaaagtacagtatcaagcatgatactaatggtaacacgaatgtgtcggaccttacgatcattgacgtaactagtatcaacgaagtttcttctctccttatgcgggctgctcagagcagatcagttggtagaacacaaatgaatgaggaatcatcaagaagtcactgtgttttcactcttcggattttccgtgaaaatgagggaacggatcaacaagtgctaggagtgctgaatcttatagatctagcaggccttgagcgccctgaacaaaattggggccacgggcgatcggttgaaagagacattggctatcaacaaaagccttgtcctgttttaagtgaatgtcattctatctctattgcaaagaaataggaacatcttccattttcggaactcaaaacttaacttatctgctcccagccttggtctcggaaggggaactccaaaaccactggttggttgttgaatcctgtcccctctgaaaccgtccccctaacgaggggaatccttctattgggctcaatgacgggtttct

SEQ ID NO: 66378 - protein, 152 aa, Zea mays
  misc_feature: Ceres CLONE 1539294
  misc_feature (1)..(148): Pfam Name: Kinesin Pfam Description: Kinesin motor domain
MQASMLEIYNETIRDLLATNRMAAQDVGASKYSIKHDTNGNTNVSDLTIIDVTSINEVSSLLMRAAQSRSVGRTQMNEESSRSHCVFTLRIFRENEGTDQQVLGVLNLIDLAGLERPEQNWGHGRSVERDIGYQQKPCPVLSECHSISIAKK

SEQ ID NO: 66379 - DNA, 696 bp, Zea mays
  misc_feature: Ceres CLONE 1539295
  misc_feature: Encodes the peptide sequence at SEQ ID NO. 66380
tcccccgggctgcaagaattcgtctcacccctagaaaaaaaatgacaacagcagcacgatggcaagcccgctgctgtgcctggccgccgcggcgctggccgtagccgtcctcgtctccgcgacagaggcgtggcgcgcgactccaccgccgctgccggtgctgccgatcccgtcggcgccgcagctgagatggcagcgccgcgaggtgatcatgttcttccacttcggcatgaacaccttcacggactccgagtggggcacggggtcggaggacccgtccctgttccgccccgcggggctcaacgccacccagtggatggacgcggcgcgggcggcgggggcctcgctcgtcatcctcgtcgccaaaccccacgacgggttctgcctctggccgtccgactacacggcccactccgtgcgcgccagcccctggcgcgggggccgcggcgacgtggtgagggagttcgtgggcgctgcccgcgcgcgcggccttgatgccgggctgttcctctcgccatgggaccggcacgaccagaggtacggcgaggaaggtcgcggtacaacgagtactacgagggccagctccaccgagctcctcaccgggtacgggagctttgtcggagatttggtttcaacggcggccaagggctaagaacgccgacccaatttggacgtaccacttctccggtagtggtt

SEQ ID NO: 66380 - protein, 197 aa, Zea mays
  misc_feature: Ceres CLONE 1539295
  misc_feature: SWISSPROT Homolog: EC 3.2.1.51 Alpha-L-fucosidase
MASPLLCLAAAALAVAVLVSATEAWRATPPPLPVLPIPSAPQLRWQRREVIMFFHFGMNTFTDSEWGTGSEDPSLFRPAGLNATQWMDAARAAGASLVILVAKPHDGFCLWPSDYTAHSVRASPWRGGRGDVVREFVGAARARGLDAGLFLSPWDRHDQRYGEEGRGTTSTTRASSTELLTGYGSFVGDLVSTAAKG

SEQ ID NO: 66381 - DNA, 778 bp, Zea mays
  misc_feature: Ceres CLONE 1539301
  misc_feature: Encodes the peptide sequence at SEQ ID NO. 66382
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
gattcttgtgctttatattattttacatgccgcctccnncncgcaatagctggactccccgcggtggcggccgctctttactagtggatcccccgggctgcaggaattcgtctcacccctagaaaaagagatctccagggtacgagcgcattcgcgattttggccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccaccccccaataacgtctcagtaggtcatagtgctgtgttacaaggatgcacggttgaggatgaggcttttgttggcattggggcaaccctattagatggtgttgttgttgaaaagcatggaatggtggctgctggagccctcgtacggcagaatactaggatcccttgtggagaggtatggggagggaaccctgccaaatttctgaggaagcctcctgatgacgagatcagtttcattgccgaatcagcttgccaactattcccagtccgttccaagggccttgctgcctgaaaaatgcaaaacctctttggaaaagaat

SEQ ID NO: 66382 - protein, 79 aa, Zea mays
  misc_feature: Ceres CLONE 1539301
  misc_feature: SWISSPROT Homolog: EC 4.2.1.1 Carbonate dehydratase
MNIFDKTPHVHKDAFVAPSASLIGDVQVGSGASIWYGCVLRGDANIIQIGSGTNIQDNSLIHVAKSNLSGKVFPTTTPQ

SEQ ID NO: 66383 - DNA, 692 bp, Zea mays
  misc_feature: Ceres CLONE 1539302
  misc_feature: Encodes the peptide sequence at SEQ ID NO. 66384
ctccccgcggtggcggccgctctagaactagtggatcccccgggctgcaggaattcgtctcacccctagaaaaaaccaccactgaacccgctgcttcccctcctccacacctctcggtttcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaggcggggtccgagctcggtgcggcggttcagcatctcgcgcgccaggtgcctgtgcctgtgcccttccggaaatgggaagccgcacagccgccgaccgtggtgacgggggatgttgcgctcgctgtggggacggttgggtccgcgacgtcgctttggaaagggctgtagacatagggtccctcaaggtggcagcggctgctgctgtcgcggtcactggaagtgcactgcag

SEQ ID NO: 66384 - protein, 142 aa, Zea mays
  misc_feature: Ceres CLONE 1539302
MEISLEASWVGVQRHGQGFSGLLLHAQPPQLPPWSPAALLPPKLVIPFDLDLPVVPFVAGMRRGVGTVDLPAVAVSSLVEIGGRLGQAGSELGAAVQHLARQVPVPVPFRKWEAAQPPTVVTGDVALAVGTVGSATSLWKGL

SEQ ID NO: 66385 - DNA, 704 bp, Zea mays
  misc_feature: Ceres CLONE 1539304
  misc_feature: Encodes the peptide sequence at SEQ ID NO. 66386
  misc_feature (704)..(704): n is a, c, t, g, unknown, or other
gctctagaactagtggatcccccgggctgcaggaattcgtctcacccctagaaaaacccttcgctacaagtcatctcgccgcaaccgcaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggcaacttcgcccccgtcgtcgaggagaccccgccggccccaaaccttaccgtccgcagacacctcccggagtgcttgaatggagagtttgtcagggttgggcctaatccgaactttgctcctgttgcggggtatcactggtttgatggagacgggatgattcatgccatgcgtattaaagatggaaaagctacctatgtatcaagatatgtgaagactgcccgcctcaaacaagaggagtatttttggtggagcgaagtttatgaagattggagacctgaagggattttttggattgttatgggccaaatgcagcaactttcggaataaattcaaagcctttggattttaactatgggaattgggaacagctaatactggcacttatataatcatcaatgggaaaactcaggggcccttgtccaaaagcaaan

SEQ ID NO: 66386 - protein, 166 aa, Zea mays
  misc_feature: Ceres CLONE 1539304
  misc_feature: SWISSPROT Homolog: EC 1.13.11.51 9-cis-epoxycarotenoid dioxygenase
MGTEAEQPDMDSHRNDGVVVVPAPRPRKGLASWALDLLESLAVRLGHDKTKPLHWLSGNFAPVVEETPPAPNLTVRRHLPECLNGEFVRVGPNPNFAPVAGYHWFDGDGMIHAMRIKDGKATYVSRYVKTARLKQEEYFWWSEVYEDWRPEGIFWIVMGQMQQLSE

SEQ ID NO: 66387 - DNA, 914 bp, Zea mays
  misc_feature: Ceres CLONE 1539307
  misc_feature: Encodes the peptide sequence at SEQ ID NO. 66388
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
tttgtggggttctatgcggttcacgatnnncggcccannnnnnaatatccaaacctcaccgcgggggggggccgctctacaactagtggatcccccgggctgcaggaattcgtctcacccctagaaaaagcattttggctcctcactgccgcgccgccaccccctacaggtaaggaagaggagggcaggatgtctcaccgtaagttcgagcacccgaggcacggttccctcggcttccttcccaggaagcgctcctcccgtccccgcggtaaggtgaagtccattccctagggatgaccccaagaagccttgccatctcactgccttccttgtgtaccagggtggaatgactcccattgccccgtgaggttgagaaacccaggatccaaatctccataggagaggaaactgcccaccccctggtggggggggggggggggcccctccctcttgtaccatgtctgggcccccccccgctatgtgcacagaatccctccctggtccttcccccacattgcagactacgagttgcgggcctccaccatatctgttgcgaaataaaacctatcggatacaggttaccccaccacatgacccgtacgacgctgcagtctcataaggtgacgtcgctctctcctctaccttatgtcctgcgctctcacgttgtgtagaggctgagctggccggggccaagcacaggaaactggccgcccctgggtcgctcctgccggaagcgagtgagtaatgtgtgtgcgtgctgtgtgatcgcgcgctgccattacacttacatcggatggtcgccctgcagcacatcacacaggcggcggcaaaatcgcaagtagagatgtcttgattgcagccatggatttactggagcggatgctctctcgacgcggctttcgcgacacgagcgg

SEQ ID NO: 66388 - protein, 33 aa, Zea mays
  misc_feature: Ceres CLONE 1539307
MSHRKFEHPRHGSLGFLPRKRSSRPRGKVKSIP

SEQ ID NO: 66389 - DNA, 799 bp, Zea mays
  misc_feature: Ceres CLONE 1539310
  misc_feature: Translation starting site: 213
  misc_feature (1)..(1): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
nggtgggagggacaaaaatggtattttnttnntattnnttttcaaactggcactccccgcggtggcggccgctctagaatagtggatcccccgggctgcaggaattcgtctcacccctagaaaaaaaacgccagccgccagtccccccgggcggcggcgcggcgctaccctcagctagctccgtaaaccagcgagtacggccgaccagaccaatggcactgcggctacccatctcctcgacccacgggctggcctcctcgccagcgcccatctcctccacgacgacgtgccggccggccgccgccagtgggagcttgatcccgccagctgccctggtcgcagttgccatccgctgggcgtcggcgtcggcgtcccaaaagaggggcctgctgctgacgacggcgaggggcggcggagtctcgccggtgaggtcgagcgggatctagacgacgtcgacctcggtgggagctgaggccgtcaccgggcaggtcacggaggtcaacaaggacaccttctggccctatcgtcgaggccgccggcgacaaagtcgtcgtcctcgacatgtaccccgaaatggtgcggggcctttgcaaagtgatgggctcccaagttccagggagatgtcccgagaaaaacctgggacgtcgtgttccctccaagctggaactgcacccaggaaaacaagcccttctcgcgaaaggaacttgggcataaaagggttgtggcccaactttcaataattcctcaaaggggcgggaaagagtcatttaaaaggaagggtcacccgggtctccaaaaa

SEQ ID NO: 66390 - DNA, 961 bp, Zea mays
  misc_feature: Ceres CLONE 1539313
  misc_feature: Encodes the peptide sequence at SEQ ID NO. 66391
tttctgcttgtcagccccgcccctctgttggttctcttttttttaatagctggtactccccgcggtggcggccgctcttttaatagtggatcccccgggctgcaggatttcgtctcacccctagaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggtgcgttgccgcccaagaaggacctgcaccggttcgtcaagtggcccaaggtcgtgcgtatcctgcggcatcgccgcatccctcatgcagcgcctcatggtaccaccggccggtcatctagttcatccgtcaccccttctactaataacttcagctaccacacctggttttaaaaatgccttcttcaatgttccggtgtctggtaaaaacaacgggctggcccatggaataggaataggtcttttctcgaaattatagttcccccacgtgctggaaggacatggtaccgagacatgacatactggtttcggaacgcccccaaatctaaaatctcaaatttcgtcttgggctgaaatcatttcgcgagcttttaaggcccattggtggaatctttatactctattaatttgaaaggaataaaacacaaggggcttcaaccacactgcattggtccacccgcgccactactagatagatgggtaacacctcaatcttcgagatctttgttgtgttaggggtgtcttctattctcccttgttgtccagtgcgcgtgaatggtatcgctctctctcttctctgtctttgggcgtactatgtatatttgtttctcgttctcttgaccattcaatggtgttattcttcaaaatctatggtg

SEQ ID NO: 66391 - protein, 92 aa, Zea mays
  misc_feature: Ceres CLONE 1539313
MAPKRGGRAPVPAKKKTDKVTNPLFEKRPKQFGIGGALPPKKDLHRFVKWPKVVRILRHRRIPHAAPHGTTGRSSSSSVTPSTNNFSYHTWF

SEQ ID NO: 66392 - DNA, 848 bp, Zea mays
  misc_feature: Ceres CLONE 1539314
  misc_feature: Encodes the peptide sequence at SEQ ID NO. 66393
  misc_feature (1)..(1): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ncctctagttttttcgcgcggggggttatntannnggagagnnnnnttgaacaagcactccccgcggtggcggccgctctacactagtggatcccccgggctgcaggaattcgtctcacccctagaaaaaactcgccctcgtccgcagcgcccacgaaacgcgccgccgccgccgtgacatcgcagcggcgtcggcgtcgtctcggccgctccccgccgtagggccattttcgctcgagctgccggagaccatgtcgagcggtctagacatgtccctggacgacctcatcaagcagtctaagtcccgacccaaggccaaccccgcgtcctcgtcggggcctgcccgccgggcgcaccccgctcgcgccgcgccctacccacgggtcgttcccagggcccgtgcccccgcccactcgccttggggggtgggactccaagcatatcgcctttatggacccccacccgctccgcttgtcggctcaaagcatggttggttcggagaacgggaatggaaggtggccattggtcaaatctttggagtccggtgtgtacagtgcgagaaattgttctaggaagttcgtctctagaaagtgtgggggagtctcgggccggttatgtgaagataacctccggataccggatgggaggcagccgtagtcgggaagtcgcgcaagtttgagtgttcacgcgcgatatgtgtgagctctctggggagcggtgtacgtcgagcagtgccccggatgtgggcccgtcgggatgtggagtgccgagagcgttttgcaggaagccactcggcgaaagacagggccggatagcccgagtgctatatatctactatttgcgtgggg

SEQ ID NO: 66393 - protein, 56 aa, Zea mays
  misc_feature: Ceres CLONE 1539314
MVGSENGNGRWPLVKSLESGVYSARNCSRKFVSRKCGGVSGRLCEDNLRIPDGRQP

SEQ ID NO: 66394 - DNA, 884 bp, Zea mays
  misc_feature: Ceres CLONE 1539315
  misc_feature: Translation starting site: 178
  misc_feature (1)..(1): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (278)..(278): n is a, c, t, g, unknown, or other
  misc_feature (281)..(281): n is a, c, t, g, unknown, or other
  misc_feature (288)..(288): n is a, c, t, g, unknown, or other
  misc_feature (291)..(291): n is a, c, t, g, unknown, or other
  misc_feature (295)..(295): n is a, c, t, g, unknown, or other
  misc_feature (297)..(297): n is a, c, t, g, unknown, or other
  misc_feature (304)..(304): n is a, c, t, g, unknown, or other
  misc_feature (312)..(312): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (326)..(326): n is a, c, t, g, unknown, or other
  misc_feature (328)..(328): n is a, c, t, g, unknown, or other
  misc_feature (336)..(336): n is a, c, t, g, unknown, or other
  misc_feature (337)..(337): n is a, c, t, g, unknown, or other
  misc_feature (346)..(346): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (362)..(362): n is a, c, t, g, unknown, or other
  misc_feature (363)..(363): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (434)..(434): n is a, c, t, g, unknown, or other
  misc_feature (445)..(445): n is a, c, t, g, unknown, or other
  misc_feature (449)..(449): n is a, c, t, g, unknown, or other
  misc_feature (454)..(454): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (484)..(484): n is a, c, t, g, unknown, or other
  misc_feature (499)..(499): n is a, c, t, g, unknown, or other
  misc_feature (501)..(501): n is a, c, t, g, unknown, or other
  misc_feature (508)..(508): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (528)..(528): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (548)..(548): n is a, c, t, g, unknown, or other
  misc_feature (568)..(568): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (614)..(614): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (641)..(641): n is a, c, t, g, unknown, or other
  misc_feature (642)..(642): n is a, c, t, g, unknown, or other
  misc_feature (649)..(649): n is a, c, t, g, unknown, or other
  misc_feature (655)..(655): n is a, c, t, g, unknown, or other
  misc_feature (690)..(690): n is a, c, t, g, unknown, or other
  misc_feature (692)..(692): n is a, c, t, g, unknown, or other
  misc_feature (726)..(726): n is a, c, t, g, unknown, or other
  misc_feature (730)..(730): n is a, c, t, g, unknown, or other
  misc_feature (731)..(731): n is a, c, t, g, unknown, or other
  misc_feature (758)..(758): n is a, c, t, g, unknown, or other
  misc_feature (759)..(759): n is a, c, t, g, unknown, or other
  misc_feature (761)..(761): n is a, c, t, g, unknown, or other
  misc_feature (765)..(765): n is a, c, t, g, unknown, or other
  misc_feature (769)..(769): n is a, c, t, g, unknown, or other
ntttccccttttnataannnnnnnnnnnnnnnnaaaannnnnnnncaacctggagctcccccccggtggcggccgctctagaatagtggatcccccgggctgcaggaattcctctcacccctagaaaaagatctcaagctcgccgcagaacgacaggacccaaaccccaattccacaatgaggccgtcgctgatgagatccacctcccagctccgccgccggcggagctactcctccgcatccgggcagcccgagcggaagggggccattctctgggnggnggggggnatngggnanccggggncggtgttnttgnnnnnnnnccntnggcgcccnncgggggttntannnatttttggggnngcgttgaggtgggggnnngannnnttnggnnnnnnntttttttttnnncccccgtnnngggggccaagaanggggggggaantcgntgagnaggggtgggannnnnnaccnnnnatggggnggggatataaccagnanacaaccntctcggggnnnnanngcganacagnnntactggacgtcgncggagttaagtgggtgatgngcccggaggggtnnnngtatagacccgacccgccgcctagcacgtncgccgccgggcgctannnataccctcnntccctcngcggtnacacgcgacccgttccattccggtttgatattgtntncgtcgccgacgggggacagcacagccaagaccgnttcnngttctcgaacgacgacagagtgttgtnntntgcnccgngagcttggtagccaagcgcgcacacgacgcatccgtcgcgcttggggcgcgtgccacagtgtctctcctactgcatcggaccaactccctcaccgcgcggtgcggcgcggtccgc

SEQ ID NO: 66395 - DNA, 739 bp, Zea mays
  misc_feature: Ceres CLONE 1539320
  misc_feature: Encodes the peptide sequence at SEQ ID NO. 66396
tcagtactagtggatcccccgggctgcaggaattcgtctcacccctagaaaaaaagacggccgccatctcccctgttcggttttaggagacctgcgccgctcctccggccacgcgagcacgccgaaatggtcgcccacaggttccatcagtaccaggtggtgggtcgcgcgctgccgaccccgaccgatgagcaccccaagatctaccgcatgaagctctgggccactaacgaggttcgcgccaagtcgaagttctggtacttcctgagaaagctgaagaaggtgaagaagagcaatggccagatgctcgccatcaacgagatcttcgagcgcaaccctaccaccatcaagaacggcggcatctggctgcggtaccagagcaggaccccctaccacaacatgtacaatgagtaccgcgacacgaccctgaacggcgccgtggagcagatgtacaacgagatggcctcgccgccccgcgtacagttcccctgcatccagatcatcaagactgcgacggtccacttcaagctgtgcaagagggacaaccctaaataattccacaacttcggcgatcaaattccctgcttcgttgtaccgctagggggaggccttcctcccctggaaatctcgggaccaccttttatggtgtgccaggccccacccctgttcatggtgaatggggccctcggcgggcccggcctagtccctccacacttttgttttatttgtgcttcagcgg

SEQ ID NO: 66396 - protein, 142 aa, Zea mays
  misc_feature: Ceres CLONE 1539320
  misc_feature (5)..(142): Pfam Name: Ribosomal_L18ae Pfam Description: Ribosomal L18ae protein family
MVAHRFHQYQVVGRALPTPTDEHPKIYRMKLWATNEVRAKSKFWYFLRKLKKVKKSNGQMLAINEIFERNPTTIKNGGIWLRYQSRTPYHNMYNEYRDTTLNGAVEQMYNEMASPPRVQFPCIQIIKTATVHFKLCKRDNPK

SEQ ID NO: 66397 - DNA, 804 bp, Zea mays
  misc_feature: Ceres CLONE 1539321
  misc_feature: Encodes the peptide sequence at SEQ ID NO. 66398
  misc_feature (19)..(19): n is a, c, t, g, unknown, or other
ggttttgggggcttttttncggtggtttccgttggtgtgttgtgggtgatagctggagctccccgcggtggcggccgctctagactagtggatcccccgggctgcaggaattcgtctcacccctagaaaaaatcagccatctcctcccgcggcaagtctctctgaattgtgggtctccggcgatggcggctctagctccatccaagattctgggcaccaagctcgacttcgccggctcctcccgctacaccacggcagcgcccaccgcgggggctcagaagatcgtctccctcttcagcaagaagcctgcccagaagcccaagccctctgcggtgtcgtcctcttctccggacatcagcgacgagctcgccaagtggtacgggcctgacaggaggatctacctgcccgatgggctcttggaccgctcggaggtaccggaggtactcatcggatagggcccccgagactattggctacgacccttttgggcctgggcaacaagccttatgactttccccaggtaccgaggccttcgaagctgattcgtgcccagatgggcccatgcttcggtggccgcgggcgcgggtgtccccagagggcggggaaaatgatattgggcgcgtaaacaggcggaccccgaggtgcgtcttggggttcagaaccgggggcccctggttcctgggacgggcgaacacctggcggcttattattgggaatcgggaatcggtccgtcaagcgtgatatgttaacccgggaatccgcttaaaggttcgtactcctcggtctggcgggaaacccacagaa

SEQ ID NO: 66398 - protein, 90 aa, Zea mays
  misc_feature: Ceres CLONE 1539321
MAALAPSKILGTKLDFAGSSRYTTAAPTAGAQKIVSLFSKKPAQKPKPSAVSSSSPDISDELAKWYGPDRRIYLPDGLLDRSEVPEVLIG

SEQ ID NO: 66399 - DNA, 790 bp, Zea mays
  misc_feature: Ceres CLONE 1539328
  misc_feature (38)..(38): n is a, c, t, g, unknown, or other
  misc_feature (41)..(41): n is a, c, t, g, unknown, or other
gtaggtcggaggtggggggttgtcgctgccggaggggntgncctatactgcggcctgagcttgtcgacttgagctttctctttcgtggatcccccgggctgcaggaattcgtctcacccctcgacaagaacacacacaacacagcagagagattactacgatgccccagttctagagcaagagagaggaagacacaccgcagagttagcaggctaataacttgcaggagcagcaggaatggcggcgacgcgtcgcctctcttgccttctcctcgccgtgcttctggcaggagtggccgctgccaccgccttcgacgaagcggctgctgccggcttcgggcttggccacggcgcgcgtttcgcgcgcaagcatggacgagctgccgctgagatgccccagccggagccacaacctaaaactaagccggagccccatatgcagccactgccccacccacaacctaaaccgaaacctatgctcacatccagagccaaagcctgaacctcaaccaaagcccaaccctgaacctcaaccaatgcccaagcctctaccaaaatccaaaccagagccattgcctacaccgaaagccagaacctaagcccgaaactaagccagagcctaagcccgaaccggaaatgaagcccaagccaaaacctgaatctaaaccagagccaaagccagattacaaaccctgagcccaaagcccgagccccgaaccaaaaccaggagccgtaaacccgaacccaaaacccgaacccaaagcccaaacccgccacccaataacagaggc

SEQ ID NO: 66400 - DNA, 724 bp, Zea mays
  misc_feature: Ceres CLONE 1539331
  misc_feature: Encodes the peptide sequence at SEQ ID NO. 66401
atagctggagctccccgcggtggcggccgctctagaactagtggatcccccgggctgcaggaattcgtctcacccctagaaaaagttcacgtgtaggatagctggataggcatcggcgcgcgccattcccattcgtgtggttactatactacacacaggaataataggacgcggccccggccgcctccgatctcagctctccgttaacacgcaaacgcaagctcccaagcagctaccaaccagccgggagagggagcgcacgcactgcgacaatggccacggccggcggaggggccgggcatctgaagctgctgggcgcgtggccgagccccttcgtgaaccgcgtacgcatggcgctgcacctcaaggggctggagtacgagaacgtggaggaggacctcaccaacaagagcgacctgctcctcgcctccaaccccgtccacaagctcgttcccgtcctcctccacggcgacaagcccatctccgagtcactcgtcatcgtggagtacctcgacgacgccttccccggcgctggccaggccgtcctcccccgcgacccctatgaacgcgccgtcgctcgcttctgggccaaatacgtcgacggcaagttgcacggcatgatggtgaaggcgctcatgggggcaaccgaagaagagagggcgacggccaccgcggacgcgctggccgctatggacagctggagggggcgttcgcccagtgctcc

SEQ ID NO: 66401 - protein, 150 aa, Zea mays
  misc_feature: Ceres CLONE 1539331
  misc_feature (9)..(82): Pfam Name: GST_N Pfam Description: Glutathione S-transferase, N-terminal domain
  misc_feature: SWISSPROT Homolog: EC 2.5.1.18 Glutathione transferase
MATAGGGAGHLKLLGAWPSPFVNRVRMALHLKGLEYENVEEDLTNKSDLLLASNPVHKLVPVLLHGDKPISESLVIVEYLDDAFPGAGQAVLPRDPYERAVARFWAKYVDGKLHGMMVKALMGATEEERATATADALAAMDSWRGRSPSA

SEQ ID NO: 66402 - DNA, 714 bp, Zea mays
  misc_feature: Ceres CLONE 1539332
  misc_feature: Encodes the peptide sequence at SEQ ID NO. 66403
  misc_feature (237)..(237): n is a, c, t, g, unknown, or other
acccgcggtggcggccgctctagaactagtggatcccccgggctgcaggaattcgtctcaccccaaatcgttatcacctaaataaccagtcaagtcgcaagtatgaatggacttttgaggaccattgtgccctgttgaactcatgtattaccttgtgaagtccgttgtgtctggtttctacctgaccgtttcgttatctgatgctgtttctttaatatctgatgctgcttcattcgntataatgccaaaaaaaaaaaaaaaaaaaaaaaaaaaaaaggcccaaatcccccgactcctcgcttcctcccgttccgtcgccgccgcgcgcctcggagaagagatagaggcggccgctgcatcgaccccgcgccacccccgcctgcctcccccggcaccgatcgggtttgatcgatggcgtcgaagaggatcctgaaggagttgaaggacctgcagaaggacccgcccacctcctgcagcgcaggtcctgttggtgaggacatgttccattggcaagcaaccatcatggggccttcggacagcccatttgcaggtggggtattcttggtgaacattcacttcccaccggattacccttttcaggccaccaaaggtgtcttttccgcaccaaggttttcccccctaacatccacagccaacggcaagcattttgccttgaaatttcttaaggaaacagtggaagtcccttgctttaac

SEQ ID NO: 66403 - protein, 101 aa, Zea mays
  misc_feature: Ceres CLONE 1539332
  misc_feature (5)..(97): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPVGEDMFHWQATIMGPSDSPFAGGVFLVNIHFPPDYPFQATKGVFSAPRFSPLTSTANGKHFALKFLKETVEVPCFN

SEQ ID NO: 66404 - DNA, 700 bp, Zea mays
  misc_feature: Ceres CLONE 1539333
  misc_feature: Encodes the peptide sequence at SEQ ID NO. 66405
  misc_feature (684)..(684): n is a, c, t, g, unknown, or other
gagctccccgcggtggcggccgctctagaactagtggatcccccgggctgcaggaattcgtctcacccctagaaaaaccctagaaaaaagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgagggtaccgcgtcgccggcggnccgctcggagaggtgg

SEQ ID NO: 66405 - protein, 183 aa, Zea mays
  misc_feature: Ceres CLONE 1539333
  misc_feature (63)..(183): Pfam Name: Chloroa_b-bind Pfam Description: Chlorophyll A-B binding protein
  misc_feature (178)..(178): Xaa is any aa, unknown, or other
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGTASPAXRSERW

SEQ ID NO: 66406 - DNA, 704 bp, Zea mays
  misc_feature: Ceres CLONE 1539334
  misc_feature: Encodes the peptide sequence at SEQ ID NO. 66407
  misc_feature (367)..(367): n is a, c, t, g, unknown, or other
  misc_feature (704)..(704): n is a, c, t, g, unknown, or other
tcccccgggctgcaggaattcgtctcacccctagaaaaaaaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcaccantgaggaactgcttgaggatgttcttggtggcaaggacgccctcagagccttcaaggaatctgaagagaagggttatcttgaagtcgagaccgaagggttaaagcagctcacgtccatgggtagccttgtactgtgctgtggagatggcgccgttatgaactcaaccaatctaaggctgctgaggcatggggtctccaatttggattgatgttcctcctgaaatggcagcaaatgaaatggtgaaaaaccacggggaacccaggctacctaacggatccaaaacacttttttttcaaggcaaagaagcaaagcctcccttcagccgggaataaataan

SEQ ID NO: 66407 - protein, 175 aa, Zea mays
  misc_feature: Ceres CLONE 1539334
  misc_feature: SWISSPROT Homolog: EC 2.7.1.71 Shikimate kinase
  misc_feature (107)..(107): Xaa is any aa, unknown, or other
MAMRAATAAATGFFSPSTVPPRRFSSVTPPASLCTARCIQRHRLRAFPSLEIPLEELNPSVDLLRRTAEAVGDFRKTPIYIVGTDCTAKRNIAKLLANSIIYRYLTXEELLEDVLGGKDALRAFKESEEKGYLEVETEGLKQLTSMGSLVLCCGDGAVMNSTNLRLLRHGVSNLD

SEQ ID NO: 66408 - DNA, 696 bp, Zea mays
  misc_feature: Ceres CLONE 1539337
  misc_feature: Encodes the peptide sequence at SEQ ID NO. 66409
ggatcccccgggctgcaggaattcgtctcacccctagaaaaacagcggcatctataggaaccggtccagcactttcacgctcagctccagcaatggctgcctccaccatggcgatctcctccacgggaatggccggcacccccatcaaggtgggctccttcggcgagggccgcatcaccatgcgcaagaccgtgggcaagcccaaggtggcagcgtccggcagcccctgatacagccccgaccgcgttatgtacctcgggcccttctccggcgagcccccgagctttcctctgcggcaagttccccggcgactaacgggctggacttcttccgcccccccccccggagggggagggggggcttttataactccttgtttgtatgtataccattcccgccccgcccagcccccacacgttcgactgggattgccaccaaactatatacccccaatggcatttaacgcatatgaaccaagctggtttatggggacctctcctgattacttgggaaagggggagtagaaatataactttagactctttagggattatctatcgttcgttgctaaacctgcccatcagggtttatcccatatccatttttacgccgcgatcataaattcgtctttcttcatattcaaattctcaacctgttcataaaagcattttatatagctcctctacccctcttatc

SEQ ID NO: 66409 - protein, 45 aa, Zea mays
  misc_feature: Ceres CLONE 1539337
MAASTMAISSTGMAGTPIKVGSFGEGRITMRKTVGKPKVAASGSP

SEQ ID NO: 66410 - DNA, 901 bp, Zea mays
  misc_feature: Ceres CLONE 1539339
  misc_feature: Encodes the peptide sequence at SEQ ID NO. 66411
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (312)..(312): n is a, c, t, g, unknown, or other
  misc_feature (483)..(483): n is a, c, t, g, unknown, or other
  misc_feature (567)..(567): n is a, c, t, g, unknown, or other
  misc_feature (638)..(638): n is a, c, t, g, unknown, or other
  misc_feature (774)..(774): n is a, c, t, g, unknown, or other
ccccccnnnnnnnnnnnnnnnnnccannntnnnccggcccnnccccccgggggtccccgcggtggcggccgctctagaatagtggatcccccgggctgcaggaattcgtctcacccctagaaaaatcccacgaagcagagcaaagccaaagcaatctcaagtgaatcaaaccgccagacttcggagtcctcctccccactaccagagcatgcgcgttgccgcgacccgagccgccgtcgtcgctcatcctccgagcgccttcctgctcctcctgttactcctcggttgcgcgtctctcgcgatcggaggaanacgcatgggcggccacgtcctcggcggcggggaagaagaaccaagcctagtgctttttcgccgaagtcggaggggcttcggccggcggcaggcgttggatttttttccccccccccccccgagggggggggggggggggggttcccctccttatcccaaccccccctcganccagatctctatcccccactaaatcgcacatcctcccttcgcgcgtgaacgggacgggctcacgtcgggttaggaggccccctncgtcgatctaagcggcagagagtgccgcggcgcgaaggagggggaggaccgccggggggttccggcccgcngtgacttggctagtttcttcctacacaacaggtaggaacagtgaaattgtcgaagaggcttgcagcgcagagcgcacactttgtgattgtggttaaaaaatatgttaatgatagccgcccggtgtttttatacgtnatgatccccgcgggcggaacattcgtggtgctcggatctctgtaggttgcctacgccccgggcagtacggcacctataacccctgggcgttacgccgccctcagccctcctcctaagtccccctcac

SEQ ID NO: 66411 - protein, 62 aa, Zea mays
  misc_feature: Ceres CLONE 1539339
  misc_feature (56)..(56): Xaa is any aa, unknown, or other
MGGHVLGGGEEEPSLVLFRRSRRGFGRRQALDFFPPPPPRGGGGGGSPPYPNPPSXQISIPH

SEQ ID NO: 66412 - DNA, 832 bp, Zea mays
  misc_feature: Ceres CLONE 1539340
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
  misc_feature (42)..(42): n is a, c, t, g, unknown, or other
nnnnnnnnnnnnnnnnnnnnnggcgggggnccccggcgacanatatcaatctggagctctccgcggtggcggccgctctatactagtggatcccccgggctgcaggaattcgtctcacccctagaaaaaaacgcgcgccaggcaagcaacaatggacaagcttctgacgccttggtacgcgggcttcgtgagaagattcatccacacggtcacggtggcatcagtcgcagacgccgcgctccagcgcgcgtgcccatttgtcaatatggaggatgtcttcggtagcatgggagtcgcgcgaccggcctacgctgcttgtggcggttttcctggttgccggcatggtgacactagagtgcctgccccgtccctcagctcgtgtccctggtggagtacggctgcttcatacctaggccgtagtattcccgggcgccaactcgccacggtgcctgaaccacaagctacctcgatgcccccccccggtgtaaccgtacaagcagcgacctgctttcgaaaaaccagcccgactctaagcgctcaagcgcctagttttgaccaccacaccggccttgcccataatccctcactccctacctcgtccaacccgggaccgccgggacccctgccagctcatcccactggaagaaacggcccccagcccgcgaccccgcccccaccccgccccccgggcgccaggccccgcccgcacccctccgccttgagcaccgcgcgagcccccggcgccgtcccgcggacgtcgcctccttcccggcgcgaactcccgacgcaggctcgaccaccgccaagcagcgcctgccccatacggccccga

SEQ ID NO: 66413 - DNA, 784 bp, Zea mays
  misc_feature: Ceres CLONE 1539346
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (51)..(51): n is a, c, t, g, unknown, or other
  misc_feature (53)..(53): n is a, c, t, g, unknown, or other
nnnnnnnnnnnnnnnnnnnnnnnnnnnngggagnngnggnnaaaggngggnanaaaaaatggagctccccgcggtggcggccgctctagaatagtggatcccccgggctgcaggaattcgtctcacccctagaaaaattccccatctccggataaaagataaggagtgtctctcctttgccatcctcctctctttcagctaagtccctgccccctctctttttcttacattcaggtcctcgcagctcctctcttttttcttgtatctttcgatctgcgagccgtccaagtacagtactcttctttccctcaaggaactcttgcagccggcccctctggtttcctcgaattcttgttccccggtccctcctcctgtccccgcgtatatccgtccgtccgaggagcacaccgtccccacccccatgtttacccaccagttcctctgacggccgccgtgctccgatgaagctgagcgtgctccgtatccgccgctcccactccttctccgtcaccttcctctactggttctacgtcttctcatgaacgcatcgcccctctccaactgctgatccttcaccgtctctccctctctctttctcttcagaaaaaatctttcgaaatcatcacaagggctccctgttttctccccatccatcccccccaccccaaccccccaaaaaaaaagaaattaattcccaaaaaaaaaaaagaaatccagggaacctcaaacccacgccccggaaatttcgggagccctcggaagaggctaaagatacccccagccg

SEQ ID NO: 66414 - DNA, 783 bp, Zea mays
  misc_feature: Ceres CLONE 1539347
  misc_feature: Encodes the peptide sequence at SEQ ID NO. 66415
  misc_feature (20)..(20): n is a, c, t, g, unknown, or other
  misc_feature (30)..(30): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (578)..(578): n is a, c, t, g, unknown, or other
gtgctaaaaattttattatnaaagaaaccnccgcgnggggggnnattaaaatggtgctccccgcggtggacgccgctctacaactagtggatcccccgggctgcaggaattcgtctcacccctagaaaaagacgggctcctggcgctgctctgagaactggatatgctgggcctagcacccctccgctctgcgcctcttcctatccgcgcctccgccaccgcctgcggtcgaaataactcgcggctcgccaatggctgccaactctctcttctcgcgccagatgcggccgaaggtgacacggcgctgccggagaacatgcacaagtggaggatggtcatcgcctacgatggaacaaagttcaaaggttggcagtatcaaccatcaattccaacaatacaatattttctagaggatgcgctgatatgcatcactaagctggatcggaagaaactatgcttagtcggtgcaggcaggactgatactggagttcatgcatggggtcaggaggcacattttactacacccgtcagttacagttgccccagaaatattcattcggcaatgaatggactccttnctcctgagattcaagtcagggaaattagtgcatcacgtcctgaattcaatgctcgcctcatccccaaagagcaaaagtctaatcgctacaaatactctataaaggaaagcaattaatgggatccgctttccataatcacttatgccgtctacacaaccgccttaataatgcttcacgtcccccatgccaaatggcagggaggggc

SEQ ID NO: 66415 - protein, 125 aa, Zea mays
  misc_feature: Ceres CLONE 1539347
  misc_feature (6)..(108): Pfam Name: PseudoU_synth_1 Pfam Description: tRNA pseudouridine synthase
  misc_feature: SWISSPROT Homolog: EC 5.4.99.12 tRNA-pseudouridine synthase I
  misc_feature (88)..(88): Xaa is any aa, unknown, or other
MHKWRMVIAYDGTKFKGWQYQPSIPTIQYFLEDALICITKLDRKKLCLVGAGRTDTGVHAWGQEAHFTTPVSYSCPRNIHSAMNGLLXPEIQVREISASRPEFNARLIPKEQKSNRYKYSIKESN

SEQ ID NO: 66416 - DNA, 891 bp, Zea mays
  misc_feature: Ceres CLONE 1539348
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
nnnnnnnnnnnnnnnnnnnnnnnnnnnnnnnnccccccaccccacccaacaaaaaaagggggagggaatggagagcgtggcggccgctctacagatagtggatcccccgggctgcaggaattcgtctcacccctagaaaaacaggctcgttctccgcgttgccggacctcgtacccagtgaccatatggaggtgctcttctcctgccccacggttctccccatcggcctgctggcttcatcccccgcgtcccacgataatgatcctcatcagtcatgtgggcggaaattgatagatcagatccttatttcatcccgcggtggttgcggctgatattcaccttcacggttacaatttgtcgacttgttcttggaacttatttctacattatgatgtttatggacctgcgttcttagacttctgagcgtagtgtacagattctcttgtgtcggtgaaggagtcgcgctcatctatgtatagatacggcatcgcgaaacacggtcagcgcacaggattagcacccctttaggattaatattgatatttatatataatccctccgaatgttgaatagaaagatagtgtaacacgaatgtcgtggcgtgggggttgatgcgcgattatattttttagcagttatcacccggtatttcctcgaccttccttatcatccctttttaaacaatggcaaggaataaataatgaaagacgaaaagtgagacacgtggttgattccattgaatccgcaataacatctcgaaacaattattggcaatgaactgatatatttgctttaatgctagttaaacaactgggatgcaaacccaaacttgcgtggaataaatcaccgttgagaaaacagtaaaagggggggaaactgccagagccgagt

SEQ ID NO: 66417 - DNA, 839 bp, Zea mays
  misc_feature: Ceres CLONE 1539349
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (53)..(53): n is a, c, t, g, unknown, or other
  misc_feature (54)..(54): n is a, c, t, g, unknown, or other
nnnnnnnnnnnnnnnnnnnnnnnnnnnnaaaaaaccgacgataaatgatatcnnactagactaccggcgatggtggccgctctagaactagtggatcccccgggctgcaggaattcgtctcacccctagaaaaaatgttaccgcttgtgttctaggctgccttagttagcctcgcattcctgggaggaggagaaggacaaggtctctgatcagcctccagattgtctggtcaaagctgaggagcctgcttgtgctgcctgtgtattcctaaatcgataggaccactgccactgtgaagcctacgtctgccggccacgagacctaggacccttaagctgcccatcggataagatctacccaaaattgtagaccaatgacgtgtcggccacttgccgccgccccccgcgtctgccggtgcttggctcccagtggcccttcttgcgcagcagcaggggcaagtccgaccccaacccgcaagcagcacctcaccccgccgtcctccgctttggctgctgtttaaagcaccaaaaaaacagtcgcgccgcgcgcgcccgcctgtttcccgcatttcacgctatctccctaggcgggcgaaccctcaatctgcgcccccccaatgctcccattggcccgcggccggcaatgcccccctccttcttccccaacccatcatgcccttttttaaggtcacccctatgataatattccagcgcaaccgcccacaccacccaccccccctactctccccctctcctctcacatctatggagggctcgacccattatgcctcccgcgccccccccccccgggagaagcacaggacctcctcctcatatatg

SEQ ID NO: 66418 - DNA, 542 bp, Zea mays
  misc_feature: Ceres CLONE 1539355
  misc_feature (396)..(396): n is a, c, t, g, unknown, or other
ggagctccccgcggtggcggccgctctagaactagtggatcccccgggctgcaggaattcgtctcacccctagaaaaaaggaccatggcagcctccgacctccgtctctctccatccccacctcgggcctcctgaccctggttagcttctgctttttactccatgcaaggacgaaatggcgaacgcctcgtcgccactccctcccttcggcttcttctccctcgcggctatttcctgggaggctgttgaggtggccgcccgcaaaataagggtttcggggtcaaaaaaacgccaataaacgtccccaggcggggaaaaaaaaaattggggggccttccaaggggcaagggaagaaaaatcttaaggggccctttgtcccccccaattccccagaanaagagggtttgttcccccccctcccaaaaaaaaaaattttgggcccaaaaatttttttttggggggggtatctcgtggggtgggggaaatttttctttttttttttgggcgccgcccgctgaaaaaacaaacacaatttctaatta

SEQ ID NO: 66419 - DNA, 693 bp, Zea mays
  misc_feature: Ceres CLONE 1539358
  misc_feature: Encodes the peptide sequence at SEQ ID NO. 66420
ggatcccccgggctgcaggaattcgtctcacccctagaaaaaaaaaaaaaaaaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggtccgagtcctccgaagtcaagtccaccccgttgcagccctacagcgagggtgtcggcctccagcggttcggcgagtgcgagctcatcccacgccgctgggccatggttcccacccttcggcgccctctccggcgaagggctccacgggcttcacctggaaggacccccgccaagggaaacttggggaaccgttcccccctacttggggcaagcccttgccgtttctctttttgaacccttttctgatacaagggccccggaat

SEQ ID NO: 66420 - protein, 190 aa, Zea mays
  misc_feature: Ceres CLONE 1539358
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRSESSEVKSTPLQPYSEGVGLQRFGECELIPRRWAMVPTLRRPLRRRAPRASPGRTPAKGNLGNRSPLLGASPCRFSF

SEQ ID NO: 66421 - DNA, 780 bp, Zea mays
  misc_feature: Ceres CLONE 1539359
  misc_feature: Encodes the peptide sequence at SEQ ID NO. 66422
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
nnnnnnnnnnnnnnngggggggggggannnnnnngggtaagctgtgcaaaggtggagctccccgcggtggcggccgctctagactagtggatcccccgggctgcaggaattcgtctcacccctagaaaaaagccggcgtcgcgtttccgacaggccagtcccctcccactcccagtcccatctcgacgacatggccgcagccgcagggccatcaagctctgtgaaggagacgctcccgccggccctcggctccacctcccagccacctcccgtcttcgatggcaccaccagactgtacatctgctacttctgcccgttcgctcagcgcgcctgggtcaccaagaacttgaagggtttgcaggacaagatggagctggtggccatcgatctgcaggacaaaccggcttggtacaaggacaaggtttacgcactgggcacggtgccttacctggagcacgacgtcgaggtcacgggcgagagcttgaacctgatcaggtacatcgaccgcaactttgacagcccctctctgctcccagaggatgctgcgaagaggcagtttgctgacgaaccgttcccgtctgcccacgcgttgccccaaggccctctactctccctttgccatcccgagcggtcggggtcagacgaatttgtttgcgggctctggcagaaactcccaaccctgacttttccctaattgggacgacggggtccttgcggtcttggggccaatttaaagctaggggggaagctaggcgtaccaatgcgagttctggggaaagg

SEQ ID NO: 66422 - protein, 167 aa, Zea mays
  misc_feature: Ceres CLONE 1539359
  misc_feature: SWISSPROT Homolog: EC 2.5.1.18 Glutathione transferase
MAAAAGPSSSVKETLPPALGSTSQPPPVFDGTTRLYICYFCPFAQRAWVTKNLKGLQDKMELVAIDLQDKPAWYKDKVYALGTVPYLEHDVEVTGESLNLIRYIDRNFDSPSLLPEDAAKRQFADEPFPSAHALPQGPLLSLCHPERSGSDEFVCGLWQKLPTLTFP

SEQ ID NO: 66423 - DNA, 963 bp, Zea mays
  misc_feature: Ceres CLONE 1539362
  misc_feature: Encodes the peptide sequence at SEQ ID NO. 66424
  misc_feature (15)..(15): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (47)..(47): n is a, c, t, g, unknown, or other
  misc_feature (963)..(963): n is a, c, t, g, unknown, or other
gggggggaggggggngcgggnnnaannccacaccatagggggggggnggggacccctggtactccccgcggtggcggccgctctagactagtggatcccccgggctgcaggaattcgtctcacccctagaaaaaatccgccgccgccgccatgccgggcttcgctcagcgtctcgcgcggatcccgtggcggagcgtcgcgaggcaaggcctctcccgcgtgttcctggtggcgacagcctactgcttgatccacgtcgtcaacaaccacctctgctcaatgacctccgtgccgggcgccagcatgctgccataccctgaacctgaacctgctatctccgtggcgttggaacctggccccgcgtgaagcctcgaccgggttcccgccggggccacatcaacgctttgatcatcccccccctgatacacccgactcaacctccggttcgatcaaggcgcgtgccggcgtgggagtgcagggggggacctccctccaaccaacccttctggccaccccccgcgccccatgtcataaatccctcctcataaacccgtctccgtgtcctaccatcctccgattccttgggtctcgcggggtggccacaggcggtcgacacagctttctccgctttggttcttccctggcagcatgtatcatatagggatgtatttaggagagtcaggttgatcttttctgctggcccctcaatctacccccccgctaggcattctcttttagagagtgggaggggtaggggatgagttggtgtaatgttcatatcggcatgctttcttgcctgtgattacattcccgtacagccagtgtcccttactccctccgcgctacggatcccactctccatgtcgcgcgttcccacaacactgtcgtgcgaaactcccaccaacacttcccgccaccccaccccccctcgactacacgccccaccgctccccgcccgccccn

SEQ ID NO: 66424 - protein, 71 aa, Zea mays
  misc_feature: Ceres CLONE 1539362
MPGFAQRLARIPWRSVARQGLSRVFLVATAYCLIHVVNNHLCSMTSVPGASMLPYPEPEPAISVALEPGPA

SEQ ID NO: 66425 - DNA, 753 bp, Zea mays
  misc_feature: Ceres CLONE 1539366
  misc_feature: Encodes the peptide sequence at SEQ ID NO. 66426
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
ttttnnnnnnnnnnnnnnnnttttttnttaattttggnnccgnngctaaactggagatccccgcggtggcggccgctctagaactagtggatcccccgggctgcaggaattcgtctcacccctagaaaaaaccgccttcttctcaccagcccctctcgcctcacgaaaaggcgcaggccaaggccaaggccaagccgccccctccctcctctcgtctccactctctctctctctctggcagccaaaggcgaggccgagatccggcgcgcggaggatgccttccaggtccatgagccggctgtccgtcgagtccgcctcgggcagcgggggcggctgccgggaggccgagccggtgctctgcgcgcctcggccgcgcagggcccagcagcagctggtccacgtccacccccgcggcgccgacctcatcctcggcccgccgcccttcctgctcaacgagagcagcgaggagggtcgctgcagctgggcggcgttgggcggcgggtcgccgccggcgcgcgcgggcaacccgctggtgcacgaccccagcttcctgctgagccagcgccaccccgcggcggacccgccgctggagctcggcttcttcgaccacctgatccgcaccagcagctacgtgcaccggccgacgacgacgacgtcgtataccagctccggcaccagcagcagcggcggcagtagcagcaagagcagttttggccccgtcgtcgttcgcgcccgccgtgaagatccagggga

SEQ ID NO: 66426 - protein, 159 aa, Zea mays
  misc_feature: Ceres CLONE 1539366
MPSRSMSRLSVESASGSGGGCREAEPVLCAPRPRRAQQQLVHVHPRGADLILGPPPFLLNESSEEGRCSWAALGGGSPPARAGNPLVHDPSFLLSQRHPAADPPLELGFFDHLIRTSSYVHRPTTTTSYTSSGTSSSGGSSSKSSFGPVVVRARREDPG

SEQ ID NO: 66427 - DNA, 666 bp, Zea mays
  misc_feature: Ceres CLONE 1539370
  misc_feature: Encodes the peptide sequence at SEQ ID NO. 66428
gcggtggcggccgctctagaactagtggatcccccgggctgcaggaattcgtctcacccctagaaaaaaagctatagaagaagagaaacggaagaggcacagcttatacccatccactgaccgcgaagtgcacagagggggggaaggaaggagacaccacccagatcgagttaccgtctgcgaggaggaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcgggaacccctgcggcgagccgtgcgtgtacgcgagcccgccgccgccgccggtctactacccgccgccgccgccgcccgtgtactcgccaccgccgccgccggagtactacccgccgacgaccccgaccccgaccacgccctactgcccgccgccgccgtcgggcggcggctacgagccgtcgcccggatacacgcccgggtacaacccgacgccgccgtccggctccggctggtacacgccctcgtacaactcgccgccgggcacgctctacccgcaggaccccgggttccggcccaacgccgcgccggcccgcgtcgccgcgccgtggcgcg

SEQ ID NO: 66428 - protein, 149 aa, Zea mays
  misc_feature: Ceres CLONE 1539370
MARRPRPCAHLTATLLLLAVAAAVARAADGDEKCGSPCGNPCGEPCVYASPPPPPVYYPPPPPPVYSPPPPPEYYPPTTPTPTTPYCPPPPSGGGYEPSPGYTPGYNPTPPSGSGWYTPSYNSPPGTLYPQDPGFRPNAAPARVAAPWR

SEQ ID NO: 66429 - DNA, 704 bp, Zea mays
  misc_feature: Ceres CLONE 1539373
  misc_feature: Encodes the peptide sequence at SEQ ID NO. 66430
  misc_feature (478)..(478): n is a, c, t, g, unknown, or other
ggagctccccgcggtggcggccgctctagaactagtggatcccccgggctgcaggaattcgtctcacccctagaaaaaaggaacgcacacagtgacacaggagcaaaaggccacagtactgctagcagtaggcagtagcagctagcgggcgggacgcgcgtgaccggcggcagtcatgtcgacgacggagccgctcctctcggccggcggcaatgatggcgaggcggggaagaagcagaagcagaagagcagcggcgagggccggcggcgcgtgagcatcgacgaggcgctgtcggcgcacgcgggggagttcgggcggtggcagctgcagcacttcgtgttggtgtccgcggcgtgggcgctggaggcgctgcacaccatggtgatcatcttcgcggaccgtgagccggccacgtcctgcgccggcgccgacgcggtgtgcggggacccctgcgccggcgccggcacggccggtggnaagtgggccggcggcgccgcggcgtcgaccgtcgccgagtgggggctcgtctgtggcgagcgctacaaggtcggcctcgcccaggccgtgttcttcgccggctgcatgatcggcgcgggcgtgttcggccacctctcggactcgttcctgggccggaaggggtcgctgcaggtggtgtgcgtgctcaacgccgccttcggcctgctgaccgcgctggccccgacct

SEQ ID NO: 66430 - protein, 176 aa, Zea mays
  misc_feature: Ceres CLONE 1539373
MSTTEPLLSAGGNDGEAGKKQKQKSSGEGRRRVSIDEALSAHAGEFGRWQLQHFVLVSAAWALEALHTMVIIFADREPATSCAGADAVCGDPCAGAGTAGGKWAGGAAASTVAEWGLVCGERYKVGLAQAVFFAGCMIGAGVFGHLSDSFLGRKGSLQVVCVLNAAFGLLTALAPT

SEQ ID NO: 66431 - DNA, 779 bp, Zea mays
  misc_feature: Ceres CLONE 1539375
  misc_feature: Encodes the peptide sequence at SEQ ID NO. 66432
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
nnnnnnnnnnnnnnnnnnnnnnnnnnnnnnnccacaaccgaaccaacaatggcactccccgcggcggcggccgctctagaactagtggatcccccgggctgcaggaattcgtctcacccctagaaaaaagagtatagggccaacgatgcagagaagaaggtggaagtactgaatgaaaagcttaatacaatccaaaaggaaagtgatgagaaaaaacgcaaaatcaagaagacagaacgtgctcttaaagtcgctgaggaggaattaatgaggttgcagttagaagtaactgctaaatcaaaacagctgtcagaggttcatggagcatggttaccaccttggctaatggcacaatatgctcgttatgcggaggttgtctcaggtcactggaatcaacatgggaaacctgctgtgcagaatgttttgcataaggcatcagaaaaatcagcacaggcaaagaaatgggctgaacctcatatcgagactgctaagatgaaatggattcctgttaaacagaaattggttttcctcaagaaaaatgcagaaccttatgtacaaaaggtatcaacaagatcaggggagttttacgagtcatcaagggatgctgtgacacctcatgctgacaaagttaaagtgtttgttcattcctactaccagaaaaatacagaagttttctaagccttactttgatcaaattggctggagattcactaaccccccttgttggagaaaatttagaaactactcctgaaagccattacccctaaggagaagccagg

SEQ ID NO: 66432 - protein, 136 aa, Zea mays
  misc_feature: Ceres CLONE 1539375
MRLQLEVTAKSKQLSEVHGAWLPPWLMAQYARYAEVVSGHWNQHGKPAVQNVLHKASEKSAQAKKWAEPHIETAKMKWIPVKQKLVFLKKNAEPYVQKVSTRSGEFYESSRDAVTPHADKVKVFVHSYYQKNTEVF

SEQ ID NO: 66433 - DNA, 755 bp, Zea mays
  misc_feature: Ceres CLONE 1539378
  misc_feature: Encodes the peptide sequence at SEQ ID NO. 66434
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
nnntttttttntnnntttntttttttttttttttttttttttttaaactgtggctcccgaggtggcggccgctctagactagtggatcccccgggctgcaggaattcgtctcacccctagaaaaagctaagagcaatcgagagcgtcacggcgccagcctgcctgtgccaatcatcatctgctgctggagtggtggtttcatctcaacataagcgagccgagcagagtgctgaggcacaaacaagtacaacaccatcccctctctaccttcttatctcttctcctcgtgcaccagcaacaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcatgaccatctcctacgacgagaagaacaacacggtgacggtgtccgggcccttcgacgccgaggaggtcgccgacaggctcaccgccgacgccggcaaggtcatcaccgacatacacgtcgtcgggggcttcggcttccgcttgcgcgggggcggacgcggacggcgagggaaacaacagaagcacggggccgtcgcccccggcaaggggcccaagccagggaaggccagcggcaacagggaccgccagggccgggcacggaagcggaagccatggccgggcccggctgcggccgcggcc

SEQ ID NO: 66434 - protein, 132 aa, Zea mays
  misc_feature: Ceres CLONE 1539378
MSTVVMGVDLECHKCYKKIRKVLCKVQDKVSIMTISYDEKNNTVTVSGPFDAEEVADRLTADAGKVITDIHVVGGFGFRLRGGGRGRRGKQQKHGAVAPGKGPKPGKASGNRDRQGRARKRKPWPGPAAAAA

SEQ ID NO: 66435 - DNA, 739 bp, Zea mays
  misc_feature: Ceres CLONE 1539380
  misc_feature: Translation starting site: 204
  misc_feature (265)..(265): n is a, c, t, g, unknown, or other
  misc_feature (289)..(289): n is a, c, t, g, unknown, or other
  misc_feature (347)..(347): n is a, c, t, g, unknown, or other
  misc_feature (369)..(369): n is a, c, t, g, unknown, or other
  misc_feature (393)..(393): n is a, c, t, g, unknown, or other
  misc_feature (408)..(408): n is a, c, t, g, unknown, or other
  misc_feature (479)..(479): n is a, c, t, g, unknown, or other
cggggcgttttccgactcccccccactctctttcccctccctaccatttcaactcccctattcccctcggagatggccgctcttatactactggatcccccgggctgcaggaattcgtctcacccctagaaaaaacgccacacaccaccaccgcgagctagctcaccaccaacctcagcacatcgaggagaagaggagcggccatggccttctcggcggccaccgcgccgagcacattcctcgcgccccgcctggccgacccggngccgcacaacgcgcgcatcccgcnccggttcgcgtcccgcgcccgacccccccgcgccgctctcccgaccaatgcggcgaanacgtcgatctcctctgaccgcncgctgcggttccccggcgccgcgncgcccgaccaccgcnacgcaccgctggtccgcgactaccgctccgaccctccccccctcgccgaaccctgcccatcacccccccgncgcactggcctcgctggaccttaacctggcccagaacgaggccggcggcctcatcggcacccggttcgagtcctccgacgtccagtccacccccgctccagccctacagcgaggtgttcggcctccagcggttccgcgagtgcgagctcatccacggtcgatgggccatgctcgccaccctcggcgccctcaccgtcgagtggctcaccggcgtcacctgccatgatgctggcaaggtggagctggtggatgggtcctcc

SEQ ID NO: 66436 - DNA, 861 bp, Zea mays
  misc_feature: Ceres CLONE 1539391
  misc_feature: Encodes the peptide sequence at SEQ ID NO. 66437
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ggccgcgccgggccccgacncattcttttttttggnnggggggnnnttacacactggaactccccgcggtggcggccgctctagaactagtggatcccccgggctgcaggaattcgtctcacccctagaaaaagtccaagagcagcgccgtctcgtcgccatgggtctgcaggaggagttcgaggagcacgccgagaaggccaagaccttgcctgccaccacgacgaacgagagcaagctcgtcctctacggcctctacaagtaggccgccgtcggcgacgtcagcaccggtcgtcctggcatcttctgcctttatgagagagccttctgttatgctcgtaaggctgttgaacctaaatccaacgacgaagcaatggccgactacttcccctcggggaatgcatcttgctggaggccgccgccgcatccacctccttaggctactccaaggcaaaacaaaaaccacggaggccgcagttcgcgtatggcctcatcgtggttgttctttatccctcttcttccttaattttctctctccctatgcccgcttcccgcttgcgcgcgggccctctttatggccataatccccccccctccgtcctgcggatgggtcacgggcgtagtacgcccccctgtgccctactctagcctccccttcctccctgcctcccttcgtcgtttcctcactttttcctccccttttcgcgccatgtaaggcgtcgcgcggcgatggctcctaacagttgcgatttccttttttctccatctatatttttacattagacaaaaatctcgttatttgcgctagcaccacccctttaattcacccattcttcccatctcaacccttatcttctcttt

SEQ ID NO: 66437 - protein, 34 aa, Zea mays
  misc_feature: Ceres CLONE 1539391
MGLQEEFEEHAEKAKTLPATTTNESKLVLYGLYK

SEQ ID NO: 66438 - DNA, 705 bp, Zea mays
  misc_feature: Ceres CLONE 1539400
  misc_feature: SWISSPROT Homolog: EC 3.2.1.23 Beta-galactosidase
  misc_feature (705)..(705): n is a, c, t, g, unknown, or other
atagctggagctccccgcggtggcggccgctctagaactagtggatcccccgggctgcaggaattcgtctcacccctagaaaaagtttgggttttttttttgccatgggcgatggcaatgtaaatgtagcacgtgacgcacgtcgcagtgatattctttcatctgttttctgcaacaccggatgtgtacaagtttggagacgtagcgatcgagttcgttccgtttcaaatccgtccggcgtcgcgctacgctttcgaacacgattcatgcgtgtaaaccctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgan

SEQ ID NO: 66439 - DNA, 717 bp, Zea mays
  misc_feature: Ceres CLONE 1539410
  misc_feature: Encodes the peptide sequence at SEQ ID NO. 66440
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
aaagctggagctccccgcggtggcggccgctctagaactagtggatcccccgggctgcaggaattcgtctcacccctagaaaaaaagaacaaggatgtggatacaatagcttcgaacttcatcaagcttaagcacagggcttgggcactccagaagagcacaaccatgtaccaaccttccacttaaaggtgttgctagttcaataagtcaatactatatacttatgcttgtctctatatagtctataggtcctagttcaaataacagatgctgcttgcagccttggatatttgtggagtgaacacattgttgatagcatatggataagaaagtaatgtaattatctggagatgtgtaattatgtggcaatattttctgcccccgggagggggggggaggaaaaaannnnnaacccataccctccaggtacccaattccccctaaagggagtcgaatttcgcgcgcttcctggccgtcgttttaaaaagtctgaccggaaaaaacccctggctttcccaatttaatccctttggaacccacccccccttcccaagctaggggaaaattcaaaaaggcccgcccccgattcgctcttcccaaaaattcgccaatcctaaattgcaatttcatttggtaccttttaaatttttgtacaaatcctctttcgaatcgttttataaataccctccttatttttctccattaggacaataagcg

SEQ ID NO: 66440 - protein, 61 aa, Zea mays
  misc_feature: Ceres CLONE 1539410
KAGAPRGGGRSRTSGSPGLQEFVSPLEKKNKDVDTIASNFIKLKHRAWALQKSTTMYQPST

SEQ ID NO: 66441 - DNA, 897 bp, Zea mays
  misc_feature: Ceres CLONE 1539412
  misc_feature: Encodes the peptide sequence at SEQ ID NO. 66442
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (664)..(664): n is a, c, t, g, unknown, or other
  misc_feature (897)..(897): n is a, c, t, g, unknown, or other
ttgtggggggtttttttttnttttnnnnnnnnnnnnnnnnnnngcaaagtggagctccccgcggtggcggccgctctagaactagtggatcccccgggctgcaggaattcgtctcacccctagaaaaattcacattcggccattctccaccgtccaaccaaccaccggtggcggcacaagggaagcgaagaggaatcaacgcgatgtctgcgaccacggcggcggtgcccttctggcgggcggccgggatgacctacatcggctactccaacatctgcgctgcgctggtacggaactgcctcaaggagcccctccagtccgaggccgcgtccccgcgaaaggtccatttctccatctccaagtggacggatggcaaacagggagaagcccactgttccgcctacaatcccgatgaatattgcctctggtgtcccaaggggcgccgggccccccctccccaatgagtctgaccgtgtgcttggcaattcttcccgcacccacgccattcccccccggcctcgcaacggtcgggcgagagggcggacaacgacgccctccctccgcgtgggtcaccactgggggaactaaccaaacgtggtatagagcacccccccacatatctacacagtcgacctactactcctacaccgcaccagcccacggngtttatatggccccgccgctgctcccccccccgccccgccccccctcttccaagcaaaaaacacagagcacccgtccgcgccggtcatgctcgcccggcacaatacagccgccctaacccctcctccccactcctcctcagcactcccgcccagcactcacgaacatcaaaaaccacaccaccccacaagaaaaaggactaaaattaggtctgtgagctcaactgtgagaccn

SEQ ID NO: 66442 - protein, 86 aa, Zea mays
  misc_feature: Ceres CLONE 1539412
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPLQSEAASPRKVHFSISKWTDGKQGEAHCSAYNPDEYCLWCPKGRRAPPPQ

SEQ ID NO: 66443 - DNA, 826 bp, Zea mays
  misc_feature: Ceres CLONE 1539416
gcagctgagctcaccgcggtggcggccgctctagaactagtggatcccccgggctgcaggaattcgtctcacccctagaaaaaaaaaagcgcgaagagaggagacgagaagggggagggatccacagttcacacacaccccgcttcccatggcgctagcgctgcgctgccctcccgccgccacctcgtcccggagccccttcctaccgtcgacctccccagcccctgcggggaaggtcccgaggaggccgcccgccagctggaggtgcctcgcctactacggtaacgggtgattcctcagtaactacgaccacttcccctaccagttccgctgagaataacctcataagatgtgaggggagtgttcaggacaacggggggctcccacctccaacaaaacaccacaaatctgccccgaaaaagtgacgcaacccacaaaagcgtttaaagtttcagggcgaaaatgcccggggccctcccacgtgatgcatccccccaattccacctgcaagaagggcaaaacctttccgccgccaacgtccccgaagtatttctcaggttggcccccttctttccctcttctgtggatttatccggcgcgggctcccgagcatcactgatggtgctgccaccgccacatacccccccgcgaaccaccgccccgctcgtcaccgcggaatcacccgccggcgttttgaccgtctaaccatccagttgtacaaccatgagatgaaaacactcgtctgcccaatactaccccgttcggggaccaccctcccgtctgggtgcaaaaccacacacatctttagcgcccctccactcccacg

SEQ ID NO: 66444 - DNA, 690 bp, Zea mays
  misc_feature: Ceres CLONE 1539418
  misc_feature: SWISSPROT Homolog: EC 3.2.1.23 Beta-galactosidase
aagctggagctccccgcggtggcggccgctctagaactagtggatcccccgggctgcaggaattcgtctcacccctagaaaaaaatgttccttctatctatatgtaaggtaccacaattaaggggacaggaggatagcaattagacaagttgttttgaataaaataactcatgtgctgagttctctgctaaatgaactgtaacgtgaaatcctttattgtatttctgattgaaattgcttgaacaataatctcctttgctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccg

SEQ ID NO: 66445 - DNA, 689 bp, Zea mays
  misc_feature: Ceres CLONE 1539424
  misc_feature: Encodes the peptide sequence at SEQ ID NO. 66446
  misc_feature (47)..(47): n is a, c, t, g, unknown, or other
  misc_feature (364)..(364): n is a, c, t, g, unknown, or other
  misc_feature (581)..(581): n is a, c, t, g, unknown, or other
  misc_feature (636)..(636): n is a, c, t, g, unknown, or other
  misc_feature (689)..(689): n is a, c, t, g, unknown, or other
tagaactagtggatcccccgggctgcaggaattcgtctcacccctanaaaaaagatgagtatagaaagcttgtcgttccaataattgaggagtattttactacaggagatgtggaattggcagcttctgagctgaagtgtcttggatctgatcagtttcatcattactttgtgaagaagcttatatctctggcaatggatcggcatgacccccaaaaataaaaacacgagacgctcgaggtagccaattcgccctatagtgagtcgtattacgcgcgctcactggccgccgttttacaacgtcgtgactgggaaaaccctggggttacccaacttaatcgccttgcagcacatccccctttcgncagctggcgtaatagcgaagaggtccgcaccgatcgcccttcccaacagttgcccagcccggaatggccaatggaaatccgtcgccgctaatattttgtcagacatcgcgttaaatttctgttacatcccgcccattcctttaaccccccagcaccacgtccgcgaaatcccgcacaaatcaaccgactacacccgcatacgccttgagtgttagtnccggccttggaccaagagcccccgattaaaagaacggggcactccaacgtccaangggccgaaaaaaccgtctacccacggcgatcggccccacctacttcgaaccan

SEQ ID NO: 66446 - protein, 72 aa, Zea mays
  misc_feature: Ceres CLONE 1539424
  misc_feature (15)..(15): Xaa is any aa, unknown, or other
ELVDPPGCRNSSHPXKKDEYRKLVVPIIEEYFTTGDVELAASELKCLGSDQFHHYFVKKLISLAMDRHDPQK

SEQ ID NO: 66447 - DNA, 691 bp, Zea mays
  misc_feature: Ceres CLONE 1539429
  misc_feature: Encodes the peptide sequence at SEQ ID NO. 66448
acccgcggtggcggccgctctagaactagtggatcccccgggctgcaggaattcgtctcacccctagaaaaaaccagcaacccccaacagcgccactgtccagtgcgcgcgtcaagcttgcttagctagccgccatggcctccctcgccgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagaaaaaaaaaaaaaaaaaaaaaaaaaaaaaaaaaaaaaaaaaaaaaaaaatataaaaaaaaaaaaaaaaaaaaaaatatatcgaaataacggaaaaaaaaaaataaatccgggaccctcgaggtcccaatttccccctatagggagcgcatttacgcgcgcccacggggcgtctttttaaaacgttgtgatgggaaaaaccctgggtttccccaactaaatcgccttgaaaacaacccccctttcgccagtg

SEQ ID NO: 66448 - protein, 39 aa, Zea mays
  misc_feature: Ceres CLONE 1539429
MASLAAVTYTEHARRKTVTAMDVVYALKRQGRTLYGFGG

SEQ ID NO: 66449 - DNA, 753 bp, Zea mays
  misc_feature: Ceres CLONE 1539440
  misc_feature (34)..(34): n is a, c, t, g, unknown, or other
  misc_feature (390)..(390): n is a, c, t, g, unknown, or other
  misc_feature (391)..(391): n is a, c, t, g, unknown, or other
  misc_feature (395)..(395): n is a, c, t, g, unknown, or other
  misc_feature (408)..(408): n is a, c, t, g, unknown, or other
catcgcggtggcggccgctctagactagtggatnccccgggctgcaggaattcgtctcacctctgcaggcaagaagttccgtggtctgcgtggcaagggccacactcaccacaagaacaggccgtccaggagggccacctggaagcgcaaccagaccctttccctccgccgctaccgttgagcacacacatcttgatgctctgctactggggaacccgccccatgcatgctctctgatagaatatggaatatttgtttcattgttaaattttgctacatgtgccacctttgagcccctttaactcccctgtttttttcttggataaagtgacccgtcctatactctcattttttttttcccccccccccagggggaaaggagggggtatnnttcnctctccttttctnccacccttgttaataaaaaaataaaaaaaactccgccttcgtggggggcgggggtgtcccccatctctttgagtgaggatacacaaactctttctccggcgcctcaaaggagtggaaatattttccaaaaatttactttctcacactatttcacttcctgttcctactcccttcaccgctcgccccccccccttactagcttgtcgccgcgtgcttgccactgctctccccttttctcgtattttttcttattatatacttactaagttaatctcctctgtcttcaagcccatcctccgccccctcttcgccgccgccaaagccaccctgccgcaaaaccccctg

SEQ ID NO: 66450 - DNA, 585 bp, Zea mays
  misc_feature: Ceres CLONE 1539446
  misc_feature (150)..(150): n is a, c, t, g, unknown, or other
aaagctgggagctccacacgcggtgggcggccgctctagaactagtggatcccccgggctgcaggaattcgtctcacccctagaaaaactctcttactcttctactcctctccccgtggccacaccagcagccgccaggaaagctccttncctcctcctccatggagagagatctagcaaagcatagcctccttcctgctggcgggatctccttttgattcgtaacttataacagaagaagaggaggcacagcaccttgtcaaatgatgaactctcaaaagctgcaactgcccgttcaggatctgatgagtctgaaagggaaatcatttcttcctccgccagggggattatgcaccaaggggactgggagctggtttcgtcggccgtcttcacctgggtcccggcgtgttaaaaaggcctgaaagtttgtttggccattccccattccccaaaaagagggggggggcccccccggggccccctttgcccccggcccggggggtggaaaaaaaaaaaaaagcccctttaacaagagggggggaaaacccaaaattctctctcccccccggggggggaaaaaaaaaa

SEQ ID NO: 66451 - DNA, 635 bp, Zea mays
  misc_feature: Ceres CLONE 1539448
  misc_feature: Encodes the peptide sequence at SEQ ID NO. 66452
ggagctccccgcggtggcggccgctctagaactagtggatcccccgggctgcaggaattcgtctcacccctagaaaaaatggtggctctgaagtcatctgttaaccgatggatttggtcgtcgaaagcgtcgttcatgggcgcttacccgtcaggccatcaaggtttcctcttctgcccggctcgttgccctccactaccgtggcactgagtgctgccttttccggacgtccatgcccacccattgttcgtcggaatgccccagcggtggtgccatttgccaagaagaagaggaatgaatatatcgaagatccgccagatgaggaggtcgcagatgatttcaccgacgagttggaggaggacttcgacgacgccaaagaagacgaaggcgatgtaatggatgatgacgaagagtatgaggacgactatgactttgaagatgattttgagagtgatgatgaacaggatctttatgtaagtttcactctacttgcttgataaatacagtttgattatgtaaacattggattatgttctggaggctggagatggaggtgctggtggcggtatatcccttgctggtgcatggtgggacaaggaagcgttagctttggcagaacaggtctcagcatcatt

SEQ ID NO: 66452 - protein, 129 aa, Zea mays
  misc_feature: Ceres CLONE 1539448
MDLVVESVVHGRLPVRPSRFPLLPGSLPSTTVALSAAFSGRPCPPIVRRNAPAVVPFAKKKRNEYIEDPPDEEVADDFTDELEEDFDDAKEDEGDVMDDDEEYEDDYDFEDDFESDDEQDLYVSFTLLA

SEQ ID NO: 66453 - DNA, 744 bp, Zea mays
  misc_feature: Ceres CLONE 1539450
  misc_feature: Encodes the peptide sequence at SEQ ID NO. 66454
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (744)..(744): n is a, c, t, g, unknown, or other
ttttannnttgttatttattagctaatattcgcccttaannnccccctttttttcaaaactggaactccccgcggtggcggccgctctagaatagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcatgacgatgcgcaagacggcggctaaggcaaagccggcggcgagctccggcagcccgtggtacggccccgaccgcgtgctctacatgggcccgctgtccggcaggcccccgagctacctgacgggagagatcccgggcgactacagatggaaaacctcgaggtatgttggagaacacggaaacgtacaccaaaaaccgggagctggaagacaatccactcccgctggggcctggatgggaaactaaatacttcatgttcccaggagctgtcttgcccaggtaacgaacaatcaagatacaacaaggtccgggagggattaagggcccgatgttcgcaaaacacttaaaaatgggtgatgagcctggtactttcctatcgacaaacaccgaacgcttgatgtcaattagcatagaaaaatatagctatcggtcaagaaagtggataccgggataccagaan

SEQ ID NO: 66454 - protein, 110 aa, Zea mays
  misc_feature: Ceres CLONE 1539450
MASSTMALSSTAFAGKAVNVPSSLFGEARMTMRKTAAKAKPAASSGSPWYGPDRVLYMGPLSGRPPSYLTGEIPGDYRWKTSRYVGEHGNVHQKPGAGRQSTPAGAWMGN

SEQ ID NO: 66455 - DNA, 937 bp, Zea mays
  misc_feature: Ceres CLONE 1539452
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (281)..(281): n is a, c, t, g, unknown, or other
  misc_feature (282)..(282): n is a, c, t, g, unknown, or other
  misc_feature (469)..(469): n is a, c, t, g, unknown, or other
  misc_feature (470)..(470): n is a, c, t, g, unknown, or other
  misc_feature (596)..(596): n is a, c, t, g, unknown, or other
  misc_feature (748)..(748): n is a, c, t, g, unknown, or other
nnnnnnnnnnnnnnggggnnnnnnnnnnnaaaaaannnnnnnannnnnaaacactgggactccccgcggtggcggccgctctagaactagtggatcccccgggctgcaggaattcgtctcacccctagaaaaagccccgccgccgcaacatcccgagtcgctcgtcagatcctccagcaacacagcaccttcgccgccgccgccatgggtaaggttcacggatcgctggcccgcgctgggaaggtgcgcggttagacgccccaaggttgcaaagtaggatnnttttttcccttccaccaagaggggggggggccgagagggcagagaagggggaggagaggcggcgcgcgaaaagggcaggagggaagaaaacgcccggaggcgcaaaaaaaaatggggggagaaggcaaaagagggagcaaaagaagaagaaaataaataaaaaagagagtatgttgtattcaggtgnngaaacgaaaaagaaaaagaggaagaagcgatggcggggggggcccacagggggggtgccgggaaaattggaagcaggagcgcacctagagagcgatgagtgtgggcgctgcacgcaacccctcccnccacagtataagctgcatgctaatacgcctatccccacttctatcacctacgccggcgtgctgtgctcctcttctcagccgttatgcgctgacatcacggtgctgtgcgcgcgcagcgtctgcggggctctctctctctccatccatccgcncccggcgctattgtctcacgccacccggcccacctctcgactcactcaaagcacccgccggcgtacgccacccgatagtgaccacgagggccgctatcacgcgggcccgcctcggccctgcgttcatcctccctccttctcgccccgtcgtctcaaccctcccgaggcacgactgacggtcacgaggcc

SEQ ID NO: 66456 - DNA, 770 bp, Zea mays
  misc_feature: Ceres CLONE 1539454
  misc_feature: Encodes the peptide sequence at SEQ ID NO. 66457
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (447)..(447): n is a, c, t, g, unknown, or other
  misc_feature (770)..(770): n is a, c, t, g, unknown, or other
ttggtcgtttgtattattttgtcgcgttnnnnnnnnnnngggcctcnnnnnnaactctggagctcccgcggtggcggccgctctagactagtggatcccccgggctgcaggaattcgtctcacccctagaaaaagcacatttgcagccccgctctctcgatcgaatcccaaggaacgaagacgacgacgatggcgtcgtctgcctggttgctccaagcttccacggccttcgctccacgcttctccctcccgtcccgaccccagcccccgctacacctgcgtctccgcggcccccccaaccgtcgccgtggcgtctcactcactgcttcctccgccgcgtccccagaagtcgagaaggagtcctcgccctcgccctcgccctccccgaaggaatctcctggcccgtaggtttgttcccccccctgtgagaggggggggggggggcantcctatacgatggaaagcacccggctcccggaaattcctcccaggcgcctgtccacgactcggaagggggcaaccttcgacctctcccgcccttctttttaagaacccccccccggcctcctaattactcctcgtcagggtcccgctaatgctcttacactccactgttccatcgggaccgatttgggctctatcgggcaccgccgcatccccgggggagagccctgccgcgcatcgtggccaatgtctgggccccgcaaccttccgttcggtggatggcccctcccattacggccgaccccccccacccctggcttaatctn

SEQ ID NO: 66457 - protein, 72 aa, Zea mays
  misc_feature: Ceres CLONE 1539454
MASSAWLLQASTAFAPRFSLPSRPQPPLHLRLRGPPNRRRGVSLTASSAASPEVEKESSPSPSPSPKESPGP

SEQ ID NO: 66458 - DNA, 621 bp, Zea mays
  misc_feature: Ceres CLONE 1539456
  misc_feature: Encodes the peptide sequence at SEQ ID NO. 66459
tggagctccccgcggtggcggccgctctagaactagtggatcccccgggctgcaggaattcgtctcacccctagaaaaaacccatcctgctcacttccacgcgggccccagcccgccacgagtccccgctcccacctgctcctcgccgccgttagcgcgccccgagccccgacagcctttctccttctagggtttctctctgtttcgtcctcatcgaatcggagtttcgcatggagtcatcgcggtctcggaagcggacgcgccaggcgcatgactgtgccgccgcgccgccaccagagcgagaagtggtagcgaggggtggcgcgtcgccaccatggagggaggatgaccgtgatggacacttcgtattcgaccttggcgagaacttgacccgccgatataaaatcttgagcaaaatgggagaaggtacatttgggcgtgttttggaatgctgggaccgtgaaacacatgaatatgttgccataaaagttgttcgcagtatccgcaagtaccgtgatgctgcaatgattgagatagatgtgctcaatcgccttgcagaaaatgaaaagtacagatctctttgtgttcaaattcagagatggtttgactatcgtaatcata

SEQ ID NO: 66459 - protein, 130 aa, Zea mays
  misc_feature: Ceres CLONE 1539456
  misc_feature: SWISSPROT Homolog: EC 2.7.12.1 Dual-specificity kinase
MESSRSRKRTRQAHDCAAAPPPEREVVARGGASPPWREDDRDGHFVFDLGENLTRRYKILSKMGEGTFGRVLECWDRETHEYVAIKVVRSIRKYRDAAMIEIDVLNRLAENEKYRSLCVQIQRWFDYRNH

SEQ ID NO: 66460 - DNA, 664 bp, Zea mays
  misc_feature: Ceres CLONE 1539460
  misc_feature: Encodes the peptide sequence at SEQ ID NO. 66461
  misc_feature (664)..(664): n is a, c, t, g, unknown, or other
atagctggagctccccgcggtggcggccgctctagaactagtggatcccccgggctgcaggaattcgtctcacccctagaaaaacctttccctcgatccacagctcgcgccgttcctgcaagtgcgcacccatcgtcccgcctacgcactgccgcccaacgatctacgagctgccatggctaactcggcaccgggaggaatgaggtcgttcctgcaggccgtgtctacggtcaccgaggaggcgccgacgccactccgcgtcgtccagatggagggcctggctgtactgaagatcatcaagcactgtgaggagtttgcgccagctttagttacaggtcaattgcttggtttggatgttggtagtgttctggaagtgaccaactgttttccgttccctatcagggaagaggatgatgaagcagatgcagatggtgccaattatcagcttgagatgatgaggtgtttgagggaagttaatgttgacaacaatactatttggatgggatcagtcttgcttgcttggatcttttcaaactgtggaactgattgaaacatttatgacctaccaggagagcatccgggagatgtgttgtgcattggcctttgacccatcttaaatctagtcaagggggggcctaagctctccaaagccttaaaagcttan

SEQ ID NO: 66461 - protein, 124 aa, Zea mays
  misc_feature: Ceres CLONE 1539460
  misc_feature (25)..(114): Pfam Name: Mov34 Pfam Description: Mov34/MPN/PAD-1 family
MANSAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIWMGSVLLAWIFSNCGTD

SEQ ID NO: 66462 - DNA, 622 bp, Zea mays
  misc_feature: Ceres CLONE 1539462
  misc_feature: Encodes the peptide sequence at SEQ ID NO. 66463
gtggatcccccgggctgcaggaattcgtctcacccctagaaaaaaacgcgttcatcctcccacgcgcttcctccgccctattttagtctgctcgacacgccaccggccactgacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggactccggggatactctcctgcctcggccgcaacgacgagttctgccacggcgacgtccaagtgtgtcttcttggaacggtagcaccatgtgtggcttctatgggaaccaatgtttgaaaaggcttgcctgcttggaacaaagcacatttgtgcaaacagcctggtttggctttaccacgggaggctggtattttccttggggaaactcctcctcttctgggg

SEQ ID NO: 66463 - protein, 102 aa, Zea mays
  misc_feature: Ceres CLONE 1539462
MGAGANNHEESSPLIPAAVAAPADEKPPQAPAPEAANYYADGVPVVMGEPVSAHAFGGVPRESWTPGILSCLGRNDEFCHGDVQVCLLGTVAPCVASMGTNV

SEQ ID NO: 66464 - DNA, 753 bp, Zea mays
  misc_feature: Ceres CLONE 1539464
  misc_feature: Encodes the peptide sequence at SEQ ID NO. 66465
  misc_feature (1)..(1): n is a, c, t, g, unknown, or other
  misc_feature (11)..(11): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ncccccccttnaatttnnnnnnccaccgtggggcgggtataaaanntttnnnnnnnatatctggggctccccgcggtggcggccgctctagaatagtggatcccccgggctgcaggaattcgtctcacccctagaaaaaaccagagtcaccgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctagaccgaggacgctcgccgcaagaccgtcaccgccatggatgttgtgtactgccctccagcgccagggccaccctctgtaccggtccgggggttgaacgcatctgcttccctcgtcctccccagccgaccggggggcgttatcctcggtttccccgggccctgcttggggctgggaggggaagcgggcagtccgagactagaaattacctgctgaaggtgggtgtcgagtaattcgagggcgggaactccacggggacccgcgaccgcggggttctccgtatactcgcacggctccacggggggggcgaccgtcttccttt

SEQ ID NO: 66465 - protein, 72 aa, Zea mays; identical to SEQ ID NO: 17399
  misc_feature: Ceres CLONE 1539464

SEQ ID NO: 66466 - DNA, 794 bp, Zea mays
  misc_feature: Ceres CLONE 1539465
  misc_feature (31)..(31): n is a, c, t, g, unknown, or other
  misc_feature (37)..(37): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
ggttatttgtttatgtttttcgtgttagganaaatanaanagggcnnnggcgatnnnnnttaaaagctggtactccccgcggtggcggccgctctagaactagtggatcccccgggctgcaggaattcgtctcacccctagaaaaaacgcaccgacaacgagctctgcccccacaggtgcagcaggcagatagatcctcaccattttctctttcactcgcatcggatctctcccataatacactctcggggtcccggtcgccaggaatcactggagccgatcgagcgcgtataaaagggcttggtccttggtcctccgaagcctgaaccttgaagcgccacgtagtgcagtgcagcaatggcgcaagctcctcgggcctctcaatcctatcgcaaacgctaagtctatcctctaaaagttcggaagcgagtcctcagaagcgataggcggcgtcaaaataggcttgctgctgggcggaccctcctcctttggtgggaggcaggagacagaatcaagggttgcggtccgggagtccccctccgggcgtgtaagggaatttccgcaagcgggcggaccgcgggcgaaccggataatgccacaacctttccttcaaagccccgaaaaggccgacggccacctccccggcatggccacctgggaacccggaacttctcatatgcccaatcggtctttacttttggggccgcgcgaaacaccccgtatagcccattgatacgaaattcccggaatcaaccaacccggataaaccatacgacatggctgatcccggtatg

SEQ ID NO: 66467 - DNA, 737 bp, Zea mays
  misc_feature: Ceres CLONE 1539469
  misc_feature: Encodes the peptide sequence at SEQ ID NO. 66468
  misc_feature (31)..(31): n is a, c, t, g, unknown, or other
  misc_feature (737)..(737): n is a, c, t, g, unknown, or other
aaaaaaaaaaaaaaaaaaaacccaaaactanacctaacaaccccccttcttctaaaatgggactccccgcggtggcggccgctcttttctagtggatcccccgggctgcaggaattcgtctcacccctagaaaaaaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggataccttcgcgcgcaaccgggagctagaggtgatccactcccggtgggcgatgctgggggcgctgggctgcgtgttcccggagatccctggctaagaacggcgtcaagttcggcgaggcggtgtggttcaaggaccggcgccgcaaatccttctcgggagggcggggctgggaactaccttgggggcaaccccccaaccctgggtggcaccggttctaaaagcaatcccttgggcccatatctgggggccgctgcaccaaggttggggctgacctn

SEQ ID NO: 66468 - protein, 114 aa, Zea mays
  misc_feature: Ceres CLONE 1539469
  misc_feature (59)..(115): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPDTFARNRELEVIHSRWAMLGALGCVFPEIPG

SEQ ID NO: 66469 - DNA, 639 bp, Zea mays
  misc_feature: Ceres CLONE 1539470
  misc_feature: Encodes the peptide sequence at SEQ ID NO. 66470
ccccgcggtggcggccgctctagaactagtggatcccccgggctgcaggaattcgtctcacacctttaaatagacgctccgcctcccatcgttacattagtcgtccgcccgcgctagtgccatccacaatcttctcttctccccggccagaccggtatctggtcagcacgaagctagaaaagcgaagcggctttggaagttgggatccatggcgtccgcctcgtgcttcctccaccagtccaccgcccgcgtggccgcgccgtcgccgcgcctcgccgccccgccgcgcaacgcgcaactggtcgtctgccaggcccataagcagcaagccgccgcgactgagagcgacttgtcgcgccgcgccgcgctcgcactcctcgccggcgtctcggccgtctgcgccaatgcgagccccgccgccgccgcctactgtgaagcagccaacgtgttcggcaagaccaagaagaacacggacttcatctcctacgtctgcgacggctgcaagctactgatcccgtccaagtgtaacccctgcaaggaacgagagttccgcgggcaggtgctccgctacgaggacaacttcgacgcctacgacaacgtgtccgtcatcatcgcgcccccctcctagaaggccatcac

SEQ ID NO: 66470 - protein, 139 aa, Zea mays
  misc_feature: Ceres CLONE 1539470
MASASCFLHQSTARVAAPSPRLAAPPRNAQLVVCQAHKQQAAATESDLSRRAALALLAGVSAVCANASPAAAAYCEAANVFGKTKKNTDFISYVCDGCKLLIPSKCNPCKEREFRGQVLRYEDNFDAYDNVSVIIAPPS

SEQ ID NO: 66471 - DNA, 626 bp, Zea mays
  misc_feature: Ceres CLONE 1539472
  misc_feature: Encodes the peptide sequence at SEQ ID NO. 66472
  misc_feature (626)..(626): n is a, c, t, g, unknown, or other
ggagctccccgcggtggcggccgctcttcactagtggatcccccgggctgcaggaattcgtctcacccctagaaaaacacgatcacacaccactccatagtactatccagagggatagatcaaggtcacacacacacacggaccactagtaggctagcctagccttttagtcgtctaggaggagcaagaacggcgcgcacgctagcggggatgcaagaagagagccgatcgaacgacagcttccacgcgatggcgaggtcttccctgatgatggtggcggcagctctgctggtcttggccctggtcgtgtcgaccgactaggcgaggatcatccagacctcgacgacggacaacaaggacgacgcggtggtgcagccgcataccttcccgcccttcgaccgcctcggcggaggcgcgtccccggcgttcggcggcctccccggcggcatcattcctggcagcagcattcccgagttcagcatgcccggcagcggcagcagactacccgggttcagcttgcccggcagcggcatcatgcccctcttcggcggaagctccccgggattcagcggcttcggaggtatgcccgggtcgcccaccgccggctccgtccccgagcactccan

SEQ ID NO: 66472 - protein, 48 aa, Zea mays
  misc_feature: Ceres CLONE 1539472
MPGSGSRLPGFSLPGSGIMPLFGGSSPGFSGFGGMPGSPTAGSVPEHS

SEQ ID NO: 66473 - DNA, 748 bp, Zea mays
  misc_feature: Ceres CLONE 1539473
  misc_feature (12)..(12): n is a, c, t, g, unknown, or other
  misc_feature (22)..(22): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (89)..(89): n is a, c, t, g, unknown, or other
  misc_feature (592)..(592): n is a, c, t, g, unknown, or other
aaaaaagaagangaaggatagngaaggtgggaacagatggaagagnnaaccacnngaagggaaaatgggaaatctccgcagtggggggngattttccctagtggatcccccgggctgcaggaattcgtctcacccctagaaaaaattcgaatactcctcccccgccacgccccgcctgcccacggactcctcctccccacagctccgccgccgccggctagccgtctccccgcgcgcggacgcggcgaccgggactggggatgtggaggggctcaaggccggggtgtccgtgtacgagccgcggtcctactacgtgctcgtcaccgtacgcggctcgctccctcgcctgcacaatcgacgacggaaagacccggctcgagatcgaattcccgcctctagccagccgcatctctgcttaccaaggctcctcaaatgagttcatcaatgccaacatccagctagctcgtcgatgtggctaataaactcaaaaaactaaagggggactaaagtcttgtaaaagagttctcctgaaaaacctggaataacgtaagggcatcataagtagttccagaaaaccttataggaaacgatntgaatggtgtaaaccatcaagcttcccttaaatgagttcaccccacagaaacccctggccgtccatgttttcccttaaatcatcgaacgcgaaaccaccccttggatattttgtgaacaagccacacgacgaggccgaccgcaagaggtacgtgcg

SEQ ID NO: 66474 - DNA, 604 bp, Zea mays
  misc_feature: Ceres CLONE 1539476
  misc_feature: Encodes the peptide sequence at SEQ ID NO. 66475
aaagctggagctccccgcggtggcggccgctctccaactagtggatcccccgggctgcaggaattcgtctcacccctagaaaaagcggcgccgctattaataaaaaatctgacgacgtcctccttctcctgctccctggctgcaacggacttgaccactgaaagctaagcacacccctcggccatggcgctcgcgtccacctccgccaccgcgcccgctgccgtgctcaagaccccgttcctcggcgccaggcgcgcgctcgccaatgccgccgcgcccaagcccacgtcgcgccgcgcgctcctcgccgtcgccgcggccgccgccaagaagtcgtggatccccgccttcaagagcgacgccgagttcatcaacccgccctggctcgacggatcgctccctggcgacttcggattcgatccgctggggctgggcaaggacccggcgttcctcaagtggtaccgggaggcggagctgatccacgggcggtgggcgatggccgccgtgctgggcatcttcgtgggacaggcctggagcggcatcccgtggttcgaggccggcgccgacccgggcgccatcgcgcccttctccttcggctcgctgc

SEQ ID NO: 66475 - protein, 140 aa, Zea mays
  misc_feature: Ceres CLONE 1539476
  misc_feature (63)..(140): Pfam Name: Chloroa_b-bind Pfam Description: Chlorophyll A-B binding protein
MALASTSATAPAAVLKTPFLGARRALANAAAPKPTSRRALLAVAAAAAKKSWIPAFKSDAEFINPPWLDGSLPGDFGFDPLGLGKDPAFLKWYREAELIHGRWAMAAVLGIFVGQAWSGIPWFEAGADPGAIAPFSFGSL

SEQ ID NO: 66476 - DNA, 638 bp, Zea mays
  misc_feature: Ceres CLONE 1539481
  misc_feature: Translation starting site: 331
ggagctccccgcggtggcggccgctctagaactagtggatcccccgggctgcaggaattcgtctcacccctagaaagagcttcagctcggcgtcttcacaaacgccggcggaaactctcgcccgagcccgacagatcttcaattccccattccgcccaccgatcgaccttcacgcctgtctcggccgcttccgaaggcgtcgcgcgcggttgtttgagaggagaggaggaagatgagggagtgcatctccggccacgtcgggcaaggcgagcatcctagtcggcaacgcgtgctgagaactttactgcctcgagctcggcatccagcctgatggccaagtgcctggagataagaccgcgggacatcgcgatgatgccttcagcaccttcttcagccagactggtgctaggaagcacgttccccgtgcaatcgtcgtcgatctagaacccgctgtgatcgatgacgtgcgcactggcacgtaccgccaggtcttcgaccctgagcagctcatctgtggcaaggaggatgccgctaacaatttcgcccgtggccactacacgattcggctggagattgttgatctgtgacttgaccgtatcggctagcttgctgacaactagaccggcctccatggcttc

SEQ ID NO: 66477 - DNA, 639 bp, Zea mays
  misc_feature: Ceres CLONE 1539482
  misc_feature: Encodes the peptide sequence at SEQ ID NO. 66478
ggagctccccgcggtggcggccgctctagaactagtggatcccccgggctgcaggaattcgtctcacccctagaaaaactggggagcaacgcaagcactccgatccacgctgctgtgcagaacgagagagatatcatcagtagttagagcgaccaatagatgagttcctccccgtcctttggtctcctggccgtagcagcagtactcctagcactgaacttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcataagacgaacttcgccggcatcaacgtcgagttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtgtacgatgaagattacgtccagaagagaattgaactggcggacagcgtggaagagatgggggagaagctctctgccactttgcacgcc

SEQ ID NO: 66478 - protein, 160 aa, Zea mays
  misc_feature: Ceres CLONE 1539482
  misc_feature: SWISSPROT Homolog: EC 1.5.3.11 Polyamine oxidase
MSSSPSFGLLAVAAVLLALNLAQHGSLAATVGPRVIVVGAGMSGISAAKRLSEAGITDLLILEATDHIGGRMHKTNFAGINVELGANWVEGVNGGKMNPIWPIVNSTLKLRNFRSDFDYLAQNVYKEDGGVYDEDYVQKRIELADSVEEMGEKLSATLHA

SEQ ID NO: 66479 - DNA, 622 bp, Zea mays
  misc_feature: Ceres CLONE 1539485
  misc_feature: Encodes the peptide sequence at SEQ ID NO. 66480
ccccgcggtggcggccgctctagaactagtggatcccccgggctgcaggaattcgtctcacccctagaaaaaaacacgtacacttgcacacactctgccaactgaaggtgccggactagtagctccgtgtcaccaaccagagccagagccatgggggccagcctgagcctggtgccggtgctcgactacttcgcccgccgcgagtgcctgcgcgccggcctccaccagaacgccgtcacgctcccgtaccccgacggcggcggcggggcgacctgcaccgtccagtactgggctccgcaaggggagcctgagctcccgccgctcctgctggtccacggcttcgggccccgggccgactggcagtggcgctgccaggtggggccgctctcgcgccacttccacgtcatcatccccgacctcctgggcttcggcggcagcgcgtacccgtccgagacggcgccgccgccgactgaggcgacgcaagccgcggtgctggcggcgctgctgggcgcgctgcccgggatggagcgccggcgcgtggccgtggcgggcaccagctacggcgggttcgtggcgtactggctggcccgcgaggcggggcccgccagggtcggccccgtgg

SEQ ID NO: 66480 - protein, 157 aa, Zea mays
  misc_feature: Ceres CLONE 1539485
MGASLSLVPVLDYFARRECLRAGLHQNAVTLPYPDGGGGATCTVQYWAPQGEPELPPLLLVHGFGPRADWQWRCQVGPLSRHFHVIIPDLLGFGGSAYPSETAPPPTEATQAAVLAALLGALPGMERRRVAVAGTSYGGFVAYWLAREAGPARVGPV

SEQ ID NO: 66481 - DNA, 644 bp, Zea mays
  misc_feature: Ceres CLONE 1539487
  misc_feature: Encodes the peptide sequence at SEQ ID NO. 66482
  misc_feature (644)..(644): n is a, c, t, g, unknown, or other
aagctggagctccccgcggtggcggccgctctagactagtggatcccccgggctgcaggaattcgtctcacccctagaaaaaggaggatagatggctcatggctgccatcgtctaggctcaacatccgaaagacgggccatggtcggtttccttcctcaccccagcggcggacatctatccgaaaataggccgcacctcgtccgctttgctccttgttcatccttcacctgctgatggcggcagcggcgcggccatccaacgccactcttctcgcgcgcctccgggacggcacggccaagttcgagctgctggatgactctgcgtttgcgcttgcgcacgcgcccccggcctggccccgacttcactgctttgccaggattgccccctcgttgaggggtgggtggtcggcagcgttgaacaaggtggagcattacggggttcagagggttaccggcgatggccggtgcatgtttcgagcgctggctaaaggaatggcaaaaaacaaggggattcctttggccccaagggaggaggtagaagatgcagatgatttacggatggcagtgaaagaaattatatgtgacagcgagactgggcggcaggagtactaagaagcagttatagcaattactgtggagcaatn

SEQ ID NO: 66482 - protein, 125 aa, Zea mays
  misc_feature: Ceres CLONE 1539487
MAAAARPSNATLLARLRDGTAKFELLDDSAFALAHAPPAWPRLHCFARIAPSLRGGWSAALNKVEHYGVQRVTGDGRCMFRALAKGMAKNKGIPLAPREEVEDADDLRMAVKEIICDSETGRQEY

SEQ ID NO: 66483 - DNA, 651 bp, Zea mays
  misc_feature: Ceres CLONE 1539488
  misc_feature: Encodes the peptide sequence at SEQ ID NO. 66484
  misc_feature (399)..(399): n is a, c, t, g, unknown, or other
  misc_feature (414)..(414): n is a, c, t, g, unknown, or other
  misc_feature (423)..(423): n is a, c, t, g, unknown, or other
aaagctggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaaggccgtggagtacctgcanttcaagttggactcnctggaccanaacctggccaagaatgaggccggcggcatcatcggcacccggttcaagtcctcccaaatcaagtccaccccgttgcagccctacagcgaggtgttcggcctccagcggttccgcgagggcaaactcctccacgggccgcggggccatgctccccaccctcagaacccctctccgtcgaaagggctcaccggcgtcccctgggctggaacccccggcaaggggaaacct

SEQ ID NO: 66484 - protein, 175 aa, Zea mays
  misc_feature: Ceres CLONE 1539488
  misc_feature (91)..(91): Xaa is any aa, unknown, or other
  misc_feature (99)..(99): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGLGKAVEYLXFKLDSLDXNLAKNEAGGIIGTRFKSSQIKSTPLQPYSEVFGLQRFREGKLLHGPRGHAPHPQNPSPSKGLTGVPWAGTPGKGKP

SEQ ID NO: 66485 - DNA, 624 bp, Zea mays
  misc_feature: Ceres CLONE 1539494
  misc_feature: Encodes the peptide sequence at SEQ ID NO. 66486
tggagctccccgcggtggcggccgctctagaactagtggatcccccgggctgcaggaattcgtctcacccctagaaaaaaccccgcaactgtcaccgccgccagccgctcctccaccggcatggatgtggccctcctgcaagcacccaaggacgagccagtacttgcggaccccatccgccaccgccaagaccatcgcatccctcttcctggactccggggagtcgtccttcgccaactcctcggcgcggacgacgcgccacgtggactgcgcgtccgacagccagtccaccgagtccgaggccccggcggccgacgacttcgcggacgccatcgtccgggggctccgctccgacgaccgcctcctcttcgagccccacgggccctccagctccatcctcgagaggaagcctccggcggcgcctgccctgcggccgcgagcggcggcgtccttcgttgacggcgtcgcggtggcgttcgactccgccgacccgtacctcgacttccgggcttccatgcaagaaatggtggccgcccccgggatggggcgaactggaactgggctcaaagaggatgccgggcctggtaccctcgggcgccaacgggagggggaccccccaccccg

SEQ ID NO: 66486 - protein, 207 aa, Zea mays
  misc_feature: Ceres CLONE 1539494
GAPRGGGRSRTSGSPGLQEFVSPLEKTPQLSPPPAAPPPAWMWPSCKHPRTSQYLRTPSATAKTIASLFLDSGESSFANSSARTTRHVDCASDSQSTESEAPAADDFADAIVRGLRSDDRLLFEPHGPSSSILERKPPAAPALRPRAAASFVDGVAVAFDSADPYLDFRASMQEMVAAPGMGRTGTGLKEDAGPGTLGRQREGDPPP

SEQ ID NO: 66487 - DNA, 825 bp, Zea mays
  misc_feature: Ceres CLONE 1539513
  misc_feature (14)..(14): n is a, c, t, g, unknown, or other
  misc_feature (17)..(17): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
gttgtttgtttacnttntgcagaagctcnaattttcnnnnaaaaagacgtaaatgtctcgggacggcggcttttatttaagagtccccggggtgcaggattcgtctcacccctagaaattgtaaccttatctgaatgtgtaagctttttggggtgccttttcttttattcccacgtcttgtgtgatctattgatcccattggaggcgttataccgtgtgctgtttctgattactagcgatgggaaactttggtcccgtaatggatgattcaataaagggctgggcgacccctgcattttgcacaaggataacaaaacacggtttgtttccgagggaatccagctgtgctcaattgtggtggggtttttttcgtgcgtctcattggggggtggtttggttatggacatttttttttggcgcccctctccccttgtggggggggggggcggtagcctttccttctttcttttctgctgatataggaggggtgcccccccccgatgtggttgtggttttgtgtgtgagccgccgtcccttttagacttgcagcgcctcgatgtgtcgtcagtggggtgcggtggacccctcccgtgttatgaaatgcgaatgaatctcacagaagtgtgaggtgggacgacggctgtgatgttcgtgtgcttattctctctgtttcgctcatccctctctgtatctggctgagcgcattgtaccttgtaagtaaatatctatgattttgttcttctatcactcgacgtatatgctctgcatgcgaccatcacatgtggcgtgacggtgatatctggattttgcttgtctagtgatcgc

SEQ ID NO: 66488 - DNA, 847 bp, Zea mays
  misc_feature: Ceres CLONE 1539515
  misc_feature: Encodes the peptide sequence at SEQ ID NO. 66489
tcgagccgcctcgggcggtcgggggaaaatgtctccccctcgcttggtggggtggcaatttgtagcggccgctctgaaacagtggatgccccgggctgcaggaattcgtctcacccctagaaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtcggcactgctgtccctccttatgacggccctgatgcagtagaagtgtcatactagatttgagccggggaatttgggtcagagttggctattcccccaattcttttgtgagtcatagaatgtcctgccgacattttataatactatggaataaaagttggggatgatcttgactgcaatacccttttttttaaaaaaaaaaaaaaaaaaaaaacggagaccgctccgagggtaaccacaattacgccccgtgatggtggagtgcggatttaacgcggggccgcaagtggggccgggcggtttatacaaactttcgagcactcgggaaaaaacccctgggggttacgcccgacttaaagtcgccttggaaactcaaaaccccctctttcggccagagcgggcgtaaaaaaagagtaagaaagacccggaaccagaattcccctttctccaagaaattgacgcagacgcgg

SEQ ID NO: 66489 - protein, 65 aa, Zea mays
  misc_feature: Ceres CLONE 1539515
MAPRVASALLFVVAVLVASAAAQESMAPASAPAPGPVAGAASAPASAVAVVSSALLSLLMTALMQ

SEQ ID NO: 66490 - DNA, 838 bp, Zea mays
  misc_feature: Ceres CLONE 1539531
  misc_feature (28)..(28): n is a, c, t, g, unknown, or other
  misc_feature (29)..(29): n is a, c, t, g, unknown, or other
ggcgaggtgtgtggtgtttacatactcnnttcgcgacaacaaaaatagggctcccctcggtggcggccgctttttactagtggatcccccgggctgcaggttttcgtctcacccctagaaaaacgcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggatcctgtcgcaccacgaggcgccgtcaacgagtcgggttgtttgggaatgcagcccaaatcgggcggtaaactccgtcccaaggctaaaaacccacaaaaaaacgagacgctcgaggtacccaattcgccctatagtggagtccgaattaactcgcgctccctgggccgtcgtttttacagcgcccttgacttgggaaaaccctgggcgttaccccaactttattgcgccttgagagaaagttccccctttcaccccggctggggctgattagcccaaaaggccccggccctgattcgcccctttcccaacaagatggctcccgccctgaaatgggcaatggggaaatttgcacaacgttaaaattattttggttaaaaattccgcgggatgaagtgttgggaaaagattcagctctaattttttttaaacccagaagggcgcgaaaatctgggaataatacgccttgtataaagacatg

SEQ ID NO: 66491 - DNA, 669 bp, Zea mays
  misc_feature: Ceres CLONE 1539538
  misc_feature: Encodes the peptide sequence at SEQ ID NO. 66492
  misc_feature (669)..(669): n is a, c, t, g, unknown, or other
gcggtggcggccgctctagaactagtggatcccccgggctgcaggaattcgtctcacccctagaaaaagtatcgcatgggagattacctccagttccatctcacttatttaaccaagttccaagtagagtacagcaagagcacaagatatcttgttagggaattttgccctcttttcagattgtcttttgatttgacgcaataattatgatgtcacagatttatactggaaatatgatttgattatgcaaattatagaatgttggcaaccaaaaaaaaaaaaaaaaccagcccctccagggaccccaattccccccaaaggggagccgaattacccccgccccctggcccccccttttttaaaactgcgggacgggaaaaacccttgggttttcccaaataaaacgcctgggaaaaaatccccctttttccccgaggggggaaaaaacaaaaaaaagcccccccccaaatcccccttttccaaaaatttttccccccccctaaaggggggaagggaaaaattttttaccggcgctaaaaaaattttttttaaaaaaaacacccccgcaaaaaattttttgtaaaaaaccccccccctttttttttttacaacaaaagaggggcgcaaaaaatgtcgaaaaaacactctttttattgtaaaataataaan

SEQ ID NO: 66492 - protein, 42 aa, Zea mays
  misc_feature: Ceres CLONE 1539538
MGDYLQFHLTYLTKFQVEYSKSTRYLVREFCPLFRLSFDLTQ

SEQ ID NO: 66493 - DNA, 686 bp, Zea mays
  misc_feature: Ceres CLONE 1539541
  misc_feature: Encodes the peptide sequence at SEQ ID NO. 66494
ggatcccccgggctgcaggaattcgtctcacccctagaaaaaggtacaatacaacctgcgttagtagccaggcccaatcttccagcccaaagttccatcccattgctcgctctgtccctccgttcacaacctcctctacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctcttgaagcactactgtttccgtagtatcattatattattgtaggcggtatgttgtttccttctctaacaggattcaggagaggattgttgggagtgtgaacttgcctttgctcccgagcattcaggactgaccaagggctggttgcatccatcctaccatgtttggagatttttaaccgatttaaccgctaacgtgaaaaaaaaaaaaaaaaactggaccgctcgaggtccccaattccgccct

SEQ ID NO: 66494 - protein, 71 aa, Zea mays; identical to SEQ ID NO: 64355
  misc_feature: Ceres CLONE 1539541
  misc_feature (1)..(60): Pfam Name: RNA_pol_N Pfam Description: RNA polymerases N / 8 kDa subunit
  misc_feature: SWISSPROT Homolog: EC 2.7.7.6 DNA-directed RNA polymerase

SEQ ID NO: 66495 - DNA, 658 bp, Zea mays
  misc_feature: Ceres CLONE 1539543
  misc_feature: Encodes the peptide sequence at SEQ ID NO. 66496
  misc_feature (544)..(544): n is a, c, t, g, unknown, or other
aaagctggagctccccgcggtggcggccgctctagaactagtggatcccccgggctgcaggaattcctctaaccccgagaaaaaaaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaagggcatatcctcctccacctggggcatacccaccacaatatgggtaccctcagccaggtggctacccacctcaaggtggatatcctcctgcaggctaccccggctcatctcaccagggttatgggagcacgcacggcgggggccacgggggccacatggggaccggggcaatgctancgggaggtgctgccgcggccgctgccgcttatggagcacacaagctttctcatggccataccggaaacgggggacatgggggcctttggaaggcaataggtcacgcgggtttcc

SEQ ID NO: 66496 - protein, 154 aa, Zea mays
  misc_feature: Ceres CLONE 1539543
  misc_feature (117)..(117): Xaa is any aa, unknown, or other
MGGGKDKHDESDKGLFSNMMHGVAGGHGYPHQGYPPQGYPPQPGAYPPPPGAYPPPPRAYPPPPGAYPPQYGYPQPGGYPPQGGYPPAGYPGSSHQGYGSTHGGGHGGHMGTGAMLXGGAAAAAAAYGAHKLSHGHTGNGGHGGLWKAIGHAGF

SEQ ID NO: 66497 - DNA, 690 bp, Zea mays
  misc_feature: Ceres CLONE 1539544
  misc_feature: Translation starting site: 99
  misc_feature (1)..(1): n is a, c, t, g, unknown, or other
  misc_feature (136)..(136): n is a, c, t, g, unknown, or other
  misc_feature (305)..(305): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (311)..(311): n is a, c, t, g, unknown, or other
  misc_feature (341)..(341): n is a, c, t, g, unknown, or other
  misc_feature (343)..(343): n is a, c, t, g, unknown, or other
  misc_feature (344)..(344): n is a, c, t, g, unknown, or other
  misc_feature (349)..(349): n is a, c, t, g, unknown, or other
  misc_feature (353)..(353): n is a, c, t, g, unknown, or other
  misc_feature (355)..(355): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (455)..(455): n is a, c, t, g, unknown, or other
  misc_feature (461)..(461): n is a, c, t, g, unknown, or other
  misc_feature (462)..(462): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (496)..(496): n is a, c, t, g, unknown, or other
  misc_feature (664)..(664): n is a, c, t, g, unknown, or other
ncatgctggagctcacaccggtggcggccgctctagaactagtggatcccccgggctgcaggaattcgtctcacccctagaaaacccgtcgagcaaccatggcggcggcggtaaccctcctccgccttcctctcgnccgaatctcctaccacctccgctccgtaccttcctctcgtctgccgtctccgcgcctacgtatctttgcctcccatcgccttttctcctccctggaccatgtctccgcctctgcttccgcctccgcggccgtggcccatgttgtatgctttccccacaaggaggaaacngnnnangagggatcttcgtatctatgcggaggcggngnngcccngggngntttttttttccccccccccccgggggggagaaggggggggnnnnnnnnnnnnnnnntnntttnnntnntnnnttttaaaaaaaaaaaaaataaaaaaatnaaaaanngggggggggggggggtgtttttnnnttttttatntatatattttggtattgaatttcgtagtggtgacctccgaagtccccaaaagcccccgaagcgtgataaatcctgctctgacccccccagcgcggggcctccctaggtgccgcaccgcacctcagtgggacccgcccccacacaccccgtgtgatactatatatattnttcgtagatttttgtgtggcgctatg

SEQ ID NO: 66498 - DNA, 719 bp, Zea mays
  misc_feature: Ceres CLONE 1539545
  misc_feature: SWISSPROT Homolog: EC 3.2.1.23 Beta-galactosidase
gcggtggcggccgctctagaactagtggatcccccgggctgcaggaattcgtctcacccctagaaaaaacgggcagctccgacggcccaaggatcatagcggaatacggccaggaatacggaaaggacgatccagtccgcgttctctacgacggctacggccactacgacgcactccagccatctctcgtaagaacacaatcatcgagactgcgaggtgtgtaggtcaccgggggctgcgctgcctaagcttcttctacaggacagctgcgtaactgcgagcagctcaagatttgacgacgctattttttactccagttcgacacagccgtatagcgaatacgaaactatgcctggctttgactgtatcagccttttctgttcttcaacatttgatgtataaataaacacacacaaaaaaaaaactcgtcacccgagtcagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaa

SEQ ID NO: 66499 - DNA, 649 bp, Zea mays
  misc_feature: Ceres CLONE 1539547
  misc_feature: Encodes the peptide sequence at SEQ ID NO. 66500
  misc_feature (649)..(649): n is a, c, t, g, unknown, or other
tggagctccccgcggtggcggccgctctagaactagtggatcccccgggctgcaggaattcgtctcacccctagaaaaaagcgggcaacgagagggaggaaaatcccattccaactctaggcgcttcccttctcccttttcctttcttcttccccgaggcgctggccccgctcaggtcgggacctgccgccatttcataactcctaactgcttctaagtcagggttgcagcacaccttgcgtaccctgggttgagcatcattggagtggaatataggaatcatgttcaggacaaagcatgcttctcattccaactcatctgatgctgagcagcaagaagcgcagataagtgacttaaaatctgcacttggtcctttgtctgcccatggcgagaactactgcaccgacacatgtttgacaagatatcttgaagcccggaactagaatgtcgcttagtcgagaacaatgcttgaagaaagtctcacatgcacgagcacttataagccagaggatattcgctggactgatgtttctgtctgaccgcatacgggaacaatgtacaatgcacatttgcgagatagagaggggagaactgtattctttatgaggcctactatggattattcaacgtcccatgacagtcagattcn

SEQ ID NO: 66500 - protein, 53 aa, Zea mays
  misc_feature: Ceres CLONE 1539547
MFRTKHASHSNSSDAEQQEAQISDLKSALGPLSAHGENYCTDTCLTRYLEARN

SEQ ID NO: 66501 - DNA, 656 bp, Zea mays
  misc_feature: Ceres CLONE 1539553
  misc_feature: Encodes the peptide sequence at SEQ ID NO. 66502
aagctggagctccccgcggtggcggccgctctagaactagtggatcccccgggctgcaggaattcgtctcacccctagaaaaataactttgcctttgccgcgagcgaccgtagccaggtgattgcaatggtggcctccactgcttcccgcctctcgcccccgcgcttcagcaccccttccccgtctcttcatcctccaaaccgccgctcgagcttctcccctgttcgcgcagccaagttggaagctgtgctgtctattggtagctcatctaatcccacacccaagaaaggctgcaagtggcggataagatgctttctttgccaatagcgatgctggcggagtatttgccattgcatatggtgccccgcctcatgcgcttatctactgacagatgggcaaataaaaatgtcaatcccacctctattctctcgagagctcatgagaaacagctctaatttcctcaatgatcaggcggccagccatgatccctcataatcttctcatgaaaactcatggctgcaacttctttctatggaatctggcacagtaatcatccccctgccttgaaaaaaccgggaactctaaaaattgcaaatggggggaaaattgtggggtttgaaaattattccccaaaaagggcaaataaagggtcccct

SEQ ID NO: 66502 - protein, 66 aa, Zea mays
  misc_feature: Ceres CLONE 1539553
MVASTASRLSPPRFSTPSPSLHPPNRRSSFSPVRAAKLEAVLSIGSSSNPTPKKGCKWRIRCFLCQ

SEQ ID NO: 66503 - DNA, 663 bp, Zea mays
  misc_feature: Ceres CLONE 1539557
  misc_feature (420)..(420): n is a, c, t, g, unknown, or other
aagctggagctccccgcggtggcggccgctctagaactagtggatcccccgggctgcaggaattcgtctcacccctagaaaaactttagatcgattcgattctacggttgttgcgacgcccacgatgttttttttgtgcgatcgtatgccctccatggacaccgagacaccaagatgacgggtgacaccaggagaggaggtcgccacctgtatctagcctgacaagctcgatgagcaaacgagctacggagaggaactcgagccgcatgatgagagaagaggaacatcatcacgatgactcatgatgacagggatgatgatgaactccatggggatgccagaggcaagtcatcgtccagatggactgtcacgatgaggggcagggcggtgctgaagcttgcgatgtcccccatcactggngccagccgcgtcactgtatcgaatacaagatcatcgtctttgtgttctcccaccgtgatgtgttctgaaagccgatctccgactcgtatggtcttattcgattacgcgtaagatcgaggacctgagctcccctctggagacccaggacgtatatcagtttcgagctccctgacttgccccctgatgatctcgaatcccagaggaaggctgggcccggggccacgaaggaaagatgctgaaggg

SEQ ID NO: 66504 - DNA, 644 bp, Zea mays
  misc_feature: Ceres CLONE 1539558
  misc_feature: Encodes the peptide sequence at SEQ ID NO. 66505
  misc_feature (644)..(644): n is a, c, t, g, unknown, or other
ctccccgcggtggcggccgctctagaactagtggatcccccgggctgcaggaattcgtctcacccctagaaaaagttgcttcgctaggacatcgtgggtgtgtgtgtgtccttcgcacccatgcggcgttagctgatgacgagctcgcctgagaggggagaagcaccacctgcgccgccacgcgattcaccgtgcgaggacgccgccccagctgccgccgtcgttgcctcttcctcctctggctccgagcgccaggaagacggcggctccaggcagtccaaggcctctgtcctgtccggcatcttcgcgccccctctcgccatattcgaggggcagcagcaggtctcctcgctgccgtgcgacgccagctcgacaaagccgccctcggggtcctatgcttggtccaggattctgaggaggttcgtgggcagcggctccatgtggcgtcttctgggctgcgccagggtcgtgacctccggtgacgtgtggttccttggtaaatgctacagggtgtcgcccgaggaagaggagtctggcggctcggattctgacagcggccatgctgcgtttctggaagatttctcttccaggatatggatcacttaccggaaagggtttgatgcaatacctggttccaagctcan

SEQ ID NO: 66505 - protein, 169 aa, Zea mays
  misc_feature: Ceres CLONE 1539558
MTSSPERGEAPPAPPRDSPCEDAAPAAAVVASSSSGSERQEDGGSRQSKASVLSGIFAPPLAIFEGQQQVSSLPCDASSTKPPSGSYAWSRILRRFVGSGSMWRLLGCARVVTSGDVWFLGKCYRVSPEEEESGGSDSDSGHAAFLEDFSSRIWITYRKGFDAIPGSKL

SEQ ID NO: 66506 - DNA, 886 bp, Zea mays
  misc_feature: Ceres CLONE 1539561
tcgctctttttttttcttttgcaagctgacctaaggccaaacaaaacacgacatacctcgctgtgtgttggggtctcgtttttattttatttcccggctccacgaattcttctcaccccttgaaaaatattcccttgtctagtttattctcgttaccatgtattaatgtaacaatctgtagctgaaggaaggtgacttccagtccagtcatgttttggttttggtggtgttgagcagaggtaattttttttttttttgggtcaaggttggatggatgcttttgggctaaatggatttgattttatccttgctgaataaagaacacgtaattgtagccgaataagaacgtgatatataaatatttctctttccaaaaaaaaaaaaataaaccgagacgctcgaggtaaccaattcgcccctataaaggagtcgaattacacacgctcacttggtctgtcttttttacacactttatggcgcatgggaaaaacccagggcgttatcccaactttatatactttttggcaaatataaattctcctattttgccagcttgggcgttaattagcaaaaaaaggtcccgcacatcaatgcgcctctttccccaaaatgactgacctattcctttaaatgtgcagaaatgggaaatttgacaaacccgttacaaaaattctttgtgaaaaatttcctcggcaaaaaatcttttagtgttaaattccgcctcccttctttcttttaatccaagtaggggtcctaaaattggcctaaaaaaacacccttagataaccctaagaataaatattcccctaaactataatgtcttatgatgtttttttacaaaccttgtataacctaaatttcccttctttaacgagtaaatagaggg

SEQ ID NO: 66507 - DNA, 762 bp, Zea mays
  misc_feature: Ceres CLONE 1539564
  misc_feature: Encodes the peptide sequence at SEQ ID NO. 66508
  misc_feature (367)..(367): n is a, c, t, g, unknown, or other
cttaactagtggatcccccgggctgcaggaattcctctcacccctagaaaaatacattttgcctgattctggactggccaaagtcaggaggtgcttgcactgcagccatttgaacacagaaaatgttcgtttttatagctctattcttttctttgttgggtctattgggtatattaattgaaatgatcacttaacttcccaaaaaaaaaaaaaaaaacgagacgctcgaggtacccaattcgccctatagtgagttttattacgcgcgcgacagtgggccgtctttttacaacatcttgactgggaaaaccctggcgttacccaacttatttttttttccccccaatcgggggggggggggggggtnttaatactcaaaaccctccccccccattgtccttaagaaaataatgctcctggctgcaagggcctaacgccaatcctcaatgctatatgaattctgttaaaattaccgctgtaaatttcttgataagagcccggccccagttcatttaatcccactgcctgcaaaaacttggtcaagtgcccattcttaattttcaatacaatagggctcgatttcgcggcgccttattgcatagtatcacataagtaaaaaaaacagggccttcataaagtaacaagtgcgacttccgtattgcaatattagtagttaaaatctttatatgtcggggataatgtatcagcagcgtggggaatagccttctagaataaacgattctggtacgactcaactagcgc

SEQ ID NO: 66508 - protein, 59 aa, Zea mays
  misc_feature: Ceres CLONE 1539564
LTSGSPGLQEFLSPLEKYILPDSGLAKVRRCLHCSHLNTENVRFYSSILFFVGSIGYIN

SEQ ID NO: 66509 - DNA, 665 bp, Zea mays
  misc_feature: Ceres CLONE 1539565
  misc_feature: Encodes the peptide sequence at SEQ ID NO. 66510
  misc_feature (296)..(296): n is a, c, t, g, unknown, or other
  misc_feature (300)..(300): n is a, c, t, g, unknown, or other
  misc_feature (388)..(388): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (662)..(662): n is a, c, t, g, unknown, or other
gtccccgcggtggcggccgctctagaactagtggatacccagggctgcaggaattcccctcacccctagaaaaagtcctttttccggcacatccgattcgtctctttgctcgcatcaggcctcaagcccctcaggcctcagctcaccaccacgaaccaaccgacagaaagagggacgaatggcgagctctccgtgctgcgataacccgccggccctgaacccggcctgcggggagggcaaggtcgtcgacagcttcggcgggctcatagcctacttctcccgccccgaggactccnaagnccccgtcgtcttcttctccaaaatcttccgaattcaaagcgcccttttttttttttcccccccccccaagggttagtaaaggggggtnctttnntnnnnnnnccttttttttttcaaaaaaaaaaaaaaaaaaacccccaacaggggtggggggggcccgtcctccttctctttaaaaccccccacccccggaaaaaaggtttccaccaaacacacacaattttataagacccccccacaacaaaaagcacagtccgccctcacccctaccccccatatattcccaaccgccgacaacctccttcctacaacacccctcgtaactctcaaaatgccccttcttctcgataaatagcacccgncca

SEQ ID NO: 66510 - protein, 65 aa, Zea mays
  misc_feature: Ceres CLONE 1539565
  misc_feature (40)..(40): Xaa is any aa, unknown, or other
  misc_feature (41)..(41): Xaa is any aa, unknown, or other
MASSPCCDNPPALNPACGEGKVVDSFGGLIAYFSRPEDSXXPVVFFSKIFRIQSALFFFSPPPKG

SEQ ID NO: 66511 - DNA, 609 bp, Zea mays
  misc_feature: Ceres CLONE 1539566
  misc_feature: Translation starting site: 259
  misc_feature (609)..(609): n is a, c, t, g, unknown, or other
ggagctcaccgcggtggcggccgctctagaactagtggatcccccgggctgcaggaattcgtctcaccctgaaaacaaaagccacaacattgtcagatcaggtagttttgctgcacatagacaccactggaataacaaccaataatagtgagctgaacattcacctggacaccatggaacagcaagtccacttacaagatgctctctgaatgaccaccctgaaaacagaggtactccggctgcaagtagtaacacgacatgcggcctgatggtgatggagggatgatgctgaacttagcggccatgccacgcctggtcggacgcaaccagcaaatgttccacattagccaagcgatgcaatccgtgctggcgacgcaacaactgcaccatctacatctctactcccatcctcatcatcagcaaatacactcgctgtcgctccctccagtggcgagagacctccagatgaaagggcatctggacggccaacgccaacgtgaccatggaaaatctgggagcgacaccatgagcagcggcacatgaccctactagcaccgtggcacggaactattggagtatgtcctgagcaggaacgctgatcccatatan

SEQ ID NO: 66512 - DNA, 675 bp, Zea mays
  misc_feature: Ceres CLONE 1539573
  misc_feature: Translation starting site: 433
  misc_feature: SWISSPROT Homolog: EC 2.4.1.207 Xyloglucan:xyloglucosyl transferase
acagctggagctccccgcggtggcggccgctctagaactagtggatcccccgggctgcaggaattcgtctcacccctagaaaaaagctcgaccaccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcggtgcggctccgggttccagtcccggcaccactacctgttcggcaagatcgacatgcacctgcggctggtgccgggcaactccgccggcaccgtcaccgcctactacctgtcgtcgcagggcggcgcccccgacgagatcgaattcgagttcctgggcaacgggtccggcgaggccttacccgctgcacaaccatcgtggtttcacgcctggggcagggggctgccgggaaatcatcatttttcccccctctggtatcaaaccccaccggccgtattttcacccccttacccccat

SEQ ID NO: 66513 - DNA, 652 bp, Zea mays
  misc_feature: Ceres CLONE 1539576
  misc_feature: Encodes the peptide sequence at SEQ ID NO. 66514
tagctggagctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacaaggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcagggccatgtccagaggcttaagacatacaaggccaagctggttatctttccaaggcgtgctcgcaagggcaaggcgggtgactccactctgggagaacttacccctgctacccaggttacagggtggactactgcccatttactccccggggagg

SEQ ID NO: 66514 - protein, 161 aa, Zea mays
  misc_feature: Ceres CLONE 1539576
  misc_feature (6)..(161): Pfam Name: Ribosomal_L13e Pfam Description: Ribosomal protein L13e
MVKHNNVIPNGHFKKHWQNYVKTRFNQPARKQRRRIARQKKAVKIFPRPTAGPLRPIVQCQTLKYNMKSRAGRGFTLEELKAAGIPKRLAPTIGISVDHRRKNKSLEGLQGHVQRLKTYKAKLVIFPRRARKGKAGDSTLGELTPATQVTGWTTAHLLPGE

SEQ ID NO: 66515 - DNA, 624 bp, Zea mays
  misc_feature: Ceres CLONE 1539582
  misc_feature: Translation starting site: 173
cagctggagctccccgcggtggcggccgctctacactagtggatcccccgggctgcaggaattcgtctcacccctagaaaaaatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctcccccccgcgctgcgggggggggccgtctacatgatcaacttcgtcatgtccatgtccacgcagatcttctgcggccagctcggcaacctcgagctcgccgcctcctcgctcggaaacccggcatccagcccttggcctacggcctcatgctgggcatgggcagcgcggtggagacgctgtgcgggcaggcgtacggcgcgcacaagcaccgcatgctgggggggtacctgcagcgctcggaggggctgctcatggccaccgccgtg

SEQ ID NO: 66516 - DNA, 621 bp, Zea mays
  misc_feature: Ceres CLONE 1539584
  misc_feature: Encodes the peptide sequence at SEQ ID NO. 66517
agtggatcccccgggctgcaggaattcgtctcacccctagaaaaaatccccagcccacgaccctccgccaccagccatcgtctgcatcagatctcccgcccgtccgttacatcccagggcgacgcggccgcggccatgacgccatcctcagctctcgccctcgcgcaccacgccgcggtatccccgctcccgtcctccacgccgcggccctcccccaggtccagctctctgagcctgggcccgggctccgccgggctcgggccgcgccggctcgtcacggcggcgcccccacgggcgttcttctcctcatccccctaccttcccccccacccggaggggggggggggagcacctctagtacggtctggtccccatggtcattacaaacaacctctcccgggggagcagcgcctacgacatctttttcgcgccttgctccaaggaaccccaacgactgcattcacggggtccaattgccgaacgacaacagtcctcccattggctgccacgcagcttgctcttcctccaaactccgataaccccgcgtaagacgcggcgcccaaaaataataaatttcaccgggggggcttcttcccaccagggtactttcacttttcgtag

SEQ ID NO: 66517 - protein, 137 aa, Zea mays
  misc_feature: Ceres CLONE 1539584
MTPSSALALAHHAAVSPLPSSTPRPSPRSSSLSLGPGSAGLGPRRLVTAAPPRAFFSSSPYLPPHPEGGGGAPLVRSGPHGHYKQPLPGEQRLRHLFRALLQGTPTTAFTGSNCRTTTVLPLAATQLALPPNSDNPA

SEQ ID NO: 66518 - DNA, 650 bp, Zea mays
  misc_feature: Ceres CLONE 1539588
  misc_feature: Encodes the peptide sequence at SEQ ID NO. 66519
aagctggagctccccgcggtggcggccgctctagaactagtggatcccccgggctgcaggaattcgtctacacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctct

SEQ ID NO: 66519 - protein, 147 aa, Zea mays
  misc_feature: Ceres CLONE 1539588
  misc_feature (49)..(147): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGS

SEQ ID NO: 66520 - DNA, 650 bp, Zea mays
  misc_feature: Ceres CLONE 1539589
  misc_feature: Encodes the peptide sequence at SEQ ID NO. 66521
  misc_feature (650)..(650): n is a, c, t, g, unknown, or other
aaagctggagctccccgcggtggcggccgctctagaactagtggatcccccgggctgcaggaattcctctcacccctagaaaaagtccatccgtagcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcgccagcaccagggccccgcgccgcagggggctcaggctgaggaccgtcacgtgcttcgtgccgcaggacacggcggccccggccgctcccgtgccggcgctggacgaggaggccagggccgcggcggcgcggcgcgtcgcggagaaggaggcgcggaagcggtccgagcggcggacgtacctggtggccgccgtgatgtctagcctcggagtcacgtccatggccgtcgccgccgtgtactatcgcttcagctggcaaatggagggcggcgaggtgccggtgatcgagacgctgggcacgttcgcgctctccgtccgggcggcggccgggatggagttctgggcgcggtgggcgcn

SEQ ID NO: 66521 - protein, 154 aa, Zea mays
  misc_feature: Ceres CLONE 1539589
MAAAMTSFVAKNPLLAAAARRRAPPLAGRALPFSPLASTRAPRRRGLRLRTVTCFVPQDTAAPAAPVPALDEEARAAAARRVAEKEARKRSERRTYLVAAVMSSLGVTSMAVAAVYYRFSWQMEGGEVPVIETLGTFALSVRAAAGMEFWARWA

SEQ ID NO: 66522 - DNA, 631 bp, Zea mays
  misc_feature: Ceres CLONE 1539594
  misc_feature: Encodes the peptide sequence at SEQ ID NO. 66523
aagctggagctccccgcggtggcggccgctctagaactagtggatcccccgggctgcaggaattcgtctcacccctagaaaaaacggaagtttcggcggcgccggcgtgctcgtgatctcaacccaaggcgtgcctccgctccggtcacccgtcgctccacgcaaccatgttgtatgtgtttgcagtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcgcagcgctgcaaggagcttggcattactgcactgcacattaagcttcgcgccaccggaggcaacaagaccaagacccctggacctggtgcccagtctgccctcagggcgcttgctcgttccgggatgaaaatcggacgcattgaggacgttaccccggtccccactgacagcactcgcagaaagggcggtaggaggggaaggaggc

SEQ ID NO: 66523 - protein, 152 aa, Zea mays
  misc_feature: Ceres CLONE 1539594
  misc_feature (31)..(149): Pfam Name: Ribosomal_S11 Pfam Description: Ribosomal protein S11
MCLQSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRR

SEQ ID NO: 66524 - DNA, 713 bp, Zea mays
  misc_feature: Ceres CLONE 1539597
  misc_feature: Encodes the peptide sequence at SEQ ID NO. 66525
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
ccagctggagctccccgcggtggcggccgctctagaactagtggatcccccgggctgcaggaattcgtctcacccctagaaaaagttgtggtacagttgtactgagctgagctgccggaggcagaataggagaggcaggcgatgaccatggctaccaacgccgcttgcgtgctggcggtgtgggtgctcgtcgcctcgggcctgtgcgacctgggctcagcgcgcgcgcccctgggcagcaagccgcaacgggagttcgactacttcgcgctctccctccagtggcccggcaccatctgcgcctccacccgccactgctgcgccaccaacggctgctgccgctcggagccgctccatatttttcccccccccgggggggggggcggggggctacaacnnnaccctctcccccccccccccccccgatctcaattttaagatggccacgattttgggcgtggaaggagccccctcccccacttccctggccgccccccctactgcccccgaatcttgcgatccgtctctcctctccctaccccccctcttcccggccactccccaacctccgccgccatatgtgtctcccgcctctttccccccgttggctccccgccgaccctctctccctccctcccccctccgcccttttccccctgggtcctttcgtgttgggagcgtgttccccaccttcccttccccctcccttcctc

SEQ ID NO: 66525 - protein, 98 aa, Zea mays
  misc_feature: Ceres CLONE 1539597
  misc_feature: SWISSPROT Homolog: EC 3.1.27.1 Ribonuclease T(2)
  misc_feature (86)..(86): Xaa is any aa, unknown, or other
  misc_feature (87)..(87): Xaa is any aa, unknown, or other
MTMATNAACVLAVWVLVASGLCDLGSARAPLGSKPQREFDYFALSLQWPGTICASTRHCCATNGCCRSEPLHIFPPPGGGGGGLQXXPLPPPPPRSQF

SEQ ID NO: 66526 - DNA, 693 bp, Zea mays
  misc_feature: Ceres CLONE 1539600
  misc_feature: Encodes the peptide sequence at SEQ ID NO. 66527
  misc_feature (559)..(559): n is a, c, t, g, unknown, or other
tctccactagtggatcccccgggctgcaggaatctcgtctcacccctagaaaaactccccctcttatccctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgctcgccgcctgccgctcgccccgctcgccgcctccgactccgccttcgagtcctccgtcggagttaactactctttaccccgaccactcgggagaggagagaggaggtgtaatttgtttctgattggttgacccaccaacaaccccccctaaatttggcgagatgaaccatttcccgagaaggtccttagccccctcgcccgtggtataagggtgtaaggaagtaagtccgggaaattaatgttgaatcacgcccataagagagccaaaaggacagtgttcggcaaaaccctgtaccttattaacnttcaataaaaagaaccgaattaaaaataaggtatataacgcgccaccgcgccgcgtctcgccacttacgtccctctaaaaaataatctatacaaaaaacaacaaaaatgatatccccaaagctgccctaagttt

SEQ ID NO: 66527 - protein, 88 aa, Zea mays
  misc_feature: Ceres CLONE 1539600
MASSVAVSLRALAAAPLPKSSPATSCPFFVLLAPALPRRLLRLRSARRLPLAPLAASDSAFESSVGVNYSLPRPLGRGERRCNLFLIG

SEQ ID NO: 66528 - DNA, 665 bp, Zea mays
  misc_feature: Ceres CLONE 1539601
  misc_feature: Encodes the peptide sequence at SEQ ID NO. 66529
  misc_feature (273)..(273): n is a, c, t, g, unknown, or other
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (422)..(422): n is a, c, t, g, unknown, or other
aatactggagctccccgcggtggcggccgctctagactagtggatccccagggctgcaggaattcccctaaccccgggaaaaaggcgtcgcgtttcaacaggccaatcccctccccctcccaggcccatctcgacgacatggccgcagccgcagggccatcaagctctgtgaaggagacgctcccgccggccctcggatccacctcccagccacctcccgtcttcgatggcaccaccaggctgtacatctgctacttctgcccgttcgctcancgcgcctgggtcaccaggaacttgaagggtttgccggacaatatggttttggtggccatcaatctgcaggacaaaccggtttttttttcccccccccttggggaggaggggggggggtcttccctgnannnnnaccnccnngtcatganaaaaaatatgaaagcggaccgggggctggggggggggccttcaatgccccccctccgatcccaaatgatagtgatctataagcactcggcgtgaggaaaaagcccccgcccggcgatcgcttctccaaaagacggcccaactctcggtgggctgcctcaagtatcccatgcccaacctaatctggacgcccatacgatgttaaacccaaggtccaacttgctgtttcgtattattgaccccct

SEQ ID NO: 66529 - protein, 125 aa, Zea mays
  misc_feature: Ceres CLONE 1539601
  misc_feature: SWISSPROT Homolog: EC 2.5.1.18 Glutathione transferase
  misc_feature (45)..(45): Xaa is any aa, unknown, or other
  misc_feature (88)..(88): Xaa is any aa, unknown, or other
  misc_feature (89)..(89): Xaa is any aa, unknown, or other
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (95)..(95): Xaa is any aa, unknown, or other
MAAAAGPSSSVKETLPPALGSTSQPPPVFDGTTRLYICYFCPFAXRAWVTRNLKGLPDNMVLVAINLQDKPVFFSPPLGEEGGGSSLXXXXXVMXKNMKADRGLGGGPSMPPLRSQMIVIYKHSA

SEQ ID NO: 66530 - DNA, 637 bp, Zea mays
  misc_feature: Ceres CLONE 1539609
  misc_feature: Encodes the peptide sequence at SEQ ID NO. 66531
ggagctccccgcggtggcggccgctctagaactagtggatcccccgggctgcaggaattcgtctcacccctagaaaaactccctgtagagaacaggccgaggcgggcaagtgctccagtacacctcgagctacataccccagctcgcacggtccagctttgagctccctcctctccacctccacgcccgatcgtgaatcgtcacttgctctgcaacggcgagagcgccatctttgctgctacccattaactcaggcgggcattccgtcgagcaccttccgttcggcgccgggtggcgtggggagcgagtcctgccgggttgcatggtccgttgcgtgaaggggcgacagttgctgctttcccggggacgctccttgatgccgctgttgtggcaggcgctgggttctagcggatggaatgcaacagttcctacgcgctgaagtcaagaaggttcgttgccgtagctgatgcgggatttgaggatgcggtagacggcgccagcgattttggagacacgatgagtctcgcacacaagcagaaggttgtcggggaaaccgtggagacggaggaggagcaggagtttgtttggaaatctagcctggtctcctacaaggatgatggtgattccgttcttcctg

SEQ ID NO: 66531 - protein, 75 aa, Zea mays
  misc_feature: Ceres CLONE 1539609
MECNSSYALKSRRFVAVADAGFEDAVDGASDFGDTMSLAHKQKVVGETVETEEEQEFVWKSSLVSYKDDGDSVLP

SEQ ID NO: 66532 - DNA, 658 bp, Zea mays
  misc_feature: Ceres CLONE 1539612
  misc_feature: Encodes the peptide sequence at SEQ ID NO. 66533
aaagctggagctccccgcggtggcggccgctctagaactagtggatcccccgggctgcaggaattcgtctcacccctagaaaaaatccatctcattctcaccgatatatatacatccctctccgtctccctaccgctcccgtcccgtccgctgctggctctgcatatcccgcgcccgactcccgttgctgcgtgcggcggcccgactagtcgcgccgcgctcgggctcggcttgattgaaccggccgggatgggggtgttggaggacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaagcagaagatttactgccaacaagtgtaaaactggccaatgaagctcgagatgaattttggaagtcaacactgaggaagtccaaacctatttacaaccgggctcctgtttgctgcttcccttgggtagctacgaaacctttcctgcctgatggat

SEQ ID NO: 66533 - protein, 136 aa, Zea mays
  misc_feature: Ceres CLONE 1539612
  misc_feature: SWISSPROT Homolog: EC 2.1.1.10 Homocysteine S-methyltransferase
MGVLEDLVARAGGCAVIDGGFATQLEALGADINDPLWSAACLITRPHLVKEVHMQYLEAGADVIISSSYQATIPGFIARGMSVAEAEDLLPTSVKLANEARDEFWKSTLRKSKPIYNRAPVCCFPWVATKPFLPDG

SEQ ID NO: 66534 - DNA, 654 bp, Zea mays
  misc_feature: Ceres CLONE 1539620
  misc_feature: Encodes the peptide sequence at SEQ ID NO. 66535
  misc_feature (654)..(654): n is a, c, t, g, unknown, or other
ggagctcaccgcggtggcggccgctctagaactagtggatcccccgggctgcaggaattcgtctcacccctagaaaaactctctctcagctagtcctccaaacccccacgtactatactacgtacgttattaaccccacctccccagcagctagcatctcctcgtcgctagcaaagcaacacccgaaggcctgcgggcgcgcggcgtgcggccacgccaccgcgccatgggcaacgctctggcgggcaggcggcgcgcggccaaggtgatgacggtggacggcgccacgttccgctacaagacccccgcggcggcgtgcgcggcgctgcgcggccacccgggccaccagctcctggagtcggaggaggtgcggcggctgggcgtgcgcgcgcgcccgctggaccgcgacgcgccgctcaagcccgggaagctctacttcctggtgcagatcccccgcggcggcgccggggacggcgacgacccgcgcgcgccgcgcaagacgtggtcgggcgcgctgcgcgtgggcgcccgcgagcgcctggagggcctgatgctgtcccggcgcaccgtctcggacgtgtcgtccatcctgccgccgcccgccgccgcgcgcctcgccgccgcgtcgccgtcgccgtcgccgccgtcgtccgn

SEQ ID NO: 66535 - protein, 142 aa, Zea mays
  misc_feature: Ceres CLONE 1539620
MGNALAGRRRAAKVMTVDGATFRYKTPAAACAALRGHPGHQLLESEEVRRLGVRARPLDRDAPLKPGKLYFLVQIPRGGAGDGDDPRAPRKTWSGALRVGARERLEGLMLSRRTVSDVSSILPPPAAARLAAASPSPSPPSS

SEQ ID NO: 66536 - DNA, 673 bp, Zea mays
  misc_feature: Ceres CLONE 1539629
  misc_feature: Encodes the peptide sequence at SEQ ID NO. 66537
tggcggccgctcttcaactagtggatcccccgggctgcaggaattcgtctcacccctagaaaaagctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcatggcgaggaacctgaggacccacgcacagttcatcccggcctatgctttcaaggcacgcacgggtgattacaccaacgaggaaaatggattaccccccgctccaaaagaaaacccgcacaaggctcaggccgccctgttttctgatccaaacatgcccatggacatgatggatgaataacctatccatgattagttcctcagacacttacattttgcatgggtgaacctttttctttttccggtttccatcgccgcaaaaaacccccttttccattggtctcttaaatttcctggcaaatgcctgcccaaatgggcatttggaccctgtgcacttgtttgtatggcctcttatgttttgtcatctcgggtcttgggt

SEQ ID NO: 66537 - protein, 117 aa, Zea mays
  misc_feature: Ceres CLONE 1539629
  misc_feature (2)..(118): Pfam Name: DUF850 Pfam Description: Eukaryotic protein of unknown function (DUF850)
MAEDLVLDTAIRDWVLIPLSVVMVLIGVLRYFVSKLMRSPATSPSPDPKLVKEGQVVIMARNLRTHAQFIPAYAFKARTGDYTNEENGLPPAPKENPHKAQAALFSDPNMPMDMMDE

SEQ ID NO: 66538 - DNA, 635 bp, Zea mays
  misc_feature: Ceres CLONE 1539636
  misc_feature: Encodes the peptide sequence at SEQ ID NO. 66539
ggatcccccgggctgcaggaattcgtctcacccctagaaaaacggctcccgtctccatgggtctcctctcaacaggattgggagggagagcctcaaggcgggggatcatatctactcctggagggcggcgtgggtctacgcgcatcacggagtatatgtgggcgatgataaggtgatccatttcccaagaggaagaggacagagacgccagaacaggaactgtcgtcgatattattcttgtgagttccaccccaaaacgaagcaccacgccttgcccggtgtgcaccgacaaaaccagcaacagcagcacacagacgaacggcgtggtatcctcctgcctcagctgcttcctagctgggggtgctctctaccgtttcgagtacgcagtcaacccggcgctcttcctcgacaaagcgcgaggagggacgtgcacgctcgctccctctgaccctgacgacacggtggctcgccgcgccagatacctgctgagcaacggtttcaggtgctacaacctgttcaagagcaactgcgaggacttcccgatatactgcaagactgggcttcttgtcgctgagcaagttgttgtccggcaaagcgggcaggctatctccctccatcggtggaactctccgccg

SEQ ID NO: 66539 - protein, 39 aa, Zea mays
  misc_feature: Ceres CLONE 1539636
MGLLSTGLGGRASRRGIISTPGGRRGSTRITEYMWAMIR

SEQ ID NO: 66540 - DNA, 691 bp, Zea mays
  misc_feature: Ceres CLONE 1539640
  misc_feature: Encodes the peptide sequence at SEQ ID NO. 66541
tccccgcggtggcggccgctctagaactagtggatcccccgggctgcaggaattcgtctcacccctagaaaaaactccacccacgcctccactacaccacacagagccgcagcagactcgtcagggaaaggagatggatcgtctgcccgagtcgacccggagcatgaggaactacgcgtcggaggccggcgggcttcgcgcggcgcggcagggcccccacgggcggtcgctgacggcgcgcacggcgcacagcatgtccacgacggcgctgcgcaccaagtccaagtcggccgcctcgctgctgcgcagggtgcccttcgcgccgctccgccccgtcctcgccaacctgcttgaggtgttcctcgggagcgggggggacgggctgttccccgccgtgccgctcgccatcgctggccatggcgccgactttcggccagctgtggggggctacgcttcagcctaatcaggctcatccccccccgccgaacgggttaattttcttctcggaccggataggtgatattccccgggccccccgaggggggggctctcacaacgcgcgttgcggcaatgccctcggggctcatcaagcgggaaccttccgactcatgggggcgcctcatccgaggtcctctctctgcctccatcccctcgcgtccggttccctcaagtctggtggcgcggggctggg

SEQ ID NO: 66541 - protein, 109 aa, Zea mays
  misc_feature: Ceres CLONE 1539640
MDRLPESTRSMRNYASEAGGLRAARQGPHGRSLTARTAHSMSTTALRTKSKSAASLLRRVPFAPLRPVLANLLEVFLGSGGDGLFPAVPLAIAGHGADFRPAVGGYASA

SEQ ID NO: 66542 - DNA, 807 bp, Zea mays
  misc_feature: Ceres CLONE 1539642
  misc_feature: Encodes the peptide sequence at SEQ ID NO. 66543
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (45)..(45): n is a, c, t, g, unknown, or other
  misc_feature (46)..(46): n is a, c, t, g, unknown, or other
  misc_feature (271)..(271): n is a, c, t, g, unknown, or other
  misc_feature (275)..(275): n is a, c, t, g, unknown, or other
  misc_feature (276)..(276): n is a, c, t, g, unknown, or other
  misc_feature (281)..(281): n is a, c, t, g, unknown, or other
  misc_feature (533)..(533): n is a, c, t, g, unknown, or other
  misc_feature (567)..(567): n is a, c, t, g, unknown, or other
nnnnnnnnnnnnnttttnnnccggttcatntccccttaccccttnnttttatactggtactccccgcggtggcggccgctctagaactagtggatcccccgggctgcaggaattcgtctcacccctagaaaaaatctgggcgaaaactcaagcacgcggcgatgctgcgccttcgcgcttgcggcggcacggcaccggcatcggtgcccgcgctcgtcaggtcccgcctctccaggagatcctcctccgcagcctacgccgccgctaccgntcgnnctttncccggcttcctcctcttcgtccaccctggaagacctcgccgccgagcacagaggtttgagcaaaggtcatttttaaaggaagggggaagaccccaaatattcccgagatggggagcccccaatggctgtattagccgggtggcctggtttaattaaggattaaattcgtttccaacctctccctcccgaaaatcccctgggcccaaaattatttaggcccccacaaaccacacccccccacttgtgtgcgtncccagagaaaagaaaaatttctcaccccccaatntccacggactaagaattcgggtgcggtcctttatcttaataaacttctctctctccctctatctgtgaatactgatccaatgaagaccacgtccgcctacattttcccattttcttttatccctgatcacataaataaccctaaactaattaaaacatttctcccttccccctctcctccccgccttctttttacgttaaaaaacaagacaagaccccctcactcctctgcctttacagc

SEQ ID NO: 66543 - protein, 91 aa, Zea mays
  misc_feature: Ceres CLONE 1539642
  misc_feature (37)..(37): Xaa is any aa, unknown, or other
  misc_feature (39)..(39): Xaa is any aa, unknown, or other
  misc_feature (40)..(40): Xaa is any aa, unknown, or other
MLRLRACGGTAPASVPALVRSRLSRRSSSAAYAAATXRXXPGFLLFVHPGRPRRRAQRFEQRSFLKEGGRPQIFPRWGAPNGCISRVAWFN

SEQ ID NO: 66544 - DNA, 704 bp, Zea mays
  misc_feature: Ceres CLONE 1539646
aagctggagctccccgcggtggcggccgctctagaactagtggatcccccgggctgcaggaattcgtctcacccctagaaaaaacattcatgcccacaaattccttccaaacagaaacagcaccagactcctttccttttcctctcgctccctcgctctttctcccgcaactcggcgtcggcgaccgctgccgctgccctacgccaggtgcactgctgctggtctagtagcctcgtcggtcccttcgacaggttttccttcgggtcttccccgggggacgagcaccccgccaggggcccaatgataaggttggcgggccagaagggcgaaacaataaaaaggctggaaaaaaaaatgggacgggatggctgggtcctgggcccgccttccctttgggggaaaagatataagggaaccccgccccaaaaatgggcggggaaaattgggggcccaaaacccggaagaagggggcccaaaaaaggaggcccttgggccccccgcccctgggttcttggtgggggaaaaaaaagggggcgggaaaacccggggggccccttcaaggagggggttcaaaatgggggggggggggggggggggcccaaaaaagaaaatggggccccccctcccccccccccgggggggggccgggggtttataaaaaaaaacaaaacccgtgggagggggccttagggggcccctaaccc

SEQ ID NO: 66545 - DNA, 643 bp, Zea mays
  misc_feature: Ceres CLONE 1539647
  misc_feature: Encodes the peptide sequence at SEQ ID NO. 66546
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
aatgctggagctccccgcggtggcggccgctctagaactagtggatcccccgggctgcaggaattcgtctcacccctagaaaaagtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccgggggcgggccgcgacnnnaangtggtgctggcccccgccaaccccaaggacgattaccaccactggatcaaggacatgcggtggatcacaaccatcaaggacgaggaaggttacccggcgttcgcgctggtgaacaaggcgaccggggaggccatccaaccctcgctggggcagtcccacccggtgcccctggtgccctacaacccggactttcctgaacagtcggggctggggacggaaaagcccgaactctggaaaggcttccc

SEQ ID NO: 66546 - protein, 63 aa, Zea mays
  misc_feature: Ceres CLONE 1539647
MRWITTIKDEEGYPAFALVNKATGEAIQPSLGQSHPVPLVPYNPDFPEQSGLGTEKPELWKGF

SEQ ID NO: 66547 - DNA, 830 bp, Zea mays
  misc_feature: Ceres CLONE 1539648
  misc_feature (30)..(30): n is a, c, t, g, unknown, or other
  misc_feature (34)..(34): n is a, c, t, g, unknown, or other
tttttttctttctccttctttttctgcaanaaanaggggacccactcctcctaaaaagtggagctccccgcggtggcggccgctctataactagtggatcccccgggctgcaagaattcgtctcacccctagaaaaatcctactgtcacacacactcagagagagacaagtggtttccaaagccaagtgtgtactattagtctagcaaccagctagctcgggcggcagctggcagccatcatgtcggaggagaagcaccttcacttctttcacctccactagaaggacgaggagcatcccgccggcgagtacgggtaatccgagaacgaagtggtcaccgcccccggtgagcgcgagtactataggttcatgtaatgaagtatatgatcatttccacaagtagatactcgtgtgaggacccgccccatcgcgcgccggggggggtgtttaactcttacgagaagccacccaagctccacaaacagccctctctatttctctccacctgcttccttcatttcgcgtaataaacgttatctggtctactttccctcctcttccgtctctcagctacgcctacctcttattccactgatataatgacgtaaccacaaacttaaaggtatcattattgaaattttgtatataaattacttaaatccgtcttaattacaaaaataaccttttatttatctttcttaccataaattaatattaaataaactagataatagataaacaacaacaataaatactggatactatgttctacctttctttaatcatcggccaggtggtgataataaagagattcccctcaccccctaccg

SEQ ID NO: 66548 - DNA, 691 bp, Zea mays
  misc_feature: Ceres CLONE 1539652
  misc_feature: Encodes the peptide sequence at SEQ ID NO. 66549
ggagctccccgcggtggcggccgctctacaactagtggatcccccgggctgcaggaattcgtctcacccctagaaaaaactcctccgtcctccctccgcgtttacacccgccgccactcctgctttggcgccgtagctagcaaaggcgatatccatggcgacccctgcacggatcgagctggacaagctgagcgtggagcagctcaaggggctcaaggagcagacggatctggaggtcaacctcctccaggacagcctcaccaagatccgcaccgccgccacccgactcgagaacgcctccgccgcgctccaggacctatccctccgcccccaagggaagaagatgctcgtgccgctcactgcgtccctctacggtcccggttcactggacgacgcggagaaggtcctcgtcgatgtcggcaccggttacttcatcgagaaaaccatggctcaggggaaagaatactgtgaaaggaaaattaatttattgaagtccaatttttgatgaatttggttgaggtggctacgaaaaagaaagccataacctgacaatatggggtttggctcctacaatccaaggtggaggcaagccttcaccgggcccccaagtttatgattagtttgggatgcaacaccctcgtcttccttcctcccttttggtggtgatcaaaaacgccattttaagattttt

SEQ ID NO: 66549 - protein, 116 aa, Zea mays
  misc_feature: Ceres CLONE 1539652
  misc_feature (24)..(117): Pfam Name: Prefoldin Pfam Description: Prefoldin subunit
MATPARIELDKLSVEQLKGLKEQTDLEVNLLQDSLTKIRTAATRLENASAALQDLSLRPQGKKMLVPLTASLYGPGSLDDAEKVLVDVGTGYFIEKTMAQGKEYCERKINLLKSNF

SEQ ID NO: 66550 - DNA, 949 bp, Zea mays
  misc_feature: Ceres CLONE 1539653-R
caattgtgtacctcaagcgtctcgtttttttttttttttttggtacagtttccagtctgatagtttcaccacgaacacaaactcgagatgacataaacacaatatatgacgttcaaactcaaaggaatcacaaacccctgccaaaagcagaaaacacgattaacagtcgtcgatcgccatcccttgaacacaacacccttgtcatctcaagacgtggacttgcgccacttggtgttgggcgtcaaggtggcgctcttcttccccttgggcggcttccggcgctccatgccgctctcagagtcgtcgaccctagcgacgtcggcgcccatgccgccgccgaaccagaacgcgctccacttgaagaagccgccaccgccgccacgccgccgcctctcggagcccaccctgtccacctgtggcctgcagcgcgttgcactgcacctggagcctggcgtacgtcttcgcggatgcggttcacctcctggtgctgcgcgaggacctcccgctttggagggcagcggtccggggagctccagcgccgggttggggctggggctgcgctggccgcttaaagaagcgctctagctcggctaagcggttgagcctggccgtgaccccgataaaagaaatttgcactagggcgcggaccggcatgcgactcggtccttcaacgtcagcactccgaggcctccgacaggaagcttgtttcgcgttcaattatgccggctctatatgaattggcactccctccttccgcggtgacctgggtgacacctcttacggtattggggtcacccagtaagggcatcagggtgttctttcctactgaagactctctctttagatgagggctacccctcggccgccccaatctttaccccaatatattcgctttgggtgtccacctatattctcgcccctacctttatctgggtcgcacactttgtaa

SEQ ID NO: 66551 - DNA, 594 bp, Zea mays
  misc_feature: Ceres CLONE 1539654
  misc_feature: Encodes the peptide sequence at SEQ ID NO. 66552
  misc_feature (594)..(594): n is a, c, t, g, unknown, or other
tggagctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcaaggtcgggctcgcgcacggctacctcctcgtgggggccttcgcgctcacggggccgctccgcagcacgcccgtgcacgggcaagccggggcgctcggggccccn

SEQ ID NO: 66552 - protein, 125 aa, Zea mays
  misc_feature: Ceres CLONE 1539654
  misc_feature (44)..(124): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVKVGLAHGYLLVGAFALTGPLRSTPVHGQAGALGAP

SEQ ID NO: 66553 - DNA, 796 bp, Zea mays
  misc_feature: Ceres CLONE 1539657
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
ggtgggggggtgtccccccccccatttacttagttgttatacnnnggccccgnnnnnaagaacctggagctccccgcggtggcggccgctctagaactagtggatcccccgggctgcaggaattcgtctcacccctagaaaaagtgcctgatctccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccgtgggctgctccgccgccacccggcgacagcagcagcgtgtcgctcgggtcctccgtgaagacgttctcccgccgccggctggcgctggcatcgatggctgctggtactccgagccggcgacgttccttttcgtcccgcggggcgtggcgggggggggggggggtggacccccgtggctaggggtcgtgaggcccccacccgccgaaagcgcggcgaagaaaccgccgatcatggaaggctccaccggcatcgcctagagcgaagctaccccgcctcaatctgcacctcccctccagtataggcccccggatgtgtccccccaccacaacaacaaccccaccttccccgccccggaggaatgttggggccaagtgttcgggccctggtcgccgtgactggcatgcctgacggccctatgaccggataccccatgtacttcattgtatacgtacatactatgacctctggatcctatatggacgcaacaaccctcttact

SEQ ID NO: 66554 - DNA, 714 bp, Zea mays
  misc_feature: Ceres CLONE 1539658
  misc_feature: Encodes the peptide sequence at SEQ ID NO. 66555
  misc_feature (22)..(22): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ggggggtgttgccccccccccnatatttgttgttatcaccacctcttnnnnttcatagctggagctccccgcggtggcggccgctctagactagtggatcccccgggctgcaggaattcgtctcacccctagaaaaacgaagcaattctaaatcctcgcgcagaagatcggatcctccgtcagatccgcatcggtgcttgccctccctgctcggatttctggcagccctttcctaccccctgaattcctgtgcggattccctcccctgccctggcggttgctcctgttgcctggtgggaacttgagagttgagaggaggggttggtgggggtggaaggcgctcgtgacccggcccgtggagatggctggcgtgaaggagccgatcgaggtgaagttccggctgtccgacggcaccgacatcgggcccagcaagtacgatcccaacaccaccgtcgccgcgctcaaggagttcgtcctcgcccggtgggcgcaggatatagaaatagctccaaaaactgtcaatgatgtgaagctcatcaatgttggaaggatactggagaatagcaaaactcttgctgaatctcgtggcccagatggagaagttcctggaagtgtgattacaatgcatgggtattgtgcgggcctccccaatccttaaaaacaggtggagaaggcaacagtccaaactctcccgaagcccctactgaatgtggg

SEQ ID NO: 66555 - protein, 98 aa, Zea mays
  misc_feature: Ceres CLONE 1539658
  misc_feature: SWISSPROT Homolog: EC 2.7.1.40 Pyruvate kinase
MAGVKEPIEVKFRLSDGTDIGPSKYDPNTTVAALKEFVLARWAQDIEIAPKTVNDVKLINVGRILENSKTLAESRGPDGEVPGSVITMHGYCAGLPNP

SEQ ID NO: 66556 - DNA, 729 bp, Zea mays
  misc_feature: Ceres CLONE 1539662
  misc_feature: Encodes the peptide sequence at SEQ ID NO. 66557
  misc_feature (416)..(416): n is a, c, t, g, unknown, or other
aaagctggagctccccgcggtggcggccgctctagaactagtggatcccccgggctgcaggaattcgtctcacccctagaaaaagagaactggcgggagaagcggcgagctgctcaggggagcctggattctccgaccggaggcgggtagcgtcagtcaccaaagactgtttcgcccgtgcgtgctctgtctcagactgttttttgcctttgtgtggtgaggatgaggacatttggggtttcccgtgtttgttaggtgtacatttgtaggtgtaaaacaacagaaaagggaacgtttgggtgaaaatggagggaagagaaggatgcttgttctggatgtcaaaaaaaaaaaaaaaaacgagacgctcgaggtacccaattcgccctatagtgagtcgtattacgcgcgctcactgnccctcgttttacaacgtcgtgactgggaaaaccctggcgttacccaacttaatcgccttgcagcacatccccctttcgccagctggcgtaatagcgaagaggcccgcaccgatcgcccttcccaacgtttgcgcagcctgaatggcgaatggaaattgtaaccgctaatattttgttaaaattaccgttaaatttttgttaaatcccctcatttttttaaccataggcccgaaatcggcaaaatcccttattaatcaaaagaattaaccgagatccggttgagtgttgttccagtttggaacaggggccacta

SEQ ID NO: 66557 - protein, 84 aa, Zea mays
  misc_feature: Ceres CLONE 1539662
  misc_feature: SWISSPROT Homolog: EC 3.2.1.23 Beta-galactosidase
  misc_feature (32)..(32): Xaa is any aa, unknown, or other
MLVLDVKKKKKNETLEVPNSPYSESYYARSLXLVLQRRDWENPGVTQLNRLAAHPPFASWRNSEEARTDRPSQRLRSLNGEWKL

SEQ ID NO: 66558 - DNA, 606 bp, Zea mays
  misc_feature: Ceres CLONE 1539671
cccgcggtggcgccgctctagaactagtggatcccccgggctgcggaattcgtctcacccccctagaaaaagaatactctaggatacaaggggtttgcctgcagactgctctgtgttgccgttgccgctgctttcttttgagtttcactgaaagtggaaaccataacttgggtaaatgtaacgttcggttttcagcttcaccaagacaataattttcccggcaaaaaaaaaaaaaaaaccagagacccttcaagggaccccaaattcccccccatagggggagcccatttccccgcccccccccctggggcccccctttttttaaaaccacccctgggaattctgggggaaaaaaacacggggggaccccccaaaaataaaccccttgaaaaaaaacccccctttttcacaggggggggaaaaaaaaaaaaaaaccccccccacggaagcgccccccccccaaaattgtccccccccccctggggggaaaaaaaaaaaatattatccccccgcttatttttttggaaaaaacccccccgaaataattttttttaaacagaacccccccttcttttttttctcctacaagggcggacgcaaatatgc

SEQ ID NO: 66559 - DNA, 646 bp, Zea mays
  misc_feature: Ceres CLONE 1539676
  misc_feature: Encodes the peptide sequence at SEQ ID NO. 66560
  misc_feature (250)..(250): n is a, c, t, g, unknown, or other
aaagctggagctccccgcggtggcggccgctctagaactagtggatcccccgggctgcaggaattcgtctcacccctagaaaaagaactggagggagcagagttggaatctcagcttcttgagcctgttgcagctcctccggtgcatccagtgcatgtcccagccaacaagcaaccagctcgccctggccccacagaaaagttaccagctgagacgatgactgctgcctgcagcgaaatgcatttgatcnggtctcatgagagtgaaactgtaatgaaaataaacctaatcagcttccttaattttgcctgcggggacaaacttgccggaaatttgcaaacccccaaaaaaaaaaagggtgcttcccccccagggttttttttcgggatttgaaaaaatttggtccaaaaaaaaaaaagttttctttttaaaaagcccccccgggaaccctcccccctatttttttccccccccccggcggccactttttagaaaaaaaaaaaaaccccccaaaaaaaaaaaaaacccaaaacctccggggaccccacattccccccctaaggagggggatttattcccccccctttagggggggttttttataaaccccgcgggggggagaaaaacccggggtgtcccccaataa

SEQ ID NO: 66560 - protein, 130 aa, Zea mays
  misc_feature: Ceres CLONE 1539676
  misc_feature (84)..(84): Xaa is any aa, unknown, or other
KAGAPRGGGRSRTSGSPGLQEFVSPLEKELEGAELESQLLEPVAAPPVHPVHVPANKQPARPGPTEKLPAETMTAACSEMHLIXSHESETVMKINLISFLNFACGDKLAGNLQTPKKKKGASPPGFFFGI

SEQ ID NO: 66561 - DNA, 694 bp, Zea mays
  misc_feature: Ceres CLONE 1539682
  misc_feature: Encodes the peptide sequence at SEQ ID NO. 66562
  misc_feature (394)..(394): n is a, c, t, g, unknown, or other
  misc_feature (400)..(400): n is a, c, t, g, unknown, or other
  misc_feature (401)..(401): n is a, c, t, g, unknown, or other
  misc_feature (408)..(408): n is a, c, t, g, unknown, or other
  misc_feature (409)..(409): n is a, c, t, g, unknown, or other
  misc_feature (694)..(694): n is a, c, t, g, unknown, or other
acaagtggagctccccgcggtggcggccgctctagaactagtggatcccccgggctgcaggaattcgtctcacccctagaaaaagctgccactaaccagccaagagtaatccagcgcccaccgcatggccgcgcgcgcacctctcatcatgccgcgcgccgcctccagcgccggcccggtcccggctgcggcgacgaccgtggccaggcgccagtccgcgcagtgtctccacgcgaggggggctgtcggcggcctcttcttcgaccagaggacagcgcggccggtccaccacctcctccctggcgccaagttcggagcgattgggagcaccgcggaggccagcccgtcggaggggttttttcaccccctccagggggggggggggggggggatntaaacnnaaaaacnntccccccccctgatctgtggaaagaaaggaaggctgtggttggcgtttgcccctgcatttccgggggcttgcttgtgccgaaaaagggcggaccttcctcccccccaaacaggaaggacttgccagctgctgtagttcctctttgttttaactcggaccacgcagcggctaaacaggcacaacgcatttttgtgaaccaaaccaattctcaaagaaaaagtgttttgcttaaccctactccctccgtcgaacggacgcccctggacttttgcattccggacttcn

SEQ ID NO: 66562 - protein, 89 aa, Zea mays
  misc_feature: Ceres CLONE 1539682
MAARAPLIMPRAASSAGPVPAAATTVARRQSAQCLHARGAVGGLFFDQRTARPVHHLLPGAKFGAIGSTAEASPSEGFFHPLQGGGGGG

SEQ ID NO: 66563 - DNA, 718 bp, Zea mays
  misc_feature: Ceres CLONE 1539683
  misc_feature: SWISSPROT Homolog: EC 3.2.1.23 Beta-galactosidase
caaagctggagctccccgcggtggcggccgctctagaactagtggatcccccgggctgcaggaattcgtctcacccctagaaaaatgggtggcgttgctctttaggcagccgacagccggggattgctccattgaaataattcgccggcgtaaattgttgctgttccaggtgacatgatcgtatccctccctccctcccgttgtccctggaagtcattagatgttaccgctgtatatgtgcgtaacctgtgttgcttataagtccatctgagttgtatgccaagcactagtgaccaaataagtaaagtaaatttctcaagtgtctggtcgacctgggtgtcaagcgagggcagtatgtacaaatctgcattgtattgtgtgttcggttccaacgtcactcttaaataaccgaatagctgcacgcttgtttttaaggtgtccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttccccagctggcgtaatagcaaagaagccccgcaccgatcgcccttcccaacaattgccccgcctgaaaggggaaatggaaaatttgaagccttaaattttttgttaaaaattcccgttaaaattt

SEQ ID NO: 66564 - DNA, 676 bp, Zea mays
  misc_feature: Ceres CLONE 1539695
  misc_feature: Encodes the peptide sequence at SEQ ID NO. 66565
aaagctggagctccccgcggtggcggccgctctagaactagtggatcccccgggctgcaggaattcgtatcacacctttaaatactatatcatcaatacctaaagattggattgttagtatggatttgtttggccaaatctttgttctgtcgtaaagtaaggggagggattcctgcccctgcgcctgcttaaaatacttatatgaacaaaaaaaaaaaaaaaaaaaaaaagaaaaaaaaaaaaaaaaaaaaaaaaaaaaaaaccccacacagccagtagtgctccacttgctagtccactcctctctcagtcaaggcaatggcctccgcttccagtagcttccgcctcgctctgttcttggttctgctggcgtttgtcagcttggcacggcacgccacgggggaggccagcccaagcaggaggctcatggagctgtacaagccgccgcccagcgatctcctaaggtaccacaacggcgccgtgctgagcggcgacatccccgtctccgtcctctggtacggccgcttcacgcccgcgcaaaaggccatcgtcaccgatttcctcctctccctctccgccgcgccaaagtcccctgcgccttccgtctcccagtggtggggcaccatcgaccggctctacctatcaaaggcggcggacgcggccgccgtcgggaaga

SEQ ID NO: 66565 - protein, 119 aa, Zea mays
  misc_feature: Ceres CLONE 1539695
MASASSSFRLALFLVLLAFVSLARHATGEASPSRRLMELYKPPPSDLLRYHNGAVLSGDIPVSVLWYGRFTPAQKAIVTDFLLSLSAAPKSPAPSVSQWWGTIDRLYLSKAADAAAVGK

SEQ ID NO: 66566 - DNA, 667 bp, Zea mays
  misc_feature: Ceres CLONE 1539696
  misc_feature: Encodes the peptide sequence at SEQ ID NO. 66567
ggagctccccgcggtggcggccgctctagaactagtggatcccccgggctgcaggaattcgtctcacccctagaaaaagcctgcgccgccagcccgccacatctgttacaccgcccgaaattcggaggggaagtcctcgacgacgtcgcggcaattggcagctcggacgatggcgtccaactccgcggccccggctgccgccgacgggggcgacgacctcgaccagctcctcgacagcgcgctcgacgacttcaccagcctcgacctctccgcctctgccgcccccaaaagcgccggtgaggcatcggggtcaggatcgggaggcaaggggccggtgaaggggctggggctggggcttccggaccccaaggtgccgaagcggcgcgcggggaagcagccaccgccgaggggcgcgtgcgccaaagaggcgcttgaggagctgacgcgcgagacgcgggaggctgtgcgcgagctcgagacggccactgggggtgttccgtcactggacgatgacgccatgatggaggagttcgtcaaacagtttgaggagttcgcaggggcacaggatatggactccattgttgaaacaatgatgcggcagcttttgtccaaggagattcttcatgagcccatgaaggacattgtggagaaatatccaaaatggctg

SEQ ID NO: 66567 - protein, 166 aa, Zea mays
  misc_feature: Ceres CLONE 1539696
MASNSAAPAAADGGDDLDQLLDSALDDFTSLDLSASAAPKSAGEASGSGSGGKGPVKGLGLGLPDPKVPKRRAGKQPPPRGACAKEALEELTRETREAVRELETATGGVPSLDDDAMMEEFVKQFEEFAGAQDMDSIVETMMRQLLSKEILHEPMKDIVEKYPKWL

SEQ ID NO: 66568 - DNA, 753 bp, Zea mays
  misc_feature: Ceres CLONE 1539711
  misc_feature: Encodes the peptide sequence at SEQ ID NO. 66569
  misc_feature (397)..(397): n is a, c, t, g, unknown, or other
tagctggagctccccgcggtggcggccgctctagaactagtggatcccccgggctgcaggaattcgtctcacccctagaaaaaaatgctggggtggatcctgctgggcgtcttcggcctcatctggtccctctacaccgtctacacctccacgctcgacgaggacgacgactccggcctctcgctctgaactcatccgtcgattattcctagctactgtattttttgttcagcctgacccgtgagttcgatcgatctatgcatgcgttggtgcagacgaagcttaagaccgtggttgtatgcgaccgtaattcagttgttgcatctcagatggtaatgataatgacgagtacgtagaaccattccagcgaagaccgcaccgatcgcccttccaaacngttgcgcagccccaatgaaaaaagaaaaattgtaaacgtaaatattttgataaaattcgcgttaaaatttttgaaaaaaaaaaaaaccgtatgcccccaggggccccaattcccccaaatgggttttaaattacgcgcgtcccccgggccttggttttaaagctgtggcaaggggaaacaccctggcgttcaccaaagtaaagcgcattgaaacacattccccttttcccacctgtgtttaaaaaccgagagggccccccaccccaacccccccccctcaaaaaattttcctacccggaaaggggggaagggaaatttgttaaactctttaattcttttttgagaactccccgctt

SEQ ID NO: 66569 - protein, 34 aa, Zea mays
  misc_feature: Ceres CLONE 1539711
MLGWILLGVFGLIWSLYTVYTSTLDEDDDSGLSL

SEQ ID NO: 66570 - DNA, 872 bp, Zea mays
  misc_feature: Ceres CLONE 1539712
  misc_feature: Encodes the peptide sequence at SEQ ID NO. 66571
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (707)..(707): n is a, c, t, g, unknown, or other
  misc_feature (821)..(821): n is a, c, t, g, unknown, or other
acaatcactaactttatttaattcttcnnntctttgttttttcatagctggaactccccgcggtggcggccgctctagaactagtggatcccccgggctgcaggaattcgtctcacccctagaaaaaccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagaagcagctagaggttgcgaagcggcaagcggtggtttactctctctacgccccccaggccaagagcgtgatggagttgaaggtgcagtggatgggttgccacctttttcttccccaccgtttcccgttccagattccttgccttttggtggtgatgagtgaaaactattaaactggctcccgttgctcaccattttcctgggattgactcgtcgatgaaaagaggttaccgtcgctggcgcaattaaaattaactacaatttcttacccgtctttgaggacaccagaaaaaaacctgaaaccgcttcgatggggatcccgcagttccgcctcattaaggtagaggtcnttactatacctcgggtcttactccgccactgcgcattgtggaaaaatgtgctcgagcctggggaacaaacccattgacaggtttcctcaacaaaagaaaatgacccactgacancctctccccgcccctatttcccgctaggtgggtacttacaatcacagaaaa

SEQ ID NO: 66571 - protein, 118 aa, Zea mays
  misc_feature: Ceres CLONE 1539712
  misc_feature (6)..(70): Pfam Name: Complex1_LYR Pfam Description: Complex 1 protein (LYR family)
MAAAAPTRAEVLSLFRSLLRTAKKFSDYNIREYTRRRAADSFRENRALADASAAAAAFSEGKKQLEVAKRQAVVYSLYAPQAKSVMELKVQWMGCHLFLPHRFPFQIPCLLVVMSENY

SEQ ID NO: 66572 - DNA, 650 bp, Zea mays
  misc_feature: Ceres CLONE 1539713
  misc_feature (12)..(12): n is a, c, t, g, unknown, or other
  misc_feature (25)..(25): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (89)..(89): n is a, c, t, g, unknown, or other
  misc_feature (92)..(92): n is a, c, t, g, unknown, or other
  misc_feature (121)..(121): n is a, c, t, g, unknown, or other
  misc_feature (122)..(122): n is a, c, t, g, unknown, or other
  misc_feature (138)..(138): n is a, c, t, g, unknown, or other
ggggggggtggnggtggttgggggnnagnnnaaagaggaaaacaatttctttttnnnnnnnnnnnnnccaaaactgggagctccaccgncgngtgggcggccgctctagaactagtggatnncccccgggctgcaggnaattcgtctcacccctagaaaaatccatccatccatctattgtctcccttccaattcgatgcctttgtagcgctgctgcctcgccgcgtcgtcgcgggtccccgatttccgcttgctgctgcgctttccacaccatggaacggcggggggatcccggaatggcctccgggcggaagggggggggcatcaaaggggtggttattataacggttccccgggatccccgaaaaaaaccccccccccgccccacccgaaaaatataatagccgcccccccctttttttccccggaagagcttccccataaaaaaaggggcccccccgaaaacgggggggggggaaaaaaaaacccccgcggggggggggcgggggggggggaaaaaaataaaggggttctcccccgggggtttccccggggggggccccccctccttttttttttttttaaaaaggggggaaaaaaaaaaggtttttttttaaaaacccccgcgggggtgtttttttctccccccc

SEQ ID NO: 66573 - DNA, 725 bp, Zea mays
  misc_feature: Ceres CLONE 1539714
  misc_feature: Encodes the peptide sequence at SEQ ID NO. 66574
atagctggagctccccgcggtggcggccgctctagaactagtggatcccccgggctgcaggaattcgtctcacccctagaaaaatcgtacctgagtgttgtgttgtggtgtgtttgctcatgtacttcggtgcgttgcttggtaaactggtcagtgttgtgtgtttgccttcgttgtcatggatttcgacggaataataaagacctcgagtagaagaggtcagggttttttcaaaaaaaaaaaaataaacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaa

SEQ ID NO: 66574 - protein, 102 aa, Zea mays
  misc_feature: Ceres CLONE 1539714
  misc_feature: SWISSPROT Homolog: EC 3.2.1.23 Beta-galactosidase
MDFDGIIKTSSRRGQGFFKKKKINKKKKKNETLEVPNSPYSESYYARSLAVVLQRRDWENPGVTQLNRLAAHPPFASWRNSEEARTDRPSQQLRSLNGEWKL

SEQ ID NO: 66575 - DNA, 759 bp, Zea mays
  misc_feature: Ceres CLONE 1539723
  misc_feature: Encodes the peptide sequence at SEQ ID NO. 66576
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
ttgtttttttttttctttttttctccttctcgctanaaatccnnnnttnnccatagctggactccccgcggtggcggccgctctagaactagtggatcccccgggctgcaggaattcgtctcacccctagaaaaagttggacggacttctagcatcaacagctttacaactacgtccaggtctgcagccagtactggcaggaactcagcaccttcatctgctccatcatctcgtccaagttctccaaatccacgaccccgagctccagtgcgacctcttgatatccccgattttccaaatgaaactccaccaaatctaaggacaaaattacctgaaagaccaccatctgctggcagatcacggccaggaatggctttaggcataagatcaaccccaaatactgaaccttcagctgcctcagctcctgtgaagaagatctctgtgcctgctgtgagccgaagtaaattttctgatgcatcatcaaagacctctactctcacaaatggacaccaaaatcgacaggctgataggtccaatattgacaatcaagctaataaaccctcgagaccttccaccgggtaaccacagataatggattttgggaggtcgaatatcaaggaggacacttggacatggcttatcaaagcacatgggacaattcggccagaacttgggggggggaattcatgggcacaatccccttgtgttcccccaagaagcattcccgccttcgggctgccttggccaaaggatccccgc

SEQ ID NO: 66576 - protein, 193 aa, Zea mays
  misc_feature: Ceres CLONE 1539723
  misc_feature (12)..(12): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
LFFFFFFSPSRXKSXXXHSWTPRGGGRSRTSGSPGLQEFVSPLEKVGRTSSINSFTTTSRSAASTGRNSAPSSAPSSRPSSPNPRPRAPVRPLDIPDFPNETPPNLRTKLPERPPSAGRSRPGMALGIRSTPNTEPSAASAPVKKISVPAVSRSKFSDASSKTSTLTNGHQNRQADRSNIDNQANKPSRPSTG

SEQ ID NO: 66577 - DNA, 676 bp, Zea mays
  misc_feature: Ceres CLONE 1539724
ggagctccccgcggtggcggccgctctagaactagtggatcccccgggctgcaggaattcgtctcacccctagatcaaagactccagattccacccacactcagtcctaatccgtttgctctcgtcgaccgctactccctccgaccgactctgcaatgcgctgtgctgcctgccttccactgttcctgcttccatacccctttcccaggctggtctctctggctctacggctgctgcgattccccttcccccctagttgcgccgcgccgactggacactggtcattgtgagcggtcataatttgtgttggaactcgcctggcacctgctccaagccctaccacatcctgtgcggggcgactccagttccagatcatccaccatctgctgttcgagtacaccaagaagacggactccgtgctcctggtggacgccgccgacctacactctcctgcaacacctcctcctacgtctccaggttcgacgaccgtctactcggtgttagcgtctcctccgctcaccggccttcttcttcatcttcttgaacgagacctgctgccgagccctcgataagatcatcatcggcagcctcccataccgatcttgaagccgcaacccgacgacatctgtcgagcacggtacggaacacaccctcacgatctgctgctagcgccctg

SEQ ID NO: 66578 - DNA, 761 bp, Zea mays
  misc_feature: Ceres CLONE 1539730
  misc_feature: Encodes the peptide sequence at SEQ ID NO. 66579
gggttgtttctctctccccttgccttggggggggtggggtgggggggtgggaaaaaagtggagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacgacaacaagaagttcgagacgctgtcgtacctgccgccgctgtcgacgggacgacctgctgaatcaggtggactacctgcatgcgcaacggctggataccccgccccgagttcagcaaggtctgtctccgggtaccgcgagaattccacctcccccgggctacttgcgacggccgcctctgggaccatgatgtaaagcttgcccgaggtttcggctgccgacgacaaccacccacggcgtatacaaagaagctgcaattaagtcaattacaaatctctaacccggtacgcccctcccaccgccggcatccaagctttcaactaaccttcatacttcaacagcacggggcgcacccgcttccatcgtccctaacatagaccccccgggggcagcgcaatca

SEQ ID NO: 66579 - protein, 118 aa, Zea mays
  misc_feature: Ceres CLONE 1539730
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYDNKKFETLSYLPPLSTGRPAESGGLPACATAGYPAPSSARSVSGYRENSTSPGLLATAASGTMM

SEQ ID NO: 66580 - DNA, 662 bp, Zea mays
  misc_feature: Ceres CLONE 1539731
  misc_feature: Pfam Name: PsaN Pfam Description: Photosystem I reaction centre subunit N (PSAN or PSI-N)
aagctggagctccccgcggtggcggccgctctagaactcgtggatcccccgggctgcaggaattcgtctcacccctagaaaaagtcgaggagctcgagagggcaccaataatggccgtgcgtgaactccagcgtcgtcagactcaagcccgccgcggaagtgccgcacgccgccgccgcatcatcggaggtgaatcgggtgcagctggccgcgcccgagggccgccgcgccgctctgctcggcctggcggccgtcttcgacgtctcggccaaccacgggtcggccaaggccacgatcttcgatgattacctccaaaagagcaaggacaacaaggagctgaacgacaagaagaggctggacaccagtggatccaactttgcgcgcgcctacaccgtggagttcggcagccgccagttcccctacaaattcactgggtgccaagacctctccaagcagaagaaagtccccttcatcagcgacaacctcgagattgagtgcgatgggaaagagaagttcgagtgcggctccaacgctttctggaggtggcgaagcagctaacaacagcgtctgatggcaaaggaagagatcatcacctgtcttgtcgaccctatatatgtccaaactgcaagaaaattagatcttactgcgtaattgcgctcact

SEQ ID NO: 66581 - DNA, 718 bp, Zea mays
  misc_feature: Ceres CLONE 1539733
  misc_feature: Translation starting site: 244
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ggggggtggggnntncnntcnnctcgcggccgccnttntttttctnnnnnnnccatagctggagctccccgcggtggcggccgctctagaactagtggatcccccgggctgcaggaattcgtctcacccctagaaaaaatcgcaaatcctcgggcaagaagagccaacagaaaagtattcatccaagaacaccacccccacccgctccaagcagaaattttgtcttgaagagagccaccaccaatggcttgttacaacaacactgcatctttagcggcgactctgctggcgttcgcgctgacgtttcaggcctgcctcgccgggaggaggctcaccgcgctggtgcaggagccggccataaccatgaagtaccgcaagggcgcgctcctgtcgggccccatcgccgtcaacttcatcgtggtacggggacttcacggcgccccaccgggcggcgatcaccgacttcgtcccctcgctgactgaggcggccccggccgcggtccagccggagccgtccgtggccacagggttaaagacggcgcgcaggtattacgcccgctccagggtggcgtccccggcgctgcgactcgggtcccaggccggcgaccggaactgctccctccgcaggccccctgaaaaaaagggacctgcttcagcttcgccgccaggggaagcccgagacgggccatcaaaccgggggctcacggcccccctaatg

SEQ ID NO: 66582 - DNA, 907 bp, Zea mays
  misc_feature: Ceres CLONE 1539745
  misc_feature: Encodes the peptide sequence at SEQ ID NO. 66583
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (879)..(879): n is a, c, t, g, unknown, or other
ctctgctgtcgggggttgtgccacccntnnnggggaccacnncnccaccccccggccccaccgcgggtggcggccgctctagaactagtggatcccccgggctgcaggaattcgtctcacccctagaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatccccaggaacaactagctaagtcattcctttgccgacgacgaggccgggggggcgggatctcgcgcctgttcatctgcccccacccccgaccttgcgccggagtgcacgatggctcgacatcccggccgggggtgtggctgcccgggcccccacccaccgcgggcgcgccctggtgccccgggaatgccaagttagttcactggtcactacacccaggcgggccgaggattggctactccctcgcgttcatccaaacacctgctgccgcgcgacccttctcgcggaccccccaattgttcgccccgtactaggacggttgtgcatcttgtcccgcttcggcggtcccgcgggccggcgcggatctcgatataggcgccgcgggcccacgctacacccctgtgccgccgcacccggcccggtcttaccgcggcaggggagctcatgcccatcgcgacgcgcttggtacaggggggtcgcgcgctagcggggtgggtanaccgcgacaccggctggccacgcggctg

SEQ ID NO: 66583 - protein, 58 aa, Zea mays
  misc_feature: Ceres CLONE 1539745
  misc_feature (6)..(56): Pfam Name: UPF0057 Pfam Description: Uncharacterized protein family UPF0057
MSEGTANCVDILIAIILPPLGVFLKYGCGHEFWICLLLTFLGYIPGIIYAIYAIPRNN

SEQ ID NO: 66584 - DNA, 914 bp, Zea mays
  misc_feature: Ceres CLONE 1539746
  misc_feature: Encodes the peptide sequence at SEQ ID NO. 66585
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
ggtcgggcgtgccttcgcctacttcgnnnnncgcnnnnnnnncaaagctggggctccccgcggtggcggccgctctagaactagtggatcccccgggctgcaggaattcgtctcacccctagaaaaagtttggctttgccatcatgaagcttaacttccagaagagataatgacgataggagttgggaaatcacctcctaggagacaaagggatttttgcattcgttgggtcgtgcaagtagatttgactgtgcatattgggagagtacgccataatatatggattcgttgattagttaaagttatagaagttattgtgtgctcctgtttttctttttttgaagggatattgtgctcctgtttgtttgtcgtaggaaatattgggcaccctttcaaggagggggatgccaggaagactgcgggaggagtagttctcccgtccctgcgaagtattcccccccgcgcgcgcttagaaagggagagagacaaagcgcgaacgccgcgtgggtcccgcatgttctcccccctatatgagagggccatgtttacgctgcgtcctactctggggccgattcgtttatgccagaggcgtcgtgtcgctgcgcgaaaaaacacctcggggggtcttcccccaagtcattagttcgggcctagtgtcgtggccgggccgcccgctttttacgccacgcttggcggcttatcatatactcgataacacgccgcccacgcccgtaattgtgccctctcccctagcggagtgggtccactccgtgtgatggggggggaatgggaacgttgcatggctgctgggaagagtcgcgcgtcctcatcctccgctggtttctatgtggtgcaatccctcttagcaccagcgttcctctgcgacccggctaggccggccttgcgcgcggtcg

SEQ ID NO: 66585 - protein, 50 aa, Zea mays
  misc_feature: Ceres CLONE 1539746
  misc_feature (9)..(9): Xaa is any aa, unknown, or other
  misc_feature (10)..(10): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
VGRAFAYFXXRXXXKAGAPRGGGRSRTSGSPGLQEFVSPLEKVWLCHHEA

SEQ ID NO: 66586 - DNA, 802 bp, Zea mays
  misc_feature: Ceres CLONE 1539754
tccccgcggtggcggccgctctagaactagtggatcccccgggctgcaggaattcgtctcacccctagaaaaacaagggaactgctggaggggaagggcagcagggcgaacgacctgcggagtgcaagcagcagtgaggtgctgcacaatgaatgttggcaggcattggttatggagcaattagtttggttctgcttgatgcgcaaggtcattgagttggtttgtggaaccttcgagggggtgcttgttggttttatggaattggttggggaatttttctgggacatggcgttatatcattatatgtgggtagtttcttcacgttctgtattgggtttcagatactatatctcccttcttagggggggggaggaaaatcctttcccactctgggatgcctcatttgtgcaaaaaaaaaaaaaaaaaaacgagaccgcccgagggtacccaatttcccccctaaagtgaagccagtattaccccgcccctcccctggccgctccttttttaccacggcccgtaacctggggaaaaccccctggtcgttaccccaaacttaaattccccttgcccgccaacacccccctttttccgccagcttggcggtaataagccagaaaaggccccccacccgattccccctttccctcaccatttgcacccacccttgaatggtgcaaatcggaaatatctaaaccggctaaaatttttggtcaaaaactaccccttaaactcttttgtgaaacacccgtcccccctttcgttaaccccacgccgccgacatacggccaaaacctgctta

SEQ ID NO: 66587 - DNA, 633 bp, Zea mays
  misc_feature: Ceres CLONE 1539760
  misc_feature (120)..(120): n is a, c, t, g, unknown, or other
ccccgcggtggcggccgctctagaactagtggatcccccgggctgcaggaattcgtctcacccctagaaaaagtctcgagatctcgccccgtcgccatggtacgcgatcgacagcgtggntggatcccctccgcgacttcgccaaggacagcgtccgcctcgtcaagcgctgccacaagcccgaccgcaaggagttcaccaaggtggcggcgcggacggcgatcgggtttccgtcgtcatgggcttcgtccgctttcttcgttaaagctcatcctttcatcccccattaaaacaaaaattcattcgtccgggtttcccggggcttaagggctttttcaccagggaaataccaaggggggggaactaaacagggggaaaaaagggccaaaaatttttttggggaaatccaccaaaaaaaaaaagcgggggggggcccccccccgggggtccttttttcacaaaaatagatatattttgtccaaaagaaaaaaaaatattttttttcttccccaaaaagaatgggttcttctctaaaaaaataaaaaaaaaaactacctctcttcatgcccccacgccgtcatgtgatatagctctattttctctctcccaccgatgatgcatggaaaagaaaga

SEQ ID NO: 66588 - DNA, 947 bp, Zea mays
  misc_feature: Ceres CLONE 1539765
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ctgggccaggtgaccccttccccacacnnnnnaaaaatctnttnnnnaaaacacaactccctccacaacggtggcgagccgctctaaaactagtggatcccccgggctgcaggaattcctctcacccctagaaaaaactatggtcagccagtggtggctgcccatactaaggacaccaactatgcttcaaatgctccagcaaatactgcaaaaccaaacaatagggggattggtgataaggcatttccagttgagtccgaaagttgataaatcatttgagtttttttcttctgaaaacacaaaattggtgtttaccttatgtagtcgtgtcctcgatgctgagcgagtggaaagatgtaacttccgcaccttcggatatgaagcggctctcgcgatccactttttttttcccccccccacggggggggggggggggggcgcccctactccccctcctccttcgccccccgcggacggcgcgcggacacccccaatctccgcccccggcccgggctgaggaccgcagcgcgctcccactcccgctattccgccgccctctctcgacgccctcgctgggtgtacctgacgtggcgcctcgcgcgggagacatagccacacacctctgctacgagagccgtgcgacactcgtctacggtgtccgctgcttcctggcaccccaccgcacgccctgtcgcaacctgtcacgccaacatccgtggtctggccgagtgtgtactacgccggcccgcggagatggtggctccccctgtctcgattagactccgggcgagccagcgcccgaacgacgcaatccaccaaatgcttctcgctcgactgaagcccccgactcgtgtaatcccctgactcccacatacgagatccgttcgtgtgttcgtcgcccctccaccgtcgtctctcgcacgcaccttatccttgaccgtcacacg

SEQ ID NO: 66589 - DNA, 925 bp, Zea mays
  misc_feature: Ceres CLONE 1539768
  misc_feature: Encodes the peptide sequence at SEQ ID NO. 66590
  misc_feature (13)..(13): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (859)..(859): n is a, c, t, g, unknown, or other
  misc_feature (925)..(925): n is a, c, t, g, unknown, or other
ccattaatttacntatacggaccccnnnnccggccannnnnnacaaagctggagctccccgcggtggcggccgctctagaactagtggatcccccgggctgcaggaattcgtctcacccctagaaaaaatcctgctgggcgtcttcggcctcatctggtccctctacaccgtctacacctccacgctcgacgaggacgacgactccggcctctcgctctgaactcatccgtcgattattcctagctacgactgtatttttggttcagcctgacccgtgagttcgatcgatctatgcatgcgttggtgcagactaagcttaagaccgtggttgtatgcgaccgtcgtagagcagacacagaaggaatgtctctcttcactctctttgcctgctattcccatccggtatattatctctccctatgaccggggggggggggggtgccctctcttccccctttttctgccccccccccttttcgggtggctcgccgggcccggcttttttttcactcgccggtgatcccgggcaaaacaccccgcgcctttttcccccgtatttttgaatccctcattcgccccgaccttgcccctccttatgtcgccgtcttgggtgtcttagtgagtctcaaaaggcggctcccgtggccctgaatgccgcctccgcctccaagtcagagcgtggtctgctctcgtcaatgcgcctaagtgccgatatctcggacacctcttctctcgcatgttcggcgcgctgcgtccgccgcggccctgtgttctggtgcgagattgcgcgcccgcccctctttcttcaccatctactgtctcctaaccgttcgactaagcctctctcatctaccctcnacattggttctctgcctcgctattgcgtaacactctccgttccgctcctcatcgctcttctgcacn

SEQ ID NO: 66590 - protein, 72 aa, Zea mays
  misc_feature: Ceres CLONE 1539768
  misc_feature (4)..(4): Xaa is any aa, unknown, or other
  misc_feature (9)..(9): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
INLXIRTPXPAXXXKAGAPRGGGRSRTSGSPGLQEFVSPLEKILLGVFGLIWSLYTVYTSTLDEDDDSGLSL

SEQ ID NO: 66591 - DNA, 741 bp, Zea mays
  misc_feature: Ceres CLONE 1539775
  misc_feature: Encodes the peptide sequence at SEQ ID NO. 66592
  misc_feature (515)..(515): n is a, c, t, g, unknown, or other
atagctggagctccccgcggtggcggccgctctagaactagtggatcccccgggctgcaggaattcgtctcacccctagaaaaactagaaaaataaactaaaatccagtcaaatttcacctataaaagaaagactactattccttagtaatgtataggaagaaggggtcatcttttttagggataggaaaatctcgtctatacggttcattctatatatatataatatttattttgtttttttagttaggaatttcgcctaaacaaaagaaatacaaaggatcttgggcaagagtatctgatcatatatgtattccaatacggaaggaggattttcaatgcgggatataaaaacatatctctctgtagcacccgtgctaagtactctatggtttggggctttagcaggtttattgatagaaatcaatcgtttattcccagatgctttgtcattcccttttttttaattctagttattcctatgcgagagatagaattcttcgtgacatgacgaanatttcccctttttgaattcttttttagtatatgaagcaaaaaaaaaaaaaaaacgagacgctcgaggtacccaattcgccctatagtgagtcgtattacgcgcgctcacttggccggtcgtttacaacgtcgtgactgggaaaaccctgggcgttccccaacttaatcgcctttgagcacatcccccctttcgccagctggggtaaataaccaagaagccccgcac

SEQ ID NO: 66592 - protein, 52 aa, Zea mays
  misc_feature: Ceres CLONE 1539775
  misc_feature (11)..(47): Pfam Name: PSI_PsaJ Pfam Description: Photosystem I reaction centre subunit IX / PsaJ
MYSNTEGGFSMRDIKTYLSVAPVLSTLWFGALAGLLIEINRLFPDALSFPFF

SEQ ID NO: 66593 - DNA, 808 bp, Zea mays
  misc_feature: Ceres CLONE 1539776
  misc_feature: Encodes the peptide sequence at SEQ ID NO. 66594
  misc_feature (808)..(808): n is a, c, t, g, unknown, or other
gctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggccgcggcggccaaaaagtgacttactgtaccccccccactgggagggggggggccatgcatcattcaatccatgccatcccccaaaatccaggccttacttttcttgggatcttcccatgggaccgccgcgtggtggcctcccccccacgtgggggaagcacgccccgaaggcactcctccagaatcacggccgtgtcttggaaagagaaacgaaacacattgtgctaggcacgctcctcggggaccccccacgctcgccgccatataagggagcgccgataagtaccgccccgcccctcaccgggcgcggtggtaatttgtagccacagcctaggtactagtgggaaaaccgcccgcggccttcatccgacactctccagttcttccgtaggccacccactccccgcctctgatctccgaccggtcgctctcgtagctgcaacgacgccccgtcctccgcattccggcagttggcagagtgtgcgtcgtagccccgcgtn

SEQ ID NO: 66594 - protein, 63 aa, Zea mays; identical to SEQ ID NO: 28299
  misc_feature: Ceres CLONE 1539776

SEQ ID NO: 66595 - DNA, 948 bp, Zea mays
  misc_feature: Ceres CLONE 1539779
  misc_feature (29)..(29): n is a, c, t, g, unknown, or other
  misc_feature (38)..(38): n is a, c, t, g, unknown, or other
  misc_feature (948)..(948): n is a, c, t, g, unknown, or other
gcgtgttggtactcttcttaacacccacntacgtcccnccctataaatatgaaactccccccggtggcggccgctctagactaagtggatcccccgggctgcaggaattcgtctcacccctagaaaaaatagtgtgataccatgcttgtaatttacccttctacctttttatctggcttaatcgtccacttctaacttttaaattgcaattccttgaattcagacttctgtgttgcaatgtgaaccaatttaattgcccccccctgtcaccaatgcaagtgctccccagtccctgcaccttgtgtttaacggaaaatgttatgctaatttctgcccaacttaatggggcggcagtatcacaaccctgtatgtgattacctcatcttcccccacacccggaacttctcaccgtgttgttctaattggcaaacacgcgcgggacagatataactctcctctacaatgatagatctttccccctcctgacgttccgctccacacgcctccctcaaacacccccctatcacttaacactcacactctcatcccttttcgtcttcttcataatacccttcttttcgtctccccatttggggcgcgttctccacttttcgtcgattcctctttcctccatctctccccttaactcccctcctcccctgcacctcctctcccgataacgctctcgatgcctctgactatcgcacctgatagccccctctcctgtccaatacttcgaatctgtcgtactacccagctattcaatcactctctcactatgttgcgctctcttttcattttttccatacttctacccacccaacatccccacttgtctttgacacccaggatgccagtgttattcatgctctcatcacatcttgtcaccaatcaagtgacaacttctcagtactccaatacctcttcaccactccacacatacactcn

SEQ ID NO: 66596 - DNA, 740 bp, Zea mays
  misc_feature: Ceres CLONE 1539781
  misc_feature: Encodes the peptide sequence at SEQ ID NO. 66597
aaagctggagctccccgcggtggcggccgctctagaactagtggatcccccgggctgcaggaattcgtctcacccctagaaaaagaagcaccggtgccaccaggagacgtgcgtgcccgacggcgcgtcgctcgcggcgatgtacctctacggcgacgtgctcgagtccgtggtggagcgggtgccggtggccgacctcgccgccgcggcgcgggtctcgcgggagtgtctccgcgcggtgcgcgccgcgctgcgccgccgcccgctgcggctgccctggctcgtcgtgcacctccagggccgcgggggcctccggtgcgccgcggcgtacgacccgtgctcgggcgcctggctcgccgtgccggcgccgcgccacgccacgccgtcgcacgtccgcctcctgcgcggcgcgcgcggggaccgcgtctgcgcgctctcgctctcggggctcgccgtcgcggccgatccgctcggcacggccggatgcgtcgcgttggatgcccccggggtggggcgcatcaacccggtggtggccgcggtgggcgaccgcgtcgtcccgcctcggcggccgtgccggttggcgctggccgaggggggcaacccccccccgggcgaggtcctctatgatggcgggtggacccccctgccatccgaatgccggaaccgctccgggaaccccgccggcccggagtgggttcttcccgggccgccccctgaccatggggtgtaccttctgggag

SEQ ID NO: 66597 - protein, 200 aa, Zea mays
  misc_feature: Ceres CLONE 1539781
MYLYGDVLESVVERVPVADLAAAARVSRECLRAVRAALRRRPLRLPWLVVHLQGRGGLRCAAAYDPCSGAWLAVPAPRHATPSHVRLLRGARGDRVCALSLSGLAVAADPLGTAGCVALDAPGVGRINPVVAAVGDRVVPPRRPCRLALAEGGNPPPGEVLYDGGWTPLPSECRNRSGNPAGPEWVLPGPPPDHGVYLLG

SEQ ID NO: 66598 - DNA, 777 bp, Zea mays
  misc_feature: Ceres CLONE 1539782
  misc_feature: Encodes the peptide sequence at SEQ ID NO. 66599
tggcggccgctctagaactagtggatcccccgggctgcaggaattcgtctcacccctagaaaaacaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgaccagagcgacaaggggctcttctcgaacatgatgcacggcgttgccggtggtcatgggtactcccaccagggataccctccgcagggctacccaccccaaccagtagcatacccgcctccccccggggcgtatccttcctcccccccccccaagggggggggggcggctttcggccttacccccccctatatagattacccctccatccagagaggcctaatcccccctccgagggggaaaggtccttccccgtagcgaccactctcctgtctcaatccgcccccctccgttcattggccaacgtccctccgccctggctgttcttatctgctttactcctatatcccgcaccgctgccattatgcttattccctgcatttgtgcttcttcgtagatctctcctttctttattatcggcttcccttccctgctctcctgtgatgctttgtttcctacgtctgccgttcaatggcactgattcgccccctcggagtggctcatttcgcgccacgcacgtcctccgagtcctctattggcgcacgtcgttttcctgaggttactcctcaacggccgcc

SEQ ID NO: 66599 - protein, 93 aa, Zea mays
  misc_feature: Ceres CLONE 1539782
MGGGKDKHDQSDKGLFSNMMHGVAGGHGYSHQGYPPQGYPPQPVAYPPPPGAYPSSPPPKGGGAAFGLTPPYIDYPSIQRGLIPPPRGKGPSP

SEQ ID NO: 66600 - DNA, 737 bp, Zea mays
  misc_feature: Ceres CLONE 1539791
  misc_feature: Encodes the peptide sequence at SEQ ID NO. 66601
  misc_feature (689)..(689): n is a, c, t, g, unknown, or other
ggagctccccgcggtggcggccgctctagaactagtggatcccccgggctgcaggaattcgtctcacccctagaaaaagtatcaccatgccagacgcacctaccgtccagcgtccgagacgagacctcaccacaccagcctcgcaatccaaaccatagtttaattagccaggctagcagtagcagctgtggtcgtcctcgcttgcttgcttgctaccagggtttgtgtgagtgtgttagtgagagagaaccatggcgacgcagcggttcacggcggcgctggtggcctgcctcctcctgctcctggcgctgccggcgcgcgggcgcaacatcacggccatcctcgccgggtacaaggagtacaagctatacaaccagtacctgtcggagacgaaggtgtgcgacgagatcaactcgcggcagtcgacgtcgatgtccgtcctggtgctgtccaacgacgccatgacgacgctggcctccgacgccggcgactcgctccccgccatcaagaacgcgctgcgcctccactcggtgctcgactactacgaccgcaagaaggtgaagaagtacggcgacgagagcgcccgcacgctgtaccaggccacgggcgacgccgccagcaccacggggaacgtcaaggtgggtggacaggaggacaagaactacggcttctcggccgccacgccgggncgcaggatctgcaccgtcaccaaggaagtggagacgcaccctttcagg

SEQ ID NO: 66601 - protein, 162 aa, Zea mays
  misc_feature: Ceres CLONE 1539791
MATQRFTAALVACLLLLLALPARGRNITAILAGYKEYKLYNQYLSETKVCDEINSRQSTSMSVLVLSNDAMTTLASDAGDSLPAIKNALRLHSVLDYYDRKKVKKYGDESARTLYQATGDAASTTGNVKVGGQEDKNYGFSAATPGRRICTVTKEVETHPFR

SEQ ID NO: 66602 - DNA, 807 bp, Zea mays
  misc_feature: Ceres CLONE 1539792
  misc_feature: Encodes the peptide sequence at SEQ ID NO. 66603
  misc_feature (20)..(20): n is a, c, t, g, unknown, or other
  misc_feature (33)..(33): n is a, c, t, g, unknown, or other
  misc_feature (38)..(38): n is a, c, t, g, unknown, or other
aaaaccacgtagtgctggcnttagccggccaanaaccnaaaaaaacaaattataaaactggactccacgcggtggcggccgctctataatagtggatcccccgggctgcaggaattcgtctcacccctagaaaaaatcgcagccagcagcctcatccccttgcccacttctaaagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgctctacgaactgacgtccttccggttcaccccccttcaggaatccattcgtgtcccgcgaggatgactcgcccccccccttgacggaaaattgatccacctacgcccgaccctgaacgtcggtcatccgtggggagccgggtttccaccaaggactgatcctggaatcattaacaattcctcttccaaggaaccaccagcccgaggacaccatcgcccaacaccagggaaacaatatccaggaggcccacccggagtccgtccattatcttaagggcccggggttcagcggccatctttatctccttttaatatccaatgggcgggtgtggcacgccaacacccttaaagcacaactctggtgatctcatcagtaaacacaaactcggacttctgacgcgccgcgtcacccaaag

SEQ ID NO: 66603 - protein, 76 aa, Zea mays
  misc_feature: Ceres CLONE 1539792
MATAAASSLLKSSFAGSRLPAATRTTPASLVVATGPRGAGAGPICASMSMSSSNPLYELTSFRFTPLQESIRVPRG

SEQ ID NO: 66604 - DNA, 860 bp, Zea mays
  misc_feature: Ceres CLONE 1539808
  misc_feature: Encodes the peptide sequence at SEQ ID NO. 66605
  misc_feature (1)..(1): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
naatttttaaagttttcgcggcccccctatacgaaatgtacccnnnnnnncaaaacgggagctccccgcggtggcggccgctctagaactagtggatcccccgggctgcaggaattcgtctcacccctagaaaaaaccccatatcccattctccccgacggcgcttctggcagcaaggaacaatatgtccaatagggccacccattggtgttatgcctgtcggcgcccagttcatcttcgtgggcaggatatcatatgtcccaactgcaatgatggctttatccaagaaatcagtgcgatgggtggcgtactgaacacttatggactaattgaaccccgactttgaagagcgccagaccagaagatttggaatgatggatgccatatcttccccttatgacggcaacggcttgggagaaattaggaagagaatagctttgttttgataaaacctgggttacacaaggggacaagggtacttggccccccccacagggacggtcaaacctgtctaattccccaacagcctggataattctgggatgggcaatcccccatttcctcctccgacaaatatggggtcacacacaaggccacggcacaaaaagtttaggaccatttaggggcgaaatgcccccccataaaaactatggtctgcttggcccacgtccccgaacatatcccaccatacccatctaaatttgtatttcggtctcccacatccccgcgaaaccctccccgaattatagataaaaagcgtacataactaacaaagaaaaaccaaccgctgcgtcagggaaaacgatccacacccggggatatctacaccaaggctaggcctaatgtcgaaccacaccaat

SEQ ID NO: 66605 - protein, 53 aa, Zea mays
  misc_feature: Ceres CLONE 1539808
MSNRATHWCYACRRPVHLRGQDIICPNCNDGFIQEISAMGGVLNTYGLIEPRL

SEQ ID NO: 66606 - DNA, 748 bp, Zea mays
  misc_feature: Ceres CLONE 1539810
  misc_feature: Encodes the peptide sequence at SEQ ID NO. 66607
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
aaaaaataaaagggttggtttgtccccagattnacnncgaccannnccccccaaagtgagactccccgcggtggcggccgctctatactagtggatcccccgggctgcaggaattcgtctcacccctagaaaaatgccttggctgcctgcacagtgccgcacagagagcaagcatagcatggccatggcccaagctcgcgtcgttgctctggctctgtgcgccctgctccttgtctccggcgtggcccggagagccgaggctgtctcgtacaacgtcggcaacagcgcggggtgggatctcagcgccgacttgccgtcgtgggccgacggcaaaaccttcaacgtcggcgacgttctagtgttccagtactccagctaccacaccctggacgaagtcgaccaggccgggttcaacaactgcagcgccgccaacgcgctcctgtcgcggagcgacggcaacacgaccgcgccgctgacggcgccccggaaccggtacttcatctgcggcagcccactgccctgcctgggccgggatgaaactgcacgtgcttcgtcagccagccggcgggaaggagctcccggcgaaggccacgccggcaattccccgcccgcaatacaaggcctccggggggccgcccccttgggggccccagcaaaccaaaaaaatgcgagggggcttggacggggacataacccccggggattccggttcccccaggcggggctccccacatccccagactataag

SEQ ID NO: 66607 - protein, 205 aa, Zea mays
  misc_feature: Ceres CLONE 1539810
  misc_feature (54)..(128): Pfam Name: Cu_bind_like Pfam Description: Plastocyanin-like domain
MPWLPAQCRTESKHSMAMAQARVVALALCALLLVSGVARRAEAVSYNVGNSAGWDLSADLPSWADGKTFNVGDVLVFQYSSYHTLDEVDQAGFNNCSAANALLSRSDGNTTAPLTAPRNRYFICGSPLPCLGRDETARASSASRREGAPGEGHAGNSPPAIQGLRGAAPLGAPANQKNARGLGRGHNPRGFRFPQAGLPTSPDYK

SEQ ID NO: 66608 - DNA, 657 bp, Zea mays
  misc_feature: Ceres CLONE 1539813
  misc_feature: Translation starting site: 213
aaagctggagctccccgcggtggcggccgctctagaactagtggatcccccgggctgcaggaattcgtctcacccctagaaaaaagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtgacggtggagctggacgaagggcaacgtgctggtcatcgccgggcgagcgcaccgtgtgccgccaggagcgcagcgacgggtgcccacacatcgagcgcagccgcgccaacttcctcgcccagttcccactgccccgaggacgcccccgtccaaacggggtcaagggccccctttggaaccccggaagggttcacccgtcccccgtggcccaaaggccaggggcccccccccccccccc

SEQ ID NO: 66609 - DNA, 735 bp, Zea mays
  misc_feature: Ceres CLONE 1539819
  misc_feature: Encodes the peptide sequence at SEQ ID NO. 66610
aagctggagctccccgcggtggcggccgctctagaactagtggatcccccgggctgcaggaattcgtctcacccctagaaaaatctcactcctcctctgcgatcctgggcgtaggcggacgccgccccgatccgaatcgccctctgtgctagcatcgccgatccccaactcccctcccctcgattacagatgcaaatctttgtgaacaccctccccggatagactatcaccctctaggtgaagtcatcagacacccttaacaatgtctggggtaagatcaggaacgaggagagcatccctcctgacatgatgcggcttatcatcaccagctcgcagattgagaaccgacgcacacttgctgactaccacgtcctgaaagagtagcccctccgcttggcgctgccccgtaagggaggcctgcacatctgtcgtccgaccttgagtggcaagacaatcacccttgacgtggactcctccgacaccaatgactacgtcaaggcaaatacccacgacaatgacggcatcccacctgatcagatccgtcacctcttttccggcctgcagatgcaggatgggaagacccttgctgactccgacatcagcaagaagagcaccctccacttgacgctgcgtcttaggcgtggtgtgcatatctatgagaacaaccatactggcgataccgtcactcttgatgtgcagtctactgactccattgtctgtgtcaaggcccagatc

SEQ ID NO: 66610 - protein, 57 aa, Zea mays
  misc_feature: Ceres CLONE 1539819
MQDGKTLADSDISKKSTLHLTLRLRRGVHIYENNHTGDTVTLDVQSTDSIVCVKAQI

SEQ ID NO: 66611 - DNA, 764 bp, Zea mays
  misc_feature: Ceres CLONE 1539820
  misc_feature: Encodes the peptide sequence at SEQ ID NO. 66612
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (13)..(13): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (379)..(379): n is a, c, t, g, unknown, or other
  misc_feature (409)..(409): n is a, c, t, g, unknown, or other
  misc_feature (537)..(537): n is a, c, t, g, unknown, or other
  misc_feature (566)..(566): n is a, c, t, g, unknown, or other
  misc_feature (700)..(700): n is a, c, t, g, unknown, or other
  misc_feature (748)..(748): n is a, c, t, g, unknown, or other
nnnnnttaaaaangaaaaccctcctcttttttccnnnnnnncctaannnnaacaaactggagctccccgcggtggcggccgctctagaatagtggatcccccgggctgcaggaattcgtctcacccctagaaaaaagcacactaagttgaggtaacgtgacagggctgacataaaacccaagcacagtagcaggtggaccgcttcagcaaaaccgcgccccaccggttccccgttccccaccccgaccgactgctccccctcccccgcaccagcctcaagggatcgccggcgccgaagcatcgctgaggaagcccgcacccctgcccggatccgatggtctacctgaacctcccgcgggggatcatccaggaaactcancggctgctcagcgagccatcaccggggatnagcgcgtcccccctctgaggagaacgtggggcgagttcaacattattaatcttgggccggcggcagtctcccaatgaagggggaggtcttaaacttgaactctttatacctgaagaataaccaatggnttgtccccaagggtaaaagtttctgagcnaaaattatatcatcccaaccatcaacaaacttttcgaaaagatatttacctcgacaattctcccaagggacctaattggaagaccacacccacttccaaaaatttccacacaacaccctatacaagaaaaaaanacacgggcctccttacaaagaaagagagcagcccctatagtcgcccgntatagcaatcctagtt

SEQ ID NO: 66612 - protein, 30 aa, Zea mays
  misc_feature: Ceres CLONE 1539820
  misc_feature: SWISSPROT Homolog: EC 6.3.2.19 Ubiquitin--protein ligase
  misc_feature (15)..(15): Xaa is any aa, unknown, or other
  misc_feature (25)..(25): Xaa is any aa, unknown, or other
MVYLNLPRGIIQETXRLLSEPSPGXSASPL

SEQ ID NO: 66613 - DNA, 711 bp, Zea mays
  misc_feature: Ceres CLONE 1539822
  misc_feature: Encodes the peptide sequence at SEQ ID NO. 66614
  misc_feature (592)..(592): n is a, c, t, g, unknown, or other
aaagctggagctccccgcggtggcggccgctctagaactagtggatcccccgggctgcaggaattcgtctcacccctagaaaaagagaagacggttcgagtccgttctagaatctagacacggcaatgaagcccaggcctctcggttgcggttgcggttgcgtcccggcggcggtagggtgcgtcggctgggcatggaggccgactccgaggccgcgcgggggagggagggcagcatgggtgtcgcccaagtgctcgcactcggctgcggcggcgggagcggtacagtcggaggaccgccgccgcgaggtgctgtaccgcccggtggagctgcccgggacgggctactggtcggagctggaggcgctgatcgagaaggtcatctacgcctgccgcttcatgaccttcttcggaatttgtggcttgctcctcggatctgtcccatgcttcctcaagggatgcgtcttcgtgatggatgccttcgtcgagtactaccggcacggctgatggaaggtcatcctcctgctgctggaagccatgagatgttttctcatgcaacggtcacgtttgtcttggggacggccttgtacaanctcttcatcagaaacctggactccgtttacgggtactactcttgcggctgatccggcattccggaacggcccagtgggttgaaatcaagtcggtaactgatctcagacaagccttggcc

SEQ ID NO: 66614 - protein, 126 aa, Zea mays
  misc_feature: Ceres CLONE 1539822
MKPRPLGCGCGCVPAAVGCVGWAWRPTPRPRGGGRAAWVSPKCSHSAAAAGAVQSEDRRREVLYRPVELPGTGYWSELEALIEKVIYACRFMTFFGICGLLLGSVPCFLKGCVFVMDAFVEYYRHG

SEQ ID NO: 66615 - DNA, 721 bp, Zea mays
  misc_feature: Ceres CLONE 1539824
  misc_feature: Encodes the peptide sequence at SEQ ID NO. 66616
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
attaataattataaaaaaanaaaaaaannngnnttttntgtattcaatcattaaaaatggtactccccgcggtggcggccgctctagtactagtggatcccccgggctgcaggaattcgtctcacccctagaaaaacccgtttctctctgcttcatccttcgctttcccctgcgccaggcccgccccgcccttccagaacgacatcctccttccccgccccctccgatggggaacccgccggagctgtaccacaagatcctcaacatccccaaggacacctcgccgcacgaaatccgcgccgcgtacaagaacctcgtcaagaagtggcaccccgacaagcacccgccgtcgtccaggccggaggccgaggcgcgcttcaaggccatcagcgaggcctacgaggcgctcctggatcagcaggagaacaggggcgtgttcgagctgtgcaacgacggccgggcgggtgagaggacgcgcggcgccttcggcgacggcggcggtggcggcggcggcggaagaggaggcctcggcgccggcgtccgggcccgcatggaaaggaagcgcagcgacgggttctgcacgaagagcgcgccccggcacgccggcgaggggagttcaagaaggttgtacagctcccggcgacccccggcggggcgccgacgccccttctcccgagattcctccaggcttcccttcgtggcggccaaaggcgccccgccg

SEQ ID NO: 66616 - protein, 165 aa, Zea mays
  misc_feature: Ceres CLONE 1539824
  misc_feature (7)..(72): Pfam Name: DnaJ Pfam Description: DnaJ domain
MGNPPELYHKILNIPKDTSPHEIRAAYKNLVKKWHPDKHPPSSRPEAEARFKAISEAYEALLDQQENRGVFELCNDGRAGERTRGAFGDGGGGGGGGRGGLGAGVRARMERKRSDGFCTKSAPRHAGEGSSRRLYSSRRPPAGRRRPFSRDSSRLPFVAAKGAPP

SEQ ID NO: 66617 - DNA, 796 bp, Zea mays
  misc_feature: Ceres CLONE 1539828
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (239)..(239): n is a, c, t, g, unknown, or other
  misc_feature (242)..(242): n is a, c, t, g, unknown, or other
  misc_feature (299)..(299): n is a, c, t, g, unknown, or other
  misc_feature (372)..(372): n is a, c, t, g, unknown, or other
  misc_feature (390)..(390): n is a, c, t, g, unknown, or other
  misc_feature (412)..(412): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (465)..(465): n is a, c, t, g, unknown, or other
nnnnnnnccccnaaattttnnnnnnnnnnnnnnnnnnnnnnnnnaaaccnnnnacacacctccactccaccccggtggcggccgctctagaactagtggatcccccgggctgcaggaattcgtctcacccctagaaaaagcttgcttcgcttcacctgccccctgcccacattttccttccttccctcccgtcgccgcctgaaaccgcgacatcaagggtcggaggagcaaggacgacnacnagaaggctcggttcggctcttcccagtctctccgagggaggaaggagaggatcgganggtgcgatggcgatcgaccacgagtccccgttcaaggagctcctcctcaagaaccgcaggatcatgggcggcngcttttccttaccctgancccggaggaggaggagaaagtntttttttttttccccccctcccggggggggagaagggggggttnnntcccctncttttctcccccccttcttcccaaaaaaaaaaaaaaaacacctcaacctccacgcgggggggggaagggcattcttgttcctgccctgtgattgctcccacacacgggactccaggtcacgagaactcccaacaccccacgtgcttcccctgtgaccctaggtcgaaagtccccaccctctaatccaccaacaacccatcccgagatcctcgggggcttccccccttaaaatctaatggccatccccggagggtgccctaaatacgcaagacgcattcaatgggaaaattctgcacgggggaaggacgaaaagccaaccgaacccctctag

SEQ ID NO: 66618 - DNA, 762 bp, Zea mays
  misc_feature: Ceres CLONE 1539830
  misc_feature: Encodes the peptide sequence at SEQ ID NO. 66619
  misc_feature (9)..(9): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
aaaaccccnaaaatttttaaccctccttttttctnnnnnnnnnngggggnnnnnnccatactggagctccacgcggtggcggccgctctacaactagtggatccccgggctgcaggattcgtctcacccctagaaaacatcggttgctatggaaagaaaacttgtagtcgagtgggttccttcctgcgacctggaagattcttcagctaaagagacccctgaagcccataaaaaagcatggaaattgctgaagggcgcagatggcgtactcgtccctggagggtttggggacaggggagtccagagcaaaatcctcgccgcgaaatacgcacgcgagaacaacgttccttatcttggcatctgcctgggaatgcaaatcgcggtgatcgagtttgcccgctcggtgatgaatctaccacgtgcccaataggcgcgggagggcgattccctcttctacgtttcccctgtgcccatcttcatggccgaagggctccaaaaaaccccaaattgggagccccacggatggaggcctttgggtccgagggaaggaccctatttttccatggcccgtggggcttgcaaaatcctggccaaagcctgtaaccggcaacctccccgcctcctggtaaaacgaaaagaacttccgccccccagaataccgaaggtggaaacccctgaacattggttcccccagaacttttgacaaaagggcccggtgtctccctgtttcggtgggcgcctaaatactgtcccatggggcct

SEQ ID NO: 66619 - protein, 93 aa, Zea mays
  misc_feature: Ceres CLONE 1539830
  misc_feature: SWISSPROT Homolog: EC 6.3.4.2 CTP synthase
MERKLVVEWVPSCDLEDSSAKETPEAHKKAWKLLKGADGVLVPGGFGDRGVQSKILAAKYARENNVPYLGICLGMQIAVIEFARSVMNLPRAQ

SEQ ID NO: 66620 - DNA, 626 bp, Zea mays
  misc_feature: Ceres CLONE 1539835
  misc_feature: Translation starting site: 150
acagctggagctccccgcggtggcggccgctctagaactagtggatcccccgggctgcaggaattcgtctcacccctagaaaaaacagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttcccccggcgaggaggggggggacaccgcggggctgtcggcggacccggaaaccttccccaagaaccgccagctggaggtgatccactgccgcttggccatgctcggcgcgctcgggtgcgtgtttcccggagctgctcccccgccacggggtcaaattccgcaaggcggggggggttcaggaggggctcccaaatcttccgcgaagggcgggctggaatacccccgcaaccccggccctggtcccaccgcagaagaatcctg

SEQ ID NO: 66621 - DNA, 747 bp, Zea mays
  misc_feature: Ceres CLONE 1539836
  misc_feature: Translation starting site: 162
  misc_feature (297)..(297): n is a, c, t, g, unknown, or other
  misc_feature (311)..(311): n is a, c, t, g, unknown, or other
  misc_feature (395)..(395): n is a, c, t, g, unknown, or other
  misc_feature (747)..(747): n is a, c, t, g, unknown, or other
ctccccgcggtggcggccgctctagaactagtggatcccccgggctgcaggaattcgtctcacccctagaaaaaaatccacgcgaccgcgattgctctcagaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcangaggcggcgtgccnttctcgatccaggcgcccaaggagaagatcgagatgtactcgcccgcccctctatgcgggcgggggggggggaagaatcccccnctgcgggctcacccacttggccgtcccgcctctcgacctcgtcaaggtgcatatgcacattgacccaccgaaattccagaatatctcgtctggattttgggtacccggttaaaggaccaaggggcccaggggtttcctcaggggatgggtgccctactttgcttgggtcacagggctcagggggcgtgccaggtttggcttcctacgaggtctttagaattattccctcgggctattgccggggcctgagtttccctcacattaccatactccttctccccctccgcgggtccccccctctccggaggaatattctgatggtggtccctcgccccctctcaagccgtacacn

SEQ ID NO: 66622 - DNA, 760 bp, Zea mays
  misc_feature: Ceres CLONE 1539842
  misc_feature: Encodes the peptide sequence at SEQ ID NO. 66623
  misc_feature (19)..(19): n is a, c, t, g, unknown, or other
  misc_feature (41)..(41): n is a, c, t, g, unknown, or other
  misc_feature (42)..(42): n is a, c, t, g, unknown, or other
  misc_feature (51)..(51): n is a, c, t, g, unknown, or other
  misc_feature (52)..(52): n is a, c, t, g, unknown, or other
tttttttttttttgtttanttacacttcgaaaaacaaagannggcggggtnncaaaaactgaaactccacgcggtggcggccgctctattatcactggatcccccgggctgcaggaaagcgtctcacccctagaaaaaaggacgacccaagcaagcaagcaagcagcgagtacatacatactaggcagccaggcagccatggcgcccaccgtgatgatggcctcgtcagccaccgccgtcgctccgttccaggggctcaagtccaccgccagcctccccatcgcccgccgctcctccagaagcctcggcaacgtcagcaacggcggaaggatccggtgcatgcaagtgtggccggcctacggcaacaagaagttcgagacgctgtcgtacctgccaccgctgtccacggacgaccttgctgaagcaggtggactacctgctgaccaaacggctggaaaccctgcctcgagttcccccaaggtcggggttcccggaaccagcgagaactccaccctccccggtgccactaacaacgagccgctacatggaaccaagagaaaaaactggcccatgattccggcatgaaaaagacgaccaacccaaaatgaaacaatggagcctgtaaggaaaggtaatccaaaatcccttccgccgggacagaccgttctacaccgagatgccatagggcgccccggcaagacctattaaacgcagacacaccaaatgcactggaaacggtttccatcagcactttaataaa

SEQ ID NO: 66623 - protein, 128 aa, Zea mays
  misc_feature: Ceres CLONE 1539842
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLAEAGGLPADQTAGNPASSSPKVGVPGTSENSTLPGATNNEPLHGTKRKNWPMIPA

SEQ ID NO: 66624 - DNA, 834 bp, Zea mays
  misc_feature: Ceres CLONE 1539843
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
tttttggattttttttcnncnccacctaccacacccccgccattaattattgataaatacagggaattcacgaggaggaggcacgctctattttagcggatcccccgggctgcaggaattcctctcacccctagaaaactttccccaaaccccaaaccgcaggaaggaagcaaaccgcacgccccgctccagaacggatcctcatctctcacgttgtcaccacagtctgaatccagaatccaactagtagctccataaaagcggcaatgtaatcacagctgctgttcatcgtgctggtggcggaggcgtccctgacagcggctctgttcatccagacgccgctgtcggaagctcgacatgataaatgattcaaacggtctcatgctgtgagtcttaaacgaactaacactatagttcaatttattttatccaaccacccggaagaactaaaaaaaaacgcccatgggaacgaatttaaaaacggatttcaaccatttcacattctcacaccaacaatcctttcctccccttacaggaactaaatgtaccacctcccccacattctccggggtataataggaaggcaaatcacgcccgtcttcgctaaacccacttcgctgatcattaataacacagaagaaaataatcacagaattaagcatcatcctaccatctccctcgcccggaggttctccacatataagtggccctctcgcctctctcatgcagattatggacaaccataatccaccatacaccacatacctcttataacaaaaaattaattacccccctccgattcaccagaagaagaaacgcctttttatattatcg

SEQ ID NO: 66625 - DNA, 753 bp, Zea mays
  misc_feature: Ceres CLONE 1539845
  misc_feature: Encodes the peptide sequence at SEQ ID NO. 66626
  misc_feature (1)..(1): n is a, c, t, g, unknown, or other
  misc_feature (2)..(2): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (454)..(454): n is a, c, t, g, unknown, or other
nnttttttcccggggccatcccccnnnnnnnnnnnnnnnnnnnaaacccnnnnccaccaccccgcatccacccgcatgtccgccgttttagaatacgggaacccccgggctgcaagaattcctctcacccctagaaaaaaacgcagccagcagcctcatccctttgcccacttctacagcccctctgctgcagcaagaaggaaagaagcttttgcttataggggggcggccatggccaccgccgccgcgtctagcctcctcaagtcctccttcgcgggctcccggctcccggccgccacgcggaccacaccggcgaccctcgaggtggccaccgggtttccccccggcgggggggggaccatctgcccgtctttgttcctggccacctccaatcagccccaaaaccttttttcttcccccccccggggggggggggggggggggtttttttctnttatttaacccccccctaaataaaaaaaaaaaaaaaactaccccctcatcccggggggcggtttccttgttgcccccctactcccgcgggagctggatctggcgagagacaaactcctgccacagatgcccctcactcattcgccttattcttgcaggtacgcaaccaccctcgcccccccgacattgaactccccgccctcagccgcaaggaactaaactaacgatacatagattagttgccacctgccccggcacgacctgtcgtcacttttaccacagcttccgtacgcggtcaat

SEQ ID NO: 66626 - protein, 76 aa, Zea mays
  misc_feature: Ceres CLONE 1539845
  misc_feature (75)..(75): Xaa is any aa, unknown, or other
MATAAASSLLKSSFAGSRLPAATRTTPATLEVATGFPPGGGGTICPSLFLATSNQPQNLFSSPPRGGGGGGFFSXI

SEQ ID NO: 66627 - DNA, 766 bp, Zea mays
  misc_feature: Ceres CLONE 1539846
  misc_feature: Encodes the peptide sequence at SEQ ID NO. 66628
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
ctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcaaaggcaaagccggcggcaagctccggcacgcccgtgggacggccccaaccgcgtgctctacctgggcccgctgtccggcgccccccccaacctaccttttttttccccccccccgggggggactagaaaggggggnnnnnnnnnnnnttttcnnnnnnaaccccccaaaacgtttccaccaaaaaaacgggggtcccgggggggggggggggtgtcccgctgggtccttggcttggggccccttttgggctccccttgttcccccggagacttgctcggcccgtactgtggttgaccggatctgactaaaaagccttaggcgggctcatgagcctgggtttccggaaactttctgcctgaggtgggggcaggccaccaccacccggcctccgcctggccctgacgcgcatccggaggaaaaccccccccgcctcccagcggggcgttggagttgcgccgcccgcctggcaccctagcttcccattatgcccttccggtgtgtccgctctacgctccc

SEQ ID NO: 66628 - protein, 78 aa, Zea mays
  misc_feature: Ceres CLONE 1539846
MASSTMALSSTAFAGKAVNVPSSLFGEARVTMRKTAAKAKPAASSGTPVGRPQPRALPGPAVRRPPQPTFFFPPPGGD

SEQ ID NO: 66629 - DNA, 801 bp, Zea mays
  misc_feature: Ceres CLONE 1539847
  misc_feature: Encodes the peptide sequence at SEQ ID NO. 66630
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (26)..(26): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnaaaaaaacctccntttnnnnnnnnnngggggggnnnnnaaacatatgagtccccgcggtggcggccgctctaaactagtggatcccccgggctgcaggtattcgtctcacccctagaaaaaggtaccccgctgcttccgtgctcacctcgcctgcagggccgcagccgctggaagaacacgaagacgacgggagtgcggggtggcgtcgccgctggagcaccagctgtagccgccggctaggcctccgcgccgctctccgtggccaacgcgccgtcatgcttgcggcgtcggcgcggcggctgtccgccgccgcctcgtttttcctcttcttccatgagctccagccagctcgccgccctactgaaccaacagaggtggatgcacgacaggattttttatcccaccccatcctggtgaggagagggagggaattgccctcccatgaaggtccaaccccccccttcgaacttacgccaattctccaacctacaaatgcgccttcattccccgccttcttaaaaggcgccgcctaaaggaaataacttttcaatgctcgggcttttggggaaaattttgacctatgggtgtatctccctcatggcccaagggttatttggccctggggcaaaaaaatcgccattttcttaaagtatacacatgcctcccctgggatcgcctctgccccaggggctaactctggagtgccctccctctctcgcctcgatttgaaaaacccctcaccacaattatctggggcccgaatcccaacaattccccacccatacct

SEQ ID NO: 66630 - protein, 85 aa, Zea mays
  misc_feature: Ceres CLONE 1539847
MLAASARRLSAAASFFLFFHELQPARRPTEPTEVDARQDFLSHPILVRRGRELPSHEGPTPPFELTPILQPTNAPSFPAFLKGAA

SEQ ID NO: 66631 - DNA, 747 bp, Zea mays
  misc_feature: Ceres CLONE 1539848
  misc_feature: Encodes the peptide sequence at SEQ ID NO. 66632
  misc_feature (20)..(20): n is a, c, t, g, unknown, or other
  misc_feature (31)..(31): n is a, c, t, g, unknown, or other
tatggaattttttttttttnaaaaacaacanactaacaacgccccaaccacaaacctggactccccgcggtggcggccgctctagactagtggatcccccgggctgcaggaattcgtctcacccctagaaaaagccaggccacacgcacaccaagatatagagattgctggtcgagaagaagagatgttacatatataataactactgtaggcagcggcatctcctgctgggacgaagattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccgacatcatcctcgtcgccgtcggggtgctcatgtacctcggctcctaggcggaggcgcggggcgccatacccttctctctctcgccgagcgcgccatccgttcccttcccttccgttctctctctatatatatacgtctgtatgaattgaatgaactcccatttacacttgtacggttccggtcgtcccatgactttttgcccctaccaaaccaagataaacaaaacgtgagaacgccttccaacggataccccaattttcctcccctatttagaggaaatcccgtg

SEQ ID NO: 66632 - protein, 70 aa, Zea mays
  misc_feature: Ceres CLONE 1539848
MQDWAPVFVSLVLFILLSPGLLFQMPGKCRIIEFGNFQTSAISILVHAILFFALADIILVAVGVLMYLGS

SEQ ID NO: 66633 - DNA, 646 bp, Zea mays
  misc_feature: Ceres CLONE 1539851
  misc_feature: Encodes the peptide sequence at SEQ ID NO. 66634
ggagctccccgcggtggcggccgctctagaactagtggatcccccgggctgcaggaattcgtctcacccctagaaaaaatcgctcgctgagcttccgttgttgcacagcacatcgatcgacgacgatatcgggaagcaatatggggttggccttgtcgcggcgcatggcagcggaagacggcgaggctgacagtccggcaccggcgccagtgccgccgaccggtgctgctgctgcttccggcggcggcactgaaaagaagaagcaggcggacgactcgtcgtcctcgtctaagacgacagaatgggttcctcataagttctctgagatcgtcggtcaaagacgacctgctgaggatatgttccgagggatctaccttccacaatcggatcagcagccgaaaacaacaaagaagtactgggtagatgggagaaatgccaactgcttcatgctgttccctaaaggattcagcatcacctggggttcggacgaaaggtactggagttggcgcaagctcacacaaaaaaaaaaaaaaaaacgagacgctcgaggtacccaattcgccctatagtgagtcgtattacgcgcgctcactggccgtcgttttacaacgtcgtgactgggaaaaccctggcgttacccaactta

SEQ ID NO: 66634 - protein, 142 aa, Zea mays
  misc_feature: Ceres CLONE 1539851
MGLALSRRMAAEDGEADSPAPAPVPPTGAAAASGGGTEKKKQADDSSSSSKTTEWVPHKFSEIVGQRRPAEDMFRGIYLPQSDQQPKTTKKYWVDGRNANCFMLFPKGFSITWGSDERYWSWRKLTQKKKKKRDARGTQFAL

SEQ ID NO: 66635 - DNA, 786 bp, Zea mays
  misc_feature: Ceres CLONE 1539855
  misc_feature: Encodes the peptide sequence at SEQ ID NO. 66636
  misc_feature (786)..(786): n is a, c, t, g, unknown, or other
cccccgggctgcaggaattcgtctcacccctagaaaaatcacattcccaaaccctccgtcgacccctcctcctcgatctacaccggcgatcggcggcgagcgatggggtgggcgacgcggttcctggcggcggtgtgcttctttgctgcgggtgtcctcttcgtccccgagggtctccttggttccccctccggcgcaggagccgtcaccgccgccaagctggcccacgtcctctcctttgccagttcgtggggcgccgccctctgggccacctttatcagcggcattctctttgtttaggaatttttttttcccccccccctccgggggggggggggaggggggatttttccttgccctatttccccccttatctgttgtctccctttttctttaacttcatgcctccgtttgtcgcactgagcagacggtatgaagcaacacgttcctctcgttagcagcggtgtccctggtcttgcaattcacctcgttgcccaatggctccgcgatggggcaccttggtcgcgtctcggcgacggcgtttaccctcccctcgagtattttagcgatggttgaaatacaccacgttcgcagtattaccccccttctcgccccgctttcacatttaaccactctccgaccgctctgcaccttaccagccaaacgtgtcccacatcctgcttcgcgtggccctctgctcggtgttaactcagcctctgcagggtacgcggtacccgagatttcctaccgacttcggggaaagtctgtttcgcgagcgctagcgtn

SEQ ID NO: 66636 - protein, 65 aa, Zea mays
  misc_feature: Ceres CLONE 1539855
MGWATRFLAAVCFFAAGVLFVPEGLLGSPSGAGAVTAAKLAHVLSFASSWGAALWATFISGILFV

SEQ ID NO: 66637 - DNA, 688 bp, Zea mays
  misc_feature: Ceres CLONE 1539861
  misc_feature: Encodes the peptide sequence at SEQ ID NO. 66638
  misc_feature (419)..(419): n is a, c, t, g, unknown, or other
  misc_feature (575)..(575): n is a, c, t, g, unknown, or other
  misc_feature (647)..(647): n is a, c, t, g, unknown, or other
gctcatacatacaggatcccccgggctgcaggaattcccctcacccctagaaaaagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctataaactacaaggggctgcaggacaagaattaagatagttgccatcgatctcgctgaaaggccagcgtggtacattgataaggtccacccagaagggaggggggcttctctagagctcgaacacccacgcgaaaaggagagaagctggaatttgggtaaaatnttttcgacaacaactttcgaagggtccatcgttagaatccccgaagagatcggggccaaggaacccgtttccccttaaggaaactggcacgggattcctttgaccgcttcccaagaaacgcgactttccctccaccgttttattcccaagacgggntaagaaagtagtcctggaagtaagtccataagcctggcctttgcgttcacactttttatatacccccctatnaagcaaaattataaagaagtataccaccttcccttttcttt

SEQ ID NO: 66638 - protein, 59 aa, Zea mays
  misc_feature: Ceres CLONE 1539861
  misc_feature: SWISSPROT Homolog: EC 2.5.1.18 Glutathione transferase
MAAAASASSVKEVLPSPLTSASEPPPLFDGTTRLYVAYLCPFAQRAWIAINYKGLQDKN

SEQ ID NO: 66639 - DNA, 791 bp, Zea mays
  misc_feature: Ceres CLONE 1539862
  misc_feature (8)..(8): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (791)..(791): n is a, c, t, g, unknown, or other
gttttcgngtccgggtggggtcacggcgggggcgccnnnnnnnggctccccnnaagcacccttgtctctcggcggtggcggccgctctagaactagtggatcccccgggctgcaggaattcgtctcacccctagaaaaactctcttccccgcctcggtctcccattctctctcgcctctcccgagtgcgtccccctatcccgcccctctccgcctccgtcgctaggggtccattcccctgggcatccgctgccgccggatcccgcctcgactccgccgcagcttcggcatcagagtcaccggattcggcggtgtttctcgcgtgactccgcttccaccggtgggtggccccaggcggcggtcccctgcatccctccggccttccgtgaatcccgccaaaaggcgaacctcgcttgattcttttcccccccccccgaggagggggggggggggggccccctcgtgcctcccctaggcccccccccgtgtggtgctgtggaatttgttcctccgggggcgagccccgcggacccaagatctacccgcccggaggcctctccgggggtggctgaataaacggcccgtggcttttgtccccctgcttggctgctctccggaccccccccccgcgggctgcccccccgtgccgcctctacagctctctccgcggctgacgcttctcgcgcgccgcctatccccccctttatccttcccggatcgggcggatgagtcccgtgaggggcgggccggcgggttggaggtgtcgccggcgggggttccggtagttgtgtn

SEQ ID NO: 66640 - DNA, 717 bp, Zea mays
  misc_feature: Ceres CLONE 1539863
  misc_feature: Translation starting site: 206
  misc_feature (9)..(9): n is a, c, t, g, unknown, or other
  misc_feature (14)..(14): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gaggtgttnggaancagcccaacacacataaccncnnttttggctnnnnnngcatagctggactccacgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcgggggctgtcggcggacccggagacgttcgccaagaaccgggagctggaggtgatccactcccgctgggccatgctggggcgcgctccgctgcgtcttcccccgagctgctcgcccgcaacggcgtcaaagttcggcgaggccgtgtggttcaaggccggctcccagatcttcagcgagggcgggcttgaactacctcggggaacccaagcctcatccacgcgcaaaagcatccttgctatctgggccctgccagggtcgggcc

SEQ ID NO: 66641 - DNA, 655 bp, Zea mays
  misc_feature: Ceres CLONE 1539866
  misc_feature: Encodes the peptide sequence at SEQ ID NO. 66642
  misc_feature (655)..(655): n is a, c, t, g, unknown, or other
tggagctccccgcggtggcggccgctctagaactagtggatcccccgggctgcaggaattcgtctcacccctagaaaaaaacagccaccgccgtttcttcgtcttcctcgcagcgccggcgcgccatctcggtacgaaggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggccgcggttgatgcgacaaccaagaagatggatgcactgcatgtgggacaaaatgatgaaccaaacgagactctgattaaagaggacaagctgcaaacagcaatcatcccgttggtgcacctcagtccttggtccccgaggaccaccatgatgatgaacccccagctgagggcccttctcagatggacacacccccaccggtgaaaaaaaaaaaaaaaaaaaccgggacccctcgagggtcccccatttcccccttatgaggggggggggtattaacggggcccctcccgggggggccctattttttcccaccccctcgagcatggtgggaaaaaaccccggggggggtttccccccn

SEQ ID NO: 66642 - protein, 68 aa, Zea mays
  misc_feature: Ceres CLONE 1539866
MAAVDATTKKMDALHVGQNDEPNETLIKEDKLQTAIIPLVHLSPWSPRTTMMMNPQLRALLRWTHPHR

SEQ ID NO: 66643 - DNA, 737 bp, Zea mays
  misc_feature: Ceres CLONE 1539867
  misc_feature: Encodes the peptide sequence at SEQ ID NO. 66644
  misc_feature (650)..(650): n is a, c, t, g, unknown, or other
  misc_feature (717)..(717): n is a, c, t, g, unknown, or other
  misc_feature (721)..(721): n is a, c, t, g, unknown, or other
  misc_feature (722)..(722): n is a, c, t, g, unknown, or other
ggagctccccgcggtggcggccgctctagaactagtggatcccccgggctgcaggaattcgtctcacccctagaaaaacgccgctccacctcgccgccgccaaaggccaccacgagatcgccgcgttgctgctggagaacggagcagaggtgaatgctaggaacctttccggcgagacggcgttgatgcaggcgtgccggttcggccactgggaggtggttcagacgctgctggttttcggatgcaacgtgtccaaggtggacagcctgagcggccagacggcgctgcacctggcggcagcgggaggccacgccacgtgcgtgcgcctgctgctggccggcgccggcgccggcaggaacaagctcgtgaacagggcggccagcggcggcgtgacggcgctgcacctggcggcgctgcacgggcacgcggactgcgtgcacctgctggtggacgagtgcgccgacgtcgccgcgccgacgctgccctgcacggcggcccccatggcggccatcggcgccgggagcgcgccgctgcactacgccgccgcgggcggcgaggtcaggtgctgccagatcctcgtggcgcgcggggccgacagggccgccccgccactgcacgggtggatcccggtggacgtggccaggacgtgnggctgccagtggctggagcacgtcctgtcccccgagtctcacctgcgcatccccaggttcccgcccntcgnnctactctcgtcgccg

SEQ ID NO: 66644 - protein, 184 aa, Zea mays
  misc_feature: Ceres CLONE 1539867
  misc_feature (67)..(99): Pfam Name: Ank Pfam Description: Ankyrin repeat
  misc_feature (29)..(62): Pfam Name: Ank Pfam Description: Ankyrin repeat
  misc_feature (155)..(155): Xaa is any aa, unknown, or other
  misc_feature (178)..(178): Xaa is any aa, unknown, or other
  misc_feature (179)..(179): Xaa is any aa, unknown, or other
MQACRFGHWEVVQTLLVFGCNVSKVDSLSGQTALHLAAAGGHATCVRLLLAGAGAGRNKLVNRAASGGVTALHLAALHGHADCVHLLVDECADVAAPTLPCTAAPMAAIGAGSAPLHYAAAGGEVRCCQILVARGADRAAPPLHGWIPVDVARTXGCQWLEHVLSPESHLRIPRFPPXXLLSSP

SEQ ID NO: 66645 - DNA, 771 bp, Zea mays
  misc_feature: Ceres CLONE 1539870
  misc_feature: Encodes the peptide sequence at SEQ ID NO. 66646
  misc_feature (337)..(337): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (418)..(418): n is a, c, t, g, unknown, or other
  misc_feature (419)..(419): n is a, c, t, g, unknown, or other
  misc_feature (467)..(467): n is a, c, t, g, unknown, or other
  misc_feature (471)..(471): n is a, c, t, g, unknown, or other
acacctggagctccccgcggtggcggccgctctagactagtggatttcttgggctgcaggaattcgtctcacccctagaaaaagtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgccgcaggtgaacatcgagggcaacgggtgcgggttggccctgccgccccanccaaccgtgaaagtgtattttccccccccccccgggggaaagaaaggggggannnnaannnnaanntnnttnttncnnccnnacaaaccccaaaaaaaaattcccctcactggggcgggggggctttctntttnaacacccatcttccatcgaacaacggagcgttccccccgcggttccgcgccaggaaaaaaaaaccgcaccccggtagcgccccccaccccgtcctccggggggggcggatcaccccggggcgcccgaggggcccctaccacagcggagacttttcgcgacggacgcggctcgccggcgagcgggggagcctgtcgcccttccagcgccggggtttccgccgggcgccccgagtgcggcacgcacaggtgggcggacgtgacacacgcccccgcgcggttgctatgagccgtcgccgcccc

SEQ ID NO: 66646 - protein, 192 aa, Zea mays
  misc_feature: Ceres CLONE 1539870
  misc_feature (53)..(53): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (81)..(81): Xaa is any aa, unknown, or other
  misc_feature (97)..(97): Xaa is any aa, unknown, or other
  misc_feature (98)..(98): Xaa is any aa, unknown, or other
MDGGYYGGRDQRYSGGYYGGGGIATPGYAPAVPYGMPQVNIEGNGCGLALPPXPTVKVYFPPPPGGKKGGXXXXXXXXXPXKPQKKIPLTGAGGLSXXTPIFHRTTERSPRGSAPGKKNRTPVAPPTPSSGGGGSPRGARGAPTTAETFRDGRGSPASGGACRPSSAGVSAGRPECGTHRWADVTHAPARLL

SEQ ID NO: 66647 - DNA, 635 bp, Zea mays
  misc_feature: Ceres CLONE 1539871
  misc_feature: Encodes the peptide sequence at SEQ ID NO. 66648
  misc_feature (220)..(220): n is a, c, t, g, unknown, or other
  misc_feature (221)..(221): n is a, c, t, g, unknown, or other
  misc_feature (243)..(243): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
ctggagctccccgcggtggcggccgctctagaactagtggatcccccgggctgcaggaattcgtctcacccctagaaaaaagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgnnccccgccgcgcagcgccccagnccttgctcgtctgcaaagccccgaaagcagaagcgcccgcgacaaagcgacgtttgggccccggcgggttgggctcctcgcggggtcagggcgccgcggggccaagtgggtcccgccccccggctaccgaaaaacacccactggtccgaaagcccagggaaaacggagtaatcccgtaaagggggaaaagggttttaaattgttattccctcccaaggggaacccccccaggagggggggtttcccccggggggggggtcccctcttcaaagaaaaatttttcacccccccaagagaagagaagggggccgccccacacactcacacattcnnnncannnnnnnnannnancnnnncacaaaaaaaaaaaaaaaaaaaaaaaaaaaaaaaaa

SEQ ID NO: 66648 - protein, 91 aa, Zea mays
  misc_feature: Ceres CLONE 1539871
  misc_feature (25)..(25): Xaa is any aa, unknown, or other
  misc_feature (33)..(33): Xaa is any aa, unknown, or other
MASTSCCLLHQSTARLGASPRLAAXPRRAAPQXLLVCKAPKAEAPATKRRLGPGGLGSSRGQGAAGPSGSRPPATEKHPLVRKPRENGVIP

SEQ ID NO: 66649 - DNA, 606 bp, Zea mays
  misc_feature: Ceres CLONE 1539873
  misc_feature (135)..(135): n is a, c, t, g, unknown, or other
agtggatcccccgggctgcaggaattcgtctcacccctagaaaaacttctctcctcccttcgcccggtccaccctctcgcggccgccaggagaagccgccgccacagcaggcccgacaaagatgggggggggttnccgtcaagacccaggaagaccaatggcgtactttcaagcgttttcccaagtgaaatttcaagagaggcgtgctggtagacagactacagggcaggataggttgataacccagacaagaacagtacaatacacccaaatcccgatttgttgtggcgattttaccaaccaggacatcatttgcccaattccgtatctgccacgttccccggggggaaattaattccttggctggctgccattttccccgggggaacttggccacaaaaacccccccccaaaaattttgggcttgaacccaatttttggttggcgcccccccacggccctggggcttttcttttttgggccccccccgggttttcccaaaaacccggggttatttggttcccggggtattttaaaggccatatgtttttagggccccccttgtggagagaaactttttctttgtgtatacccccccgcggaagt

SEQ ID NO: 66650 - DNA, 639 bp, Zea mays
  misc_feature: Ceres CLONE 1539875
  misc_feature: SWISSPROT Homolog: EC 3.6.3.44 Xenobiotic-transporting ATPase
  misc_feature (473)..(473): n is a, c, t, g, unknown, or other
cgcggtggcggccgctctagaactagtggatcccccgggctgcaggaattcgtctcacccctagaaaaagaattctggggaccattggtgttatgtcacaagttgcatggccagtttttgctatctttgttccggtgacggtggtctgtttcctatgtcaacgctactacataccgacagcgagagagttggctcgtttatcacaaattcaaagggctccaatcctacatcattttgcacaatcgctagcaggagcatcaagtattagagcatatgcacaaaaagatcgttttagaaaagcaaacattggtcttattgacaaccattccagaccatggttccataacatttcttcaatggagtggctttctttcaggctaaacattctatccaactttgtctttgccttttctttgactctgctagtgagcctccctgaaagttttataaatcccagtattgctggacttgcngttacttatgcattgaacctcaactcacagctggcaatcataaatttggaacatttgcaacacagaaaaacaaatgatatcagtagaaagaataatgcagtactcgaggattcctaccgaggctcctatcatagttaaaccctaccgcccaacaaacaactgggca

SEQ ID NO: 66651 - DNA, 828 bp, Zea mays
  misc_feature: Ceres CLONE 1539878
  misc_feature (17)..(17): n is a, c, t, g, unknown, or other
  misc_feature (51)..(51): n is a, c, t, g, unknown, or other
  misc_feature (620)..(620): n is a, c, t, g, unknown, or other
  misc_feature (640)..(640): n is a, c, t, g, unknown, or other
  misc_feature (749)..(749): n is a, c, t, g, unknown, or other
aaaaaaaaaaaaaaaanaaaaaacaaaaaaaaaaactcaaagttttttttngaagacaaaaataaaaaatggaactccacgcggtggcggccgctctatactagtggatcccccgggctgcaggaattcgtctcacccctagaaaaatcccctcagtcctcagtccctcacacactcactatacactggctctgctgcagcaagaaggaagaagctagcgcctcccctagcttctcgttgtcagcaatggcccaaaccggccggcgtcaagccccctcaagtcttcatttccgggggttcccgggttcccttttggccaaggggaacaaaacaccccgtttttccctggggccgggggcccaacccccgggcgcggggggggggggcccctatcggggggggaaatatttctctccttcccccccaccccccccccccaaaaaaaaagaaggtcttctctccgggtgtccccccccccaaaaaaaaaaacatcctttgggtgcccccccaaaaaaaaaaccccccccctcccttttggaagaaaaaaaatattatttcccccccacaaaaaaaaacaaaaagttgttaatattttgtgggggggcgtgtttcctctaaangtcttttattttcttgtgtnccacaaataatttttttataagaacccccccccccccaggggggggggggtgcgccatataaaaaaaaaaaacactctttcttctccctacccgggaatagcgacatgnccggttggggcgggggaagaaaaattatatatcactctccaccagacgaggggctataacaaacacatccctccccccc

SEQ ID NO: 66652 - DNA, 692 bp, Zea mays
  misc_feature: Ceres CLONE 1539880
  misc_feature: Translation starting site: 288
  misc_feature: SWISSPROT Homolog: EC 4.1.1.39 Ribulose-bisphosphate carboxylase
aagctggagctcaccgcggtggcggccgctctagactagtggatcccccgggctgcaggaattcgtctcacccctagaaaaaataagacgacccaagcaagcaagcaagaagtgagtacatacatactaggcgactcaggttgtcatggcgccctccgcgatgatggcctcatcggacagcgccgaagctccgtaccagaggactgagctcagcgccagattgatcatcgcgggcctctcctaacagaaggctcgtcaacgtctacaacctggcaacgatccggtgcatgcacgtgtgcccagcctacaaggacaccaacctcgataagctgtcacacctgcccgcgcaatcgaacgatcacctggtgaagctggtggactacctgctgggcaacgcctggatacaataactcgagccaacaaagtagatttcctataacgcgataaatcctcctctccgtgctaatacgacagccgctactggaccatatgcaagctgcgcttgttctcgttgcaacaacccaccaattgtgtacaagggagctgcacggaggccattccaatccaaaacccggaccgcgttgtcacccaaggtcatgcggttttcgaaaaactctccaagcaacaactccattggggtggagcattggatttaccaataaaagacccccccggggccagccaaactaaac

SEQ ID NO: 66653 - DNA, 604 bp, Zea mays
  misc_feature: Ceres CLONE 1539886
  misc_feature: Encodes the peptide sequence at SEQ ID NO. 66654
agtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcatctctcttcggcaaggcccgcgtgacgatgctcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcagcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggacgggtcccagatcttcatcgagggagggctggactacctcgggaacccgaccctgatacacgcgcagagcatcctccgccatctgggacctgcccaggtcgt

SEQ ID NO: 66654 - protein, 166 aa, Zea mays
  misc_feature: Ceres CLONE 1539886
  misc_feature (64)..(165): Pfam Name: Chloroa_b-bind Pfam Description: Chlorophyll A-B binding protein
MASSTMALSSTAFAGKAVNVPSSLFGKARVTMLKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKDGSQIFIEGGLDYLGNPTLIHAQSILRHLGPAQV

SEQ ID NO: 66655 - DNA, 629 bp, Zea mays
  misc_feature: Ceres CLONE 1539887
  misc_feature: Encodes the peptide sequence at SEQ ID NO. 66656
  misc_feature (394)..(394): n is a, c, t, g, unknown, or other
gagactctggactccccgcggtggcggccgctctagaatagtggatcccccgggctgcaggaattcgtctcacccctagaaaaaagcctctgcctctgccccccagactaccccctgcctgcaggctcctgcaactgcaatgtcggcgctcgggacgctctccggcggggccgccggtgtctccggcctcatccgcctccgccgtcgggtggcccccgcgctcgcggcgccgtcgcaccacgccgctgggacgttgaactgcgccgccttgcccgatgccgccccgctcgtctggggacgccagctccgcccgtcgctcctcctccccgccacactgctcccgtcgtcgtcgcaggttgtcttcacccccacgccaggggaggggcgggcgaanccgcaagggaaggcaattctgtgggtttccctgaagaaataccccgccctggtcactgggctccttcttcttcaatggggaactccctcaacgtcaaattcaacatccctcaacaagaaaaatctacactaccttcccctatccatactttggggcccttgatccctctaataggggggggtcggaaactggcctccatccgcttggattgttcgtctcccccaaccgaaagccc

SEQ ID NO: 66656 - protein, 138 aa, Zea mays
  misc_feature: Ceres CLONE 1539887
  misc_feature (85)..(85): Xaa is any aa, unknown, or other
MSALGTLSGGAAGVSGLIRLRRRVAPALAAPSHHAAGTLNCAALPDAAPLVWGRQLRPSLLLPATLLPSSSQVVFTPTPGEGRAXPQGKAILWVSLKKYPALVTGLLLLQWGTPSTSNSTSLNKKNLHYLPLSILWGP

SEQ ID NO: 66657 - DNA, 889 bp, Zea mays
  misc_feature: Ceres CLONE 1539890
  misc_feature: Encodes the peptide sequence at SEQ ID NO. 66658
  misc_feature (10)..(10): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (441)..(441): n is a, c, t, g, unknown, or other
  misc_feature (442)..(442): n is a, c, t, g, unknown, or other
  misc_feature (889)..(889): n is a, c, t, g, unknown, or other
tctgtggttntccccttannttnnnnnnnnnnnnggcactnnnnaacgccacggactcaccgcggtggcggccgctctacactagtggatcccccgggctgcaggaattcctctcacccctagaaaaaagcggcatctatagcaaccggtccagcactttcacgctcagctccagcaatggctgcctccaccatggcgatctcctccacggggatggccggcacccccatcaaggtgggctccttcggcaagggccgcatcaccatgcgcaagaccgtgggcaaccccaaggtggcggcgtccggcaccccctggtacggcccctaccccccccaggaggggggccccttctccggatatttcttataacaacttcaagcggagaattggccgggttttttttttttcccccccccccgagggggaagaagggggggcctnnaaaccccctctcccatatctgccccaccctcaaaaaaaaaaaaacaacgacggacccacaggggggggggcgtcgacctattcacattaatttggcggtaaccactgattcactcagaacgccgtccctcggctgtttccatcgttcaagaaggtactgtcgaagaccgcaccgcagtcgtcccgtccgtccctcgccgccacagatcggtgagctcaaacctgtcgaacaacgcgatggcgcgacactttatactaccgtttccagtgtacaagacgatacacccctcccctcatcgaccgagccagaccacgctaacataaccacttccgtggcgtccgcagctgagcgtctatatcgttctacccgccattcacgtcgtgcccaaatgcccccgtcgcgcaagcccccctacatgtcacttacgaactgtgctgcagaccgagn

SEQ ID NO: 66658 - protein, 63 aa, Zea mays
  misc_feature: Ceres CLONE 1539890
MAASTMAISSTGMAGTPIKVGSFGKGRITMRKTVGNPKVAASGTPWYGPYPPQEGGPFSGYFL

SEQ ID NO: 66659 - DNA, 769 bp, Zea mays
  misc_feature: Ceres CLONE 1539894
aaagctggagctccccgcggtggcggccgctctagactagtggatcccccgggctgcaggaattcgtctcacccctagaaaaaactgcacagcagtcccctatttcagtccccatacagagatgtgcccatcgcgaacacacggagaaacacacacacttggctctccgcaccgtgtcccgggtccagtccagagagctcaagagctcctgcagccatggcggttcccctgcttctcctcctgggctgtccgtgttccaaggcccatatgcggcgttcagatgggcacccccggggaggagcgaccggatgatgcggttcccccatcaaccatccccgccggaaagggggccgaatggctcttccccccacacagggggggggggggggaggggaaaggggaaaaaaggggggcccccccccccctgtgttttgggaaggggtaacaatcgagaacgcgccggggggttggacccccccccccgggaactataacgggggtttccccacccgtcttcggggaacagacccccggttttccggggatcgggcgaagtgtgaccctaccggcgcgcggtagtgttatgcccccccggggcgcgtgtgcagagatatgtgggtccgcacgcgtaagtaccgggcggggtgggggcgggggtgggggatacgcgcgcggcggaggggcgcatcgtgtgatgggtcggtgccgctgcgtcagtaggcgcttgtccgcgtccctggcgagacgtgaattgtcgccgccgtcgcga

SEQ ID NO: 66660 - DNA, 667 bp, Zea mays
  misc_feature: Ceres CLONE 1539896
  misc_feature: Encodes the peptide sequence at SEQ ID NO. 66661
gaacagctggagctccccgcggtggcggccgctctagaactagaggatcccccgggctgcaggaattcgtctcacccctagaaaaagctcgcactcactcacacccgcagcgaaagagggagcttgcacgggccaacgcacacacaacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggaacaggacgaccccaacctgggcatcaagatcaacgccaccctcgcgctcgcgctccccaacgcctgcggggccacccgcgccaacgtctcccactgcgctcgtacgtcatcgctttcttcttccttcagccggccagccagtgctagcaaaaccacaaaggccgcccccccgggcccgggagttaccttttctaacagcttcattcctttccccccacaaccaaaaacatgggctgggagaaatttaattttaattttaatttttggg

SEQ ID NO: 66661 - protein, 168 aa, Zea mays
  misc_feature: Ceres CLONE 1539896
  misc_feature (33)..(111): Pfam Name: Tryp_alpha_amyl Pfam Description: Protease inhibitor/seed storage/LTP family
MARWAAVLALAAATAIAVASVAGGDMNADKTECADQLVGLAPCLQYVQGQARAPPPDCCGGLRQVLGKSPKCLCVLVKEQDDPNLGIKINATLALALPNACGATRANVSHCARTSSLSSSFSRPASASKTTKAAPPGPGVTFSNSFIPFPPQPKTWAGRNLILILIFG

SEQ ID NO: 66662 - DNA, 630 bp, Zea mays
  misc_feature: Ceres CLONE 1539898
  misc_feature: Encodes the peptide sequence at SEQ ID NO. 66663
aagctggagctccccgcggtggcggccgctctacaactagtggatcccccgggctgcaggaattcgtctcacccctagaaaaaagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagcccgtggtgctgaacaccaacgtgtgggcccacggcgacggcaagaaggagcaccagttctacctgtggt

SEQ ID NO: 66663 - protein, 140 aa, Zea mays
  misc_feature: Ceres CLONE 1539898
  misc_feature (30)..(140): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MSMDRMARRSVSLLLALALLAAAASADSWLYEKFTTEGNVRADYNAQGQQVTSLILTQQSGGAFSSRQKYLYGEFSIQMRLIPGNSAGTVTSFYLSSGDGPGHDEIDMEFMGNASGQPVVLNTNVWAHGDGKKEHQFYLW

SEQ ID NO: 66664 - DNA, 638 bp, Zea mays
  misc_feature: Ceres CLONE 1539901
  misc_feature: Encodes the peptide sequence at SEQ ID NO. 66665
  misc_feature (638)..(638): n is a, c, t, g, unknown, or other
ggagctccccgcggtggcggccgctctagaactagtggatcccccgggctgcaggaattcgtctcacccctagaaaaatcccgtaatggacacttgcccgtcggtgaagaacatcctcttgctggactcggagggaaagcgcgtccccgtacagtacaacagcgatgactggcctattctatcggctaagctggccttcgacaactccgtatttaccacccgcccggacgcgcatgctggaacggaaattgagattgtcatgtttgaccgccaacttgtggtatgcgagttcatccacgacctgcgcttttttgttactggctgagaacaccagaacgagcttattttagcatccggtcttcgcggattctctgatgctgtccaacaacttctcaagtaattttctctctattacactttatcttttcaaccactgtggtgctctgtgacgcgttggctgccgaaacgctgactagggatgaccgtgtcaccgatcttgctgatcttagaaacgtggctgaacacacgcgcgccctcgagactgtggatatgatcctactgtgactcgatgaacttgctgaatctactgactggcttgagacgaacagtacagacatacctcacgcggtgtctggttn

SEQ ID NO: 66665 - protein, 79 aa, Zea mays
  misc_feature: Ceres CLONE 1539901
MDTCPSVKNILLLDSEGKRVPVQYNSDDWPILSAKLAFDNSVFTTRPDAHAGTEIEIVMFDRQLVVCEFIHDLRFFVTG

SEQ ID NO: 66666 - DNA, 856 bp, Zea mays
  misc_feature: Ceres CLONE 1539907
  misc_feature (856)..(856): n is a, c, t, g, unknown, or other
gggggggggtaccattaaacgacaagcaaccggattcgcttttcttggtctcccgccgcaagggggaggaagaagagggggcgcaaaataataacttttgcatctctcgtgctggaagaattcatctcacccctacaaaaatagatcctcccatcgcttctcccgctcgtcctcctcctctcctcctggacagcagagcacggcacaacacaccgagaaagaacaagcagccgccaccggagctcagaaccaccatcagcagcagcagcacacccggtcaaacttccacacacgcgcgcacacacacatggtgtcgcagcagaggcaacagaacgacggcagctgctgcggcaggcgtccacccctctgagagtttagaggaactaccttgaaaagacatggttgaaataagttggtgcaagggaaaagtaaagaatgatcagaaaaggaagagcggggaattacctggaccgctgaacggaattttgaagtagaagggagtcaatcaccgttaccaaccagttgttctaacgagaaaatagtgtaattccttatcacagccactagaccccagcaatgtgtcagagaaggcaccgacccttactcatgggacatattcttctctctcaattcaatataaacatacccttatgccacgcaaaggtctagcactatagattgctctagaaccacaacacacgcccatccaaaaccagaacggccgcccttcatacttctcgaagctacctaaagagattgtgaaaattttcctgtttgtcggtactttctgtataatgtgacgccctgctcacactacactcccggaaccgaactatttataaataaagaatggttn

SEQ ID NO: 66667 - DNA, 600 bp, Zea mays
  misc_feature: Ceres CLONE 1539909
  misc_feature: Encodes the peptide sequence at SEQ ID NO. 66668
agtggatcccccgggctgcaggaattcgtctcacccctagaaaaatccgctagggttttactccgcagccacaccgcgccgccggagcagcgcgagacccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgtgcgatcggtctccccgagctcctccccgaggagcagccccccgaggaggagatcttcgccgagggcgccgccgacgtctagggaagcgccatccgccgcatccaccacgcgctcctcgaggttcatggccaggagggctaccctcgtctgccccgacaacagaccgctgctttcccatcaacaagggcatcccccaacatgatgctccacaaggacgaggtctgattttgccgtggccagtttcgcccctgacctcttttggctcgcgcacctgcttctacatgggctggtcgcgtaagggaa

SEQ ID NO: 66668 - protein, 84 aa, Zea mays
  misc_feature: Ceres CLONE 1539909
  misc_feature (2)..(79): Pfam Name: Trm112p Pfam Description: Trm112p-like protein
MRLLTHNMLASNVRGATTGYPLTLEATNWCTKEVELNSDFIRGLLPKIDWRALVAATRAIGLPELLPEEQPPEEEIFAEGAADV

SEQ ID NO: 66669 - DNA, 642 bp, Zea mays
  misc_feature: Ceres CLONE 1539910
  misc_feature: Encodes the peptide sequence at SEQ ID NO. 66670
cgcggtggcggccgctctagaactagtggatcccccgggctgcaggaattcgtctcacccctagaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtgggtcaaaggccggctccccaaatcttccacggagggcgggcctggacttacctcgggaaacccgaagcctcattccacgcgcaaaagaatccctttgctatcctggggcctgg

SEQ ID NO: 66670 - protein, 168 aa, Zea mays
  misc_feature: Ceres CLONE 1539910
  misc_feature (65)..(156): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWVKGRLPKSSTEGGPGLTSGNPKPHSTRKRIPLLSWGL

SEQ ID NO: 66671 - DNA, 677 bp, Zea mays
  misc_feature: Ceres CLONE 1539912
  misc_feature: Encodes the peptide sequence at SEQ ID NO. 66672
ataactggagctccccgcggtggcggccgctctagaactagtggatcccccgggctgcaggaattcgtctcacccctagaaaaaagacattcttccccgagtcgccgtcgtctgctccgggctgctgttctgcgcctccacaaggctttggcctctgttgtaagatttaagcttaacctccaaccatgggcaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgctttgacaagctcaaggctgagcgtgagagaggtatcaccattgatattgctctgtggaagtttgagaccaccaagtactactgcactgtcattgatgccccctggacatcgcgacttcatcaagatcatgatcccgggtaccctctcaggctgactgtgcctgtcttatcattggactccccccctggtgggtttttaaggcccggtatctcctaaagaatggccaaaaccccgtggagcatggcctctcccttgctttccccccttggggggtccaaagcaaaattatttggcctgcctgacaccaaagaatg

SEQ ID NO: 66672 - protein, 60 aa, Zea mays
  misc_feature: Ceres CLONE 1539912
MGKEKSHINIVVIGHVDSGKSTTTGHLIYKLGGIDKRVIERFEKEAAEMNKRSFKYAWVL

SEQ ID NO: 66673 - DNA, 731 bp, Zea mays
  misc_feature: Ceres CLONE 1539919
  misc_feature: SWISSPROT Homolog: EC 3.2.2.8 Ribosylpyrimidine nucleosidase
  misc_feature (515)..(515): n is a, c, t, g, unknown, or other
  misc_feature (549)..(549): n is a, c, t, g, unknown, or other
  misc_feature (550)..(550): n is a, c, t, g, unknown, or other
  misc_feature (627)..(627): n is a, c, t, g, unknown, or other
ggagctccccgcggtggcggccgctctagaactagtggatcccccgggctgcaggaattcgtctcacccctagaaaaagtgcttggccagttggccacatgccttgccttgcctttgcctacctgttgatcgagccgagcgagcagggagagacacggcaccgagtgaggccgccgcatcctcctcctctccgatccgtacgtttcctcctccctagcaatcgcaacccgttcagccaatcattgccgtctccaccaactccgttcccctattacctagttagtccagtccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgggaggaaagccgcacgttgctgacttcgttcatggacctgatggcctcgggaacgtagatcttcctgatcccactatncagaaagtggaggaaagtgctaccgacttctggnntgataaggtctcgcgatttcctggagaggtctctgtgctcgccttgggtcctctgacaacatagcattggccatcangaaggatccctcattcgtgaaaaacgttagaagatcgttgtgctgggtggagcgttctttgcggctggaaatgccactccttccgctgaagcaaatatcacagt

SEQ ID NO: 66674 - DNA, 738 bp, Zea mays
  misc_feature: Ceres CLONE 1539921
  misc_feature: Encodes the peptide sequence at SEQ ID NO. 66675
  misc_feature (600)..(600): n is a, c, t, g, unknown, or other
  misc_feature (634)..(634): n is a, c, t, g, unknown, or other
aaagctggagctccccgcggtggcggccgctctagaactagtggatcccccgggctgcaggaattcgtctcacccctagaaaaacatgccagagatgttgaggtcacttagcattatagattgtactattgcggttatggccccaattgatagcttcagggtttgccgtgtgctgcatatagaaaacaactacgtacccatcagcctaaagcatctagggaagctgttgcatctcaagttcctagatatatttaacacgcctattgatgagctccctaaggaaattgggcatctgaggtctcttcagacactggtattagtcgatactggactagatgagctgccactggctgtttgctcgcttacacggctcatgtgtctgatagcctatgggttcgaaaggttgccagctgacaggatggggaacctaacgtccctggaggagctacgactacatagggtagttggccggagtgccacccaagccctagtggcagagcttggcaagctgacgaggttgagggtggtcagaatcaccttttcagagcagctagaggagagctcgcaagaagcattagtgcaatctctgtccaatctgcngttactccaggaactagtgcttttgtttaaatgncacagcggggaaacgatatgtggggagactgggagccaccaagcagctccggccgctgattatgaaagcatcgacttctcacggcagcctcgatggatcacccc

SEQ ID NO: 66675 - protein, 217 aa, Zea mays
  misc_feature: Ceres CLONE 1539921
  misc_feature (172)..(172): Xaa is any aa, unknown, or other
  misc_feature (183)..(183): Xaa is any aa, unknown, or other
MPEMLRSLSIIDCTIAVMAPIDSFRVCRVLHIENNYVPISLKHLGKLLHLKFLDIFNTPIDELPKEIGHLRSLQTLVLVDTGLDELPLAVCSLTRLMCLIAYGFERLPADRMGNLTSLEELRLHRVVGRSATQALVAELGKLTRLRVVRITFSEQLEESSQEALVQSLSNLXLLQELVLLFKXHSGETICGETGSHQAAPAADYESIDFSRQPRWIT

SEQ ID NO: 66676 - DNA, 644 bp, Zea mays
  misc_feature: Ceres CLONE 1539926
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaattgagagctgaacttggtgatagaccatagaagattgtttctctgtttgacaagccacttcgatgaattgaacatatcttctaccagacaaaagcagggaaagctgttgtttaccatgttttttttgttgtaactacctttatgtaatttcctggatcttgcgaagcatggattttccctacaataatgcaaccggttgcactggcaactattcctgatgctacggattcaagcattaccatttaacaatctggtgccagaacttgaaactaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttta

SEQ ID NO: 66677 - DNA, 642 bp, Zea mays
  misc_feature: Ceres CLONE 1539927
  misc_feature: Translation starting site: 146
ggagctccccgcggtggcggccgctctagaactagtggatcccccgggctgcaggaattcgtctcacccctagaaaaaaaaaaaccgagtgcttgatctccctccgccactccatccatctcctcgctcccagtccccgggaagcatggcgtccgtcaccgcccgcgccccggtaacaggccttcgaccgtcgtcggcatcgctcaagtcgtcgtcgggcttacttggtcactctagtcgcctcggatgtgccgtgtcttccacgaggcgcagcctcaaggcggatgccaagggcaagtggctccccggccttccctccccctcctacctcgacggtagcctgacgggtgacaatggattccacccgttgggcctggtcgagagacacccgagaacctgcggtggttcgtgcatgcggatctggtgaaatgactgtgggccatgcttggcgtgtccgagatgctcatcccggatgtgctgaccaaagccgggctgatcaaagcgccgcattggtacgacgccggcaagtcagagtagttcgcgtcgtcctccacgctgttcgtggtcgagttcctcctgttccactgcgagcagatgcgagggtgcctgtgactcttgaaccccggcagcgtccaccaagac

SEQ ID NO: 66678 - DNA, 636 bp, Zea mays
  misc_feature: Ceres CLONE 1539928
  misc_feature: Encodes the peptide sequence at SEQ ID NO. 66679
  misc_feature (636)..(636): n is a, c, t, g, unknown, or other
tggagctccccgcggtggcggccgctctagaactagtggatcccccgggctgcaggaattcgtctcacccctagaaaaaacgcaaaccacagcgaccgaacaaacaacatgtatgatttcacaagccgcccgctgaaaccaaagccttttgccctgtcgtcaggggcgaggtttcatcaacctcagtacctcaccctcctctcccggagagcctctcgcctccgctccgctcctctgccctgcccttccccgccacaccaaccaaggcgccaaaaataaacgccgcctgtcacattgcttgccgcgcctcgtcttcgcggaggcctcgtcgcgcgacgatatggagctcgccgaggcgccggcgcccgtgcccgacgaggacgggctggacgaacgcggcgtggcgctgcacctcccgaggctgctagccggcgtcgtctccggcgccctcactggcctcttcgctctcggtacttgcacttacttgcgcaagctcctttgatcctttcgatgccatgtcctgttgttagctgtcctgagagctcgatcgacgttggctctgtgtggtgcgtgcgtgcatgtgccgcgtacgtccgcgtgtaaagctggagctctgaccggggcagtcaccggcgn

SEQ ID NO: 66679 - protein, 53 aa, Zea mays
  misc_feature: Ceres CLONE 1539928
MELAEAPAPVPDEDGLDERGVALHLPRLLAGVVSGALTGLFALGTCTYLRKLL

SEQ ID NO: 66680 - DNA, 766 bp, Zea mays
  misc_feature: Ceres CLONE 1539945
  misc_feature: Encodes the peptide sequence at SEQ ID NO. 66681
  misc_feature (381)..(381): n is a, c, t, g, unknown, or other
  misc_feature (385)..(385): n is a, c, t, g, unknown, or other
  misc_feature (428)..(428): n is a, c, t, g, unknown, or other
ggcggccgctctagaactagtggatcccccgggctgcaggaattcgtctcacccctagaaaaagctctgctctgctctcctcgcatatagggtttatcttctcccctcctctgcccccatctcgcttctcgcacacggtagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgtgtctgctcgtcgaggcgctcgatccgtagcctgtttttttcccccccccctgggaacaagaccggggacacttcactnaaancctctggaacaaagggtgctagataaaacttggtgccccaggnggagaaggacgttggttgccttttgcttccctcccactgcccaaactaaaccataagggaggcgagggttgttgcttctaggaaccacgacggacctttccgggcacaatataacaacctgtgtggataatagaacactggcaccattcatctatcttactcccaactttggctggtgaatgcagcttaaaattcaatcgaggtcccaagctcttctatttctctaacaaagaacattcttctacggtgatttttctcacgcaccacgataatttcagcgcccttgaaaccctcttcttctaagccgaggacttcttcctcctgctattctttatgat

SEQ ID NO: 66681 - protein, 64 aa, Zea mays
  misc_feature: Ceres CLONE 1539945
  misc_feature (57)..(57): Xaa is any aa, unknown, or other
MSFVQLSGAGVAAVAFTNKSLVSRHAALRVCSSRRSIRSLFFSPPPGNKTGDTSLKXSGTKGAR

SEQ ID NO: 66682 - DNA, 797 bp, Zea mays
  misc_feature: Ceres CLONE 1539953
  misc_feature: Encodes the peptide sequence at SEQ ID NO. 66683
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
nttttnnnnnnnnnggggngggacacaaaacccctccctcttntagcgaccnnnnnaaaacctagaactccacgcggtggcggccgctctaaaatagtggatcccccgggctgcaagaattcgtctcacccctagaaaaactcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcaaaggcaaagccggcggcaagctccggcagcccgtggtacggccccgaaccgcgtgctctacctagggcccgcttagtccggcgcgcccccgagctacctgacgggcctattttcccccccccccacgggggggggggggggggggggctgtcaccccaaacccacaaaacccccccgcccataaaacctgggagttggaagggtcgtgccaccgctccgggtgggggcctaggctaggcgcgccatttggagcttccagggatcccccgggaagttgtttccacaccgacaaacgtgaagtctaagtttcttgtgtaggtcctcttcacgggatctcaaggccggggtgcctgcattaatttttccatgcgaagtggagggcgactgaggagattaccttccgccaaaaatacatattcccagaataaacactcacacacaaaacgtataactcacccccaatatttggagggcgttgatccacagtgc

SEQ ID NO: 66683 - protein, 115 aa, Zea mays
  misc_feature: Ceres CLONE 1539953
MASSTMALSSTAFAGKAVNVPSSLFGEARVTMRKTAAKAKPAASSGSPWYGPEPRALPRARLVRRAPELPDGPIFPPPHGGGGGGGLSPQTHKTPPPIKPGSWKGRATAPGGGLG

SEQ ID NO: 66684 - DNA, 655 bp, Zea mays
  misc_feature: Ceres CLONE 1539954
  misc_feature: Encodes the peptide sequence at SEQ ID NO. 66685
  misc_feature (428)..(428): n is a, c, t, g, unknown, or other
  misc_feature (441)..(441): n is a, c, t, g, unknown, or other
atagctggagctccccgcggtggcggccgctcttcactagtggatcccccgggctgcaggaattcgtctcacccctagaaaaagtaggaataggagcaggagatagcgcgggcggggaggggaaggagacaagtgaactcagagaagaactagcgcggcgggcgagcattgcaagccgagctgcaggggcccggagcggagaccggaggagggagacgtcgcttgcgatgtcaccggcagcatccgccgccgaaaccgccgtcgtcgtcgtcgtcgcaagcgtcccgagccagcagcagagcagccaccgcgccgcggcgccgtccgtcccgtcgtcctacgccgtctgggaaaaagtagcggtaagcggctgcagctttcaacgtcgtcgtcgtcgtctggcacctgcctactgctgctgctggtgnaagggaaggaaanggaaccggaaaggggaaaaggctggaggggaaggcgccaattgcaggggcggcggttcccggaaaaaaggaccccggggattttccgggttgggcccccaaaatcctgggcccgggggtcccccccccccccccaaggggggggggaaaaaatccccgcggggggaacctcccccccggaagggtctccccccccccttgttttgcgccggccc

SEQ ID NO: 66685 - protein, 142 aa, Zea mays
  misc_feature: Ceres CLONE 1539954
  misc_feature (67)..(67): Xaa is any aa, unknown, or other
  misc_feature (72)..(72): Xaa is any aa, unknown, or other
MSPAASAAETAVVVVVASVPSQQQSSHRAAAPSVPSSYAVWEKVAVSGCSFQRRRRRLAPAYCCCWXKGRKXNRKGEKAGGEGANCRGGGSRKKGPRGFSGLGPQNPGPGGPPPPPKGGGKKSPRGEPPPRKGLPPPLFCAG

SEQ ID NO: 66686 - DNA, 660 bp, Zea mays
  misc_feature: Ceres CLONE 1539958
  misc_feature: Translation starting site: 416
aagctggagctccccgcggtggcggccgctctagaactagtggatcccccgggctgcaggaattcgtctcacccctagaaaaattcgtcccccgccgtcgccgctcccagtctctacccggaagcagagcctcgcaccgctcctacccaatggcgccgacgtcgaagctgtcgatggtgcatcaagcgtgcgtctcggtcgcacgcgtaccaccgccgtgggctctgggccatctgaggccaagaacggcggcgtcttccccaaagccgagaaacccgccgccgccgcggaacccaagttctaccccgccgacgacgtctagcctcgcgttcccagcacccgcaagcctaatcccaccaagctcaggtcgagcatcacgcctgggacggtgctgatcctcctcgcggagcgcttcatggggaagagagtggtgttcctcaagcagctcaactccggcctgctcctcgtctctggtccattcaagatcaatggagtaccgatccgtcgtgtcaaccagacctatgtcattgctacatcaaccaaggttgacatctctggtgttgatgtagcgaagtttgatgacaagtactttgccagggagaaaaagcagaacgtgaagaagaccgagggtgagctttttgagacagagaaggaggcgtc

SEQ ID NO: 66687 - DNA, 629 bp, Zea mays
  misc_feature: Ceres CLONE 1539962
  misc_feature: Encodes the peptide sequence at SEQ ID NO. 66688
tggagctccccgcggtggcggccgctctagaactagtggatcccccgggctgcaggaattcgtctcacccctagaaaaaatgtgtgtgctgatatcttgtcataacgagctgtgtgatgccgactggtgtagagctgtatcgctgattgcgtgaaaccgaaatgctgtggctttatttacactgatgttgtcacttccagtccagaaaaaaaaaaaaaaacgagacgctcgaggtacccaattcgccctataacgagtcgtattacgcgcgctcactggccgtcgttttacaacgtcgtgactgggaaaaccctggcgttacccaacttaatcgccttgcagacacatccccctttcgccagctggcgtaatagcgaagaggcccgcaccgatcgcccttcccaacagttgcgcagcctgaatggcgaatggaaattgtaagcgctaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaacaacgtggactccaacgtcaaagggcgaaa

SEQ ID NO: 66688 - protein, 50 aa, Zea mays
  misc_feature: Ceres CLONE 1539962
GAPRGGGRSRTSGSPGLQEFVSPLEKMCVLISCHNELCDADWCRAVSLIA

SEQ ID NO: 66689 - DNA, 635 bp, Zea mays
  misc_feature: Ceres CLONE 1539967
  misc_feature: Encodes the peptide sequence at SEQ ID NO. 66690
aaagctggagctccccgcggtggcggccgctctagaactagtggatcccccgggctgcaggaattcgtctcacccctagaaaacgaccgaagcgccacttgcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagacgacatagaagaggtggggaagaaaggggatacactgaaggtgcgagctggattctaccgcaacttcctccttcccaagggcaaggctacacttctgaccccagaagtcctcaaggaaatgcagctggagcaggagagaatagaagctgaaaagaagcgggtaaaagaagacgcgcaacaacttgctcgagtttttgaaaccattggcgctttcaaactccctcgcaaaggtgaaaaagaaaacagatctttgggagtgtcacggcaccgaatgttgttgacataataaggtcacacttaatagggatgtcgacaagagcctggggacggttccgaaatcccggaaatccga

SEQ ID NO: 66690 - protein, 147 aa, Zea mays
  misc_feature: Ceres CLONE 1539967
  misc_feature (47)..(94): Pfam Name: Ribosomal_L9_N Pfam Description: Ribosomal protein L9, N-terminal domain
MASLSCASTLPWTPASYPRPSAGRCLTASRRAPSLVIVAQGKVKKYRQVILTDDIEEVGKKGDTLKVRAGFYRNFLLPKGKATLLTPEVLKEMQLEQERIEAEKKRVKEDAQQLARVFETIGAFKLPRKGEKENRSLGVSRHRMLLT

SEQ ID NO: 66691 - DNA, 639 bp, Zea mays
  misc_feature: Ceres CLONE 1539969
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaataaatgacaagtggtttcaactaaaccaagcaccacagttggaggtcaaatccttggaagacaatattgtgaagttattgtagcttgtgtgctaaaacgagatacagttttgcctcgccctggagtgatgtcgttgtggtgcttttgtgactgatcatctctggagcttttgtgaatgatctagctagatatctgtaaatgatctagttgtgaatgatattataattgtgatgcttttgtgaatatataattgtggtgcttttgtatttaaaatcacataaaaactccataaaaaaaccttaaaaaaaaataaaatcgacacgctcgaggtacccaattcgccctatagtgagtcgtattacgcgcgctcactggccgtcgttttacaacgccgtgactgggaaaaccctggcgttacccaacttaatcgccttgcagcacatccccctttcgccagctggcgtaatagcgaagaggcccgcaccgatcgcccttcccaacagttgcgcaccctgaatggcaaatggaaattgtaagcgttaatattttgttaaaattcg

SEQ ID NO: 66692 - DNA, 768 bp, Zea mays
  misc_feature: Ceres CLONE 1539970
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (362)..(362): n is a, c, t, g, unknown, or other
  misc_feature (547)..(547): n is a, c, t, g, unknown, or other
  misc_feature (616)..(616): n is a, c, t, g, unknown, or other
  misc_feature (622)..(622): n is a, c, t, g, unknown, or other
  misc_feature (658)..(658): n is a, c, t, g, unknown, or other
  misc_feature (693)..(693): n is a, c, t, g, unknown, or other
nnnnntttttttggtttatttttccttcaaacncaaaggggnnnnnnnnggccacnnnntnnacaacaccggaaaaaccgcggaggcggccgctctagaactagaggatcccccgggctgcaagaattcgtctcacccctagaaaaaacgcccctcccaacactcccagtcccaaacccatttcccttgccttcccctccggctccgcctcctcgaccactccgacaaccccagcgcctccggcgagctccacccctccaccggctgcggcgagaagcggcgggggctaactaagtctgtaagcggcggcggaggtgatccgggagccggagccgagtctagggcgatggggcagcagtcgntgatctacgagttcgtggcgcggggcaccgtggggctggctgagtacacgaaggtttttggggaacttcacccccaggggggggccggggcccggcaaaaactcccccgcccgcgacaaacaagtagaaccaaaaagtggaaatgggcaaaagcgtttgaaactacctccgccgaagaaccggantccacccaatggcgggaactctggcggtaagaaatcaaagtgggagagaaaaaaaacccacaataaagntgtgcnccggacacagtaattacaacctaaaagcccacaccncataaaacaatacgaaaaagagccgcaaacagcgnccatcgccgcgttaacaaccataaaacacgcctcggaaacaccggctagaataaggaatacaaaaacatctaaat

SEQ ID NO: 66693 - DNA, 621 bp, Zea mays
  misc_feature: Ceres CLONE 1539972
  misc_feature: Encodes the peptide sequence at SEQ ID NO. 66694
  misc_feature (393)..(393): n is a, c, t, g, unknown, or other
  misc_feature (394)..(394): n is a, c, t, g, unknown, or other
aaagctggagctccccgcggtggcggccgctctagaactagtggatcccccgggctgcaggaattcgtctcacccctagaaaaatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactcgagggaggggcacnnatatgtcttgaaattgtctgaccactatgcagctgcctactggcctggacttctgtgggctcgccgtgtgctaaaaatccgggttttggataaggatatgagggcaatgttgaggcccctggtgaggacctcctctgtgagccaccgaatgaaaagaaggcctttcctggctcccttggaggttggccttatcaggaataccacagggaaaccgtgttctttggggc

SEQ ID NO: 66694 - protein, 161 aa, Zea mays
  misc_feature: Ceres CLONE 1539972
  misc_feature (27)..(124): Pfam Name: Ribosomal_L18p Pfam Description: Ribosomal L18p/L5e family
  misc_feature (86)..(86): Xaa is any aa, unknown, or other
MGGFVKTHKTNAYFKRFQVKFKRRRAGKTDYRARIRLINQDKNKYNTPKYRFVVRFTNKDITAQIISASIAGDMVLASAYSREGHXYVLKLSDHYAAAYWPGLLWARRVLKIRVLDKDMRAMLRPLVRTSSVSHRMKRRPFLAPLEVGLIRNTTGKPCSLG

SEQ ID NO: 66695 - DNA, 649 bp, Zea mays
  misc_feature: Ceres CLONE 1539973
  misc_feature: Encodes the peptide sequence at SEQ ID NO. 66696
  misc_feature (395)..(395): n is a, c, t, g, unknown, or other
  misc_feature (412)..(412): n is a, c, t, g, unknown, or other
tccccgcggtggcggccgctctattctactggatcccccgggctgcaggaattcctctcacccctagaaaaactggtgatcacaactccacgtcacacacctcacagagctgcagcagcatcagctgccacctcctgcctctcctccttccttcctgcctgcataggttgctacacgtatatattctgaagaagagatcgagatgaccagcgtgtggaagaccaaggttctgcctggcctcaacaagatctttgacaaggatggcaagaaggctgcatctgcacgcttcttgaagtccttcaacaaggaggagtttgacaaggagattgaggacaagaagacagagctggatttttaccccccccccacggggagaaagcagggggctcctgaantcaaagctctcttcaangataaaaaaccagtcaaagtcaccaagatgaactcgggtgcggtcacccagttccctcaagaactggctaaaattgacttccccggaacccaagcggtgaagcaagacgtgccccattccggcacctccccctgcttccccgaaatcaccttacatttggaaaaggcccccccgtttaccccccaggaggaccccatcgacaaatcggcgtgttacccccccctcctgggaaacttc

SEQ ID NO: 66696 - protein, 149 aa, Zea mays
  misc_feature: Ceres CLONE 1539973
  misc_feature (2)..(145): Pfam Name: DREPP Pfam Description: DREPP plasma membrane polypeptide
  misc_feature (65)..(65): Xaa is any aa, unknown, or other
  misc_feature (70)..(70): Xaa is any aa, unknown, or other
MTSVWKTKVLPGLNKIFDKDGKKAASARFLKSFNKEEFDKEIEDKKTELDFYPPPTGRKQGAPEXKALFXDKKPVKVTKMNSGAVTQFPQELAKIDFPGTQAVKQDVPHSGTSPCFPEITLHLEKAPPFTPQEDPIDKSACYPPLLGNF

SEQ ID NO: 66697 - DNA, 1057 bp, Zea mays
  misc_feature: Ceres CLONE 1539974-R
taagggggcgccttctggagggctgttgcatcttttagctaggatataatagataattattcatgtactcaactatgataatgtcgtgtttacattttagctgttggtacatacacacaacatggacatcctaggcctgggatctgaccaaaggtgcagaggtctcactaggattttggagcatgccgccacttctttgaacaatagcaaattctccatttgcagaccatatgcattctgtcagtaagcataaaaaacgatatcaatgttcataaatacatcccatgctaaccaaacatacaaaataatataacgtcaaattctatgctaagattcaccaaaataattggagcgcacaaaggatgaattaaaacaagattaaccaggggtgtaaaaaaatccccaccgctccgagagggtgtacctttggccatggactctgaaaaacataagaaaattgagtcaagtgcatattccttttaccgtggggaaactcctaggaacggacctccattggagccgaatttagttttggatgatccggcaaattttttaataatcgcatacgtccagaaaatctaagggtttgccctttgttgggaattaacatgggggcgagggttattcggtataaagccccaatggggttatacaaaggggcgtggtgcaaaaacctttaccctgggaaccaaacccccgaagttgtcttatagataaaagacccaggcggggaaaggaagaggagaaacctcgggaggtagatccgggtgttcttggccacggaagaaagatttgagtaaattcccctttagcgcaaaatagggggctaaattctttggtataaaaaaccgggcgcgggctgggtttgagcgtataaaccgagccctaaccgagggatcacgttttattactatagcgccaaaccattaattgggggtgtcgctctgcggagagacacatttgtataggtgttgaacctagtgtaaacgattgtggtgcgagcggggagcacctctgcgctcttttcggtggcacaaagaacggggcgcctaatgcg

SEQ ID NO: 66698 - DNA, 906 bp, Zea mays
  misc_feature: Ceres CLONE 1539974-R2
ggaccgggcccgccctcgaggtcgacggtatcgataagcttttttttttttttttttggcgtaagatgcaaggtaaccatctacagaagaactgtttcaaattttacaataagatataatagataattattcatgtactcaactatgataatgtcgtgtttacattttagctgttggtacatacacacaacatggacatcctaggcctgggatctgaccaaaggtgcagaggtctcactaggattttggagcatgccgccacttctttgaacaatagcaaattctccatttgcagaccatatgcattctgtcagtaagcataaaaaacgatatcaatgttcataaatacatcccatgctaaccaaacatacaaaataatagaaggtcaaattctatgctaagattcaccaaaataattggagcgcagaaaggatgaattaaaacaagataaccagggtgtaaaaaaatcctattgttgtggtggtgtaccttgtccatgattctgacaaacatagaaaattgattcaatgcatatccttaacagtggaaactctatgacaactcatggacgatttatttgatatcggcaattttaatatgcatacgtcagaatctagtttgccctctggatacatgggcagtgtatcacaaaacccaattgttaaaagcattgtcaaccttgcaagaacaacccaagtgtataataaacccaccggaatgaagaaaactaaaaataacgggttttgccaaaagaaaaaatttaaatccttatgccaaataaggccaaacctcaataagaaaacatgtccagccggttttacctttaaacaaaccaaccaagcccactttttttattaaggtcccaaaaaaaaaggaccttccttctcgaaagaaaacaatattata

SEQ ID NO: 66699 - DNA, 696 bp, Zea mays
  misc_feature: Ceres CLONE 1539975
  misc_feature: Encodes the peptide sequence at SEQ ID NO. 66700
  misc_feature (404)..(404): n is a, c, t, g, unknown, or other
  misc_feature (405)..(405): n is a, c, t, g, unknown, or other
aaagctggagctccccgcggtggcggccgctctagaactagtggatcccccgggctgcaggaattcgtctcacccctagaaaaaagaggagaaaagcgggggcggcaagcaaccacgggcggagctcggagcgtcctcctcctcccgtctataaattcccctccttttcttcctccatatataggggccatcagatccaagaagagggaagagcaccaaggaccttcggcgcccgttcaggatccacatcttcccgagcgagttcttggttgacctcttcctcttcggaccacctccaaggctcttggggtagcttgccactctcaccaattcagttttcatgtctgatctcgacattcagatcctaactgcccttccatccggtgggggggggccgatgcttnngaactcttggtgcggcccccgggtccaaaggattacttacccttgcgcatccagcagcggaatggtccccaaaaaccttgctaccggccccggggattgaaaaaagggtttccccctcccgccagattcctcaaaaatctcacaaaaaaacttcttctttcaaagggacacgggggtcccgggaccccaaaaattttgaaccgggcctttttcctcccccggggggaatacaaaagaaaaaaaacctcccctaaaatttctccccccccacgagcccgcgctttttcagaa

SEQ ID NO: 66700 - protein, 54 aa, Zea mays
  misc_feature: Ceres CLONE 1539975
  misc_feature (22)..(22): Xaa is any aa, unknown, or other
MSDLDIQILTALPSGGGGPMLXNSWCGPRVQRITYPCASSSGMVPKNLATGPGD

SEQ ID NO: 66701 - DNA, 678 bp, Zea mays
  misc_feature: Ceres CLONE 1539976
  misc_feature (392)..(392): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (414)..(414): n is a, c, t, g, unknown, or other
  misc_feature (415)..(415): n is a, c, t, g, unknown, or other
  misc_feature (421)..(421): n is a, c, t, g, unknown, or other
  misc_feature (424)..(424): n is a, c, t, g, unknown, or other
  misc_feature (425)..(425): n is a, c, t, g, unknown, or other
  misc_feature (445)..(445): n is a, c, t, g, unknown, or other
aaagctggagctccccgcggtggcggccgctctagaactagtggatcccccgggctgcaggaattcgtctcacccctagaaaaaaaactgcggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcaggttcagctccagccctcgaggcaagcaaggtgccgacaggtttctgtggttcgcgtccaagcagtccctcttctattttttcccaccctccccggggaacgaaangggnnannnnttnnnnntcttnnaacccnaannccaccaaaaaatcaatcaancccaattgggggggggggggggaggggatcaccgcccgctaccccctgctgggcgcgggggggcccctcccccccgaaaatctccgcacaaatgggcttcctccccccccggaaacccgcttggccgggggttcaaaacgggcgtcctcccccccccgccgggacacctacaactccctgggccctatctccccacacccccccttgatttttccaaaagggccgcccccagg

SEQ ID NO: 66702 - DNA, 642 bp, Zea mays
  misc_feature: Ceres CLONE 1539977
  misc_feature: Encodes the peptide sequence at SEQ ID NO. 66703
  misc_feature (560)..(560): n is a, c, t, g, unknown, or other
  misc_feature (561)..(561): n is a, c, t, g, unknown, or other
  misc_feature (572)..(572): n is a, c, t, g, unknown, or other
  misc_feature (593)..(593): n is a, c, t, g, unknown, or other
ggagctccccgcggtggcggccgctctagaactagtggatcccccgggctgcaggaattcgtctcacccctagaaaaccgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctaccgtggcnngcgcggctacngtggtgggtgggcgcgctacngcggtgggcaccgtgggcgcggctacggcaactccgacgggaactggag

SEQ ID NO: 66703 - protein, 154 aa, Zea mays
  misc_feature: Ceres CLONE 1539977
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature (128)..(128): Xaa is any aa, unknown, or other
  misc_feature (132)..(132): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYRGXRGYXGGWARYXGGHRGRGYGNSDGNW

SEQ ID NO: 66704 - DNA, 889 bp, Zea mays
  misc_feature: Ceres CLONE 1539980
  misc_feature: Encodes the peptide sequence at SEQ ID NO. 66705
agcaaaggcagctacctgctcaccgtcctattgtctctgcccccacctaccgtgtgcacgtaccagcagggatgttgaacagcggatcatgcttggccggcggacatgacggcaataacgaccagccgaacggagacggtggtggccagcagtatgaagggaccggcggcaagaagcagctcgagtcctcgaggctcaagaagagcagcggcaacaaagataaagccgccgccgcagaggacgactaccccaaccccaagtactgcaccaacaacaccagcggtggtaccagcgtagccggcgcgccctactgcgtcggcgtcggcgtcggcgtcggcggaggcggatacgggaacagctctccctgcggcggcggtggcgacggcgacagctatggcaacagctgtccctacggcaccggcggcaacgcaccatacaacaacgctcccgccgccttctgggctccccaggacggcgccaggtcgccgttgtacatcaatacccaggcggtgcacgtgtacggcatgccttgtgtgtccaacaacgataacaacaacgacgacgacaagaggacgaagagaggcgacgggttcttcggcccggtgttccatgccgccggccacttcttagatcgaaagttcggcttcgacggcagggactgatgactgatccatatgtagacatggccgacgtgccatctatatatgatcatatatgtttaatttgcttcaccctagccgtctccacatgtagacatctatatatgatcatatatgtttaactagctgaatgcccgtgcgttgcaacggaaatatataataccagtatactgcgataacttatatacaaaatgtgtgttatattgttatgagaaaaaaaaaaaaaaaaa

SEQ ID NO: 66705 - protein, 196 aa, Zea mays
  misc_feature: Ceres CLONE 1539980
MLNSGSCLAGGHDGNNDQPNGDGGGQQYEGTGGKKQLESSRLKKSSGNKDKAAAAEDDYPNPKYCTNNTSGGTSVAGAPYCVGVGVGVGGGGYGNSSPCGGGGDGDSYGNSCPYGTGGNAPYNNAPAAFWAPQDGARSPLYINTQAVHVYGMPCVSNNDNNNDDDKRTKRGDGFFGPVFHAAGHFLDRKFGFDGRD

SEQ ID NO: 66706 - DNA, 644 bp, Zea mays
  misc_feature: Ceres CLONE 1539981
  misc_feature: Encodes the peptide sequence at SEQ ID NO. 66707
aaagctggagctccccgcggtggcggccgctctagaactagtggatcccccgggctgcaggaattcgtctcacccctagaaaaagtgcaagtgcatgcagtcgtccatcacatcgatcgactggacacactgacaggatcacaagagtgacagcaagcgccgcccgcaatggcctccgcctcgcgcctcgtgtccttcgccgcgctctgcctgtgcctgggggcggcgctccaggcggcccggggcgccgacgcggccgcccgcgccttcttcgtcttcggcgactccctcgtcgacaacggcaacaacaactacctgctcacggaggcgcgcgccgactcgccgccctacggcatcgacacgcccgaccaccgcgccacgggccggttcagcaacggcaagaacgtgccggacatcatcagtgagcacctcggcgcggagcccgtgctgccgtacctgagcccggagctcgacggcgacaagatgctcgtcggcgccaacttcgcgtccgccggcgtcggcatcctcaacgacaccggaatccagttcgccaacatcatccatatctccaagcagctgcgctacttcgagcagtaccagaagcgcctggccgcgctgatcggcccggaagcgcgggcgcagag

SEQ ID NO: 66707 - protein, 158 aa, Zea mays
  misc_feature: Ceres CLONE 1539981
  misc_feature: SWISSPROT Homolog: EC 3.2.1.51 Alpha-L-fucosidase
MASASRLVSFAALCLCLGAALQAARGADAAARAFFVFGDSLVDNGNNNYLLTEARADSPPYGIDTPDHRATGRFSNGKNVPDIISEHLGAEPVLPYLSPELDGDKMLVGANFASAGVGILNDTGIQFANIIHISKQLRYFEQYQKRLAALIGPEARAQ

SEQ ID NO: 66708 - DNA, 610 bp, Zea mays
  misc_feature: Ceres CLONE 1539993
aaaactggagctccccgcggtggcggccgctctagaactagtggatcccccgggctgcaggaattcgtctcacccctagaaaaaggtgcagcgacaagtcccatttctcaaatcatcaaactgtgatacttttgtttgtaaccttgctgtactaagttttgtagccggatggtttgggagcatggtccggtcttctatggattgttccatgcttctgaactgcatgtctatgttttgtgctactttggttgtttatgcctaatcatgcatatagattccaaaaaaaaaaaaaaaaacgagacgctcgaggtacccaaatcgccctatagtgagtcgtattacgcgcgctcactggccgtcgttttacaacgtcctgactgggaaaacccctggcgttacccaatttaatcccccttgaagaaaatccccctttttcccagctgggcttaataacaaaaaaggccccaaccgaatgccctttcccaaaatttgcccacccccgaatgggcaaaatggaaattttaaacccttaataattttgtgaaaaattcccggttaaaatttttgtataaacacaccctcttttttataaaccaaaaaaggccaaaaa

SEQ ID NO: 66709 - DNA, 758 bp, Zea mays
  misc_feature: Ceres CLONE 1539995
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnnnnnnaatagggggggggaaaacgtagaaaatagaaggagnnnnntttncnnnttcatactgtgactccccgtagtggcggccgctctagaactagtggatcccccgggctgcaggaattcgtctcacccctagaaaaaaacgcagggctgggaaacttcctggagataccgcatctgtactgaaagcttggtggcaagctcattcgaagtggccgtacccaactgaagacgacaaggccagactggtgcaggaaacggggttgcagctaaagcagatcaacaactggttcattaaccaacgcaaacggaactggcacagcaacccaacatcctcggctgaaaagaccaagaagaaaaggtatcacaatgaaaactgctttggtgttgcctaaggcgtaagcccagacaggcttgcctgcggcttgcaacaattatttttttttgtactactgtttttcacacgtggaaactgggaaacgttgccggtgaagaatggccccagagcaaatcttggcccaaaaaaaaaaaaaaaaaccgaaacccctccgaggtacccccaattccgcccctataagtgaagtccttattaacccccccctcccttgggccgatctttttttacaaccttccttgaactggggaaaaaacccctgggccatttacccaaactttaatcgagctattgaaagaaacaatccccccctattccccccaacgtgaggcgaaaattgcccgaaaaaaaggcgcccccaacc

SEQ ID NO: 66710 - DNA, 719 bp, Zea mays
  misc_feature: Ceres CLONE 1540010
  misc_feature: Encodes the peptide sequence at SEQ ID NO. 66711
  misc_feature (535)..(535): n is a, c, t, g, unknown, or other
  misc_feature (588)..(588): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (661)..(661): n is a, c, t, g, unknown, or other
  misc_feature (717)..(717): n is a, c, t, g, unknown, or other
aaagctgggagctccccgcggtggcggccgctctagaactagtggatcccccgggctgcaggaattcgtctcacccctagaaaaaagcaccaacgagcacctccaagccaaagcaagttgctaggtcctttgaaccagcaactgaagcttcctcgtctcatcatcgagaccagtaagcaacatggcggctaatctcaagtgggctcctgttctagccctcctcgtcgtcgttgctgccatggttggcaccaccaccgccggcaacatcgcagtgtactggggccagaatttctccccaaggcagggtggggggacgccctgcactccggtctctacgcctacgtcgacatcgcgtttcctcacaacttttctccccccccaccgcggggggggggggagggtccgcccgaacctgccaacccccggcctccggcaacctggccccgcgaacaaaccccacaaaacaccccgcgcggcgcgagccggcctgcgccaatacagggggcatccctcttccatccacacgaccccccgngggaggcgcttgggtaggggttttatacttgcaccattgccctccatccccgngccgcgaatacctggggggccagcagtagcctggtgaggnnnagtcgggcgcggctcccggcgccaaaagggncccccggtgggtgtcgtggcccgcacaggcgccgcgcagcaccgactcacccgcantt

SEQ ID NO: 66711 - protein, 147 aa, Zea mays
  misc_feature: Ceres CLONE 1540010
  misc_feature (136)..(136): Xaa is any aa, unknown, or other
MAANLKWAPVLALLVVVAAMVGTTTAGNIAVYWGQNFSPRQGGGTPCTPVSTPTSTSRFLTTFLPPHRGGGGRVRPNLPTPGLRQPGPANKPHKTPRAARAGLRQYRGHPSSIHTTPRGRRLGRGFILAPLPSIPXPRIPGGPAVAW

SEQ ID NO: 66712 - DNA, 644 bp, Zea mays
  misc_feature: Ceres CLONE 1540013
  misc_feature: Encodes the peptide sequence at SEQ ID NO. 66713
  misc_feature (644)..(644): n is a, c, t, g, unknown, or other
tccccgcggtggcggccgctctagaactagtggatcccccgggctgcaggaattcgtctcacccctagaaaaaactccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtacgcatatatacactacactccgatcctatgtgcgacgcaagcatgcacccaccccacctggactggacggagacggcgggcgtgacgacgagcaaagactctaacggactgtccccttgatttgatcccaggtcgcggctctcgagacggagctgcagcggatgggcgaggagaaccggcgcctggcggaagcgctggccgaggtggcctccaagtacgaagcgctgcgggggcagtacacggagaatgtgggccgcgcggccacggcctgcgn

SEQ ID NO: 66713 - protein, 95 aa, Zea mays
  misc_feature: Ceres CLONE 1540013
MDPWISSQPSLSLDLRVGLPPLSLHHQAPVAVALPRPKLLVEENFLLPPPKKEPEVRIYTLHSDPMCDASMHPPHLDWTETAGVTTSKDSNGLSP

SEQ ID NO: 66714 - DNA, 718 bp, Zea mays
  misc_feature: Ceres CLONE 1540028
  misc_feature: SWISSPROT Homolog: EC 4.1.1.39 Ribulose-bisphosphate carboxylase
  misc_feature (1)..(1): n is a, c, t, g, unknown, or other
  misc_feature (9)..(9): n is a, c, t, g, unknown, or other
  misc_feature (22)..(22): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
ngggggtgngggggggggttanattaattgtgaaagaaggactattcttcnnnnnnnnnnnccataactggagctccccgcggtggcggccgctctagaactagtggatcccccgggctgcaggaattcgtctcacccctagaaaaagaaaatccgacatccttggagatgattccgtattacaatttggtgagacgaactttgaggtagctccttggggaattgcgcctggtgcagcagcataatacgtgtggatttttaagcctgtggacatgctcgtaaggaagggcgcgatcttgctcggggaggttatgaaattatgaaagcagcttgctgatggagtgctgaactagccgcagcttgtgaattattggaaggagatcaaatttgatggtttcgaagcgatggataccatataaaatacgaaaaaaataaaagccgagacgctcgaggtacccaattcgccctatagtgagtcaccccccacgcgctcactggccgtcgtcttacaacgtcctgactgggaaaaaccctaggcgttacccaatttaatcgccttgtcgccaatcgcccttttacccagatgagcgcagtagccgaaaaggccctcccacatattgccccttccccaaaaagtgtgcgcaagcccttgtctgtggcgaaatggaaaattttgtagatgcaaacaactacgctttgcaaaaaaatttcccgagtg

SEQ ID NO: 66715 - DNA, 575 bp, Zea mays
  misc_feature: Ceres CLONE 1540030
  misc_feature (331)..(331): n is a, c, t, g, unknown, or other
ggagctccccgcggtggcggccgctctagaactagtggatcccccgggctgcaggaattcgtctcacccctagaaaaaggcacagtcacatactttccgcgcctcttcttctgcgcccctctcctcccaaactgcggatagagcagcagaggcagcgacacgatcgcgagcgcacgcacgtaagcacgttgtcggaagctcaagttagaagaagcaccagtgcctgatcgatggcggcccaggctctcctctcggccggcagctgctgggccgccccgtgcagtcggccgtctctaggtcgtcggcgaagaagcgcccctcgtcgtcaggnccagctccaggccctcagccaagcaagggtggcgaacaggcagctgtggtttcgccgtcaagcagtccctctccctacctcaatggaacgcttgcccggggacatatggctttcgaccccctgggccctttccgaaccccaagggcacccgggggctttattccaaccccaaatgggtgggcccacccgcgaaggggataaaaagggcccctaaccccttttgttggggccccgggggggcccc

SEQ ID NO: 66716 - DNA, 721 bp, Zea mays
  misc_feature: Ceres CLONE 1540035
  misc_feature: Encodes the peptide sequence at SEQ ID NO. 66717
  misc_feature (13)..(13): n is a, c, t, g, unknown, or other
  misc_feature (37)..(37): n is a, c, t, g, unknown, or other
  misc_feature (55)..(55): n is a, c, t, g, unknown, or other
ttttctttctttngggggggggggggtgtaaggatcnctttcacacacacacctntcaatactggaactcaccgcggtggcggccgctctacactagtggatcccccgggctgcaggaattcgtctcacccctagaaaaaatccatcaggcatccaataagctcaaagcaagcagatctaagctccaggcagcgtcgcgacagagtgagtgagtagcacgacaacaacaatggcttccctgaaggccgcgaagcccagcggagttgcggcgcaaggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttcccatgcatgagtgaatccccgccatgttatgaatccagtcccttcctttcttgtatcttccatgtgacgcggcgtgtggcgtccccctcttgtgtgatgatgcccgaatgaatacttccaattaagaacgttgttgggaaccgagtggccaaaaaaaaaaaaaaaaaccgagaccgcctggaggtaaccccaattccgccccaataggggaagcccttattaacgcagccgccccccctggagcggtgagattttaaaaaaccgtccg

SEQ ID NO: 66717 - protein, 63 aa, Zea mays; identical to SEQ ID NO: 28299
  misc_feature: Ceres CLONE 1540035

SEQ ID NO: 66718 - DNA, 752 bp, Zea mays
  misc_feature: Ceres CLONE 1540036
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (60)..(60): n is a, c, t, g, unknown, or other
  misc_feature (65)..(65): n is a, c, t, g, unknown, or other
tttttttttttttttttgtnaaaacgaacggtggggacaaccccnnnnnnngggnngngnaatanttgaaatctccgcgggggcggccgctctagaatagtggatcccccgggctgcaggaattcgtctcacccctagaaaaaccaataacaaccttcttcgtcaactataaagcttcaattgaagaaaagtgcctccatcttaagtttggttgactactataggacatgcagccttgtggtagctatagtagtagtagatatttatagttgctctagatttgaagttataggattatttttaattatgtttaatgtttaataatttgagttgaagttataagattttgctttgaattttaagttaaaggatttgagatatatgggtttggagttatattgattatttggatggatgggaaaatttgtggtccacaaaattcatgtgaatattttgggctaaagaagtggtaattattctatccacaaatatcaaattccaaaaaaaaaaaaaaaaaaacgaagaccgcctcgaggtaaccccaaattcgcccctaatactggaaacgttaattaaaacgagactccaactgggcccgtacgtttttttcaaaacgaacattggatgggggaaaaaaacccctggggatttacccccatcttaaattcccccgatgacaaaaataatctcccccctcttcccccaacctggggcttaattatatccagaaaaagagcccccacaagccacac

SEQ ID NO: 66719 - DNA, 722 bp, Zea mays
  misc_feature: Ceres CLONE 1540040
  misc_feature: Encodes the peptide sequence at SEQ ID NO. 66720
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttttttttttctnttttttattagcatanngggggnnnnnnnnnnnnccatactggagctccccgcggtggcggccgctctagactagtggatcccccgggctgcaggaattcgtctcacccctagaaaaacctcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttcctcgagcaactatgtgtttgcatgttgggctacttccaaacctaatatctgggttttggtttgggaattgtgattgaactaaagggcttctttgaaatttataattaatgaatgtttgaacaaaatttgggtggaaaaaaaaaaaaaaaaaaaaacca

SEQ ID NO: 66720 - protein, 86 aa, Zea mays; identical to SEQ ID NO: 44315
  misc_feature: Ceres CLONE 1540040
  misc_feature (30)..(84): Pfam Name: Ribosomal_S27e Pfam Description: Ribosomal protein S27

SEQ ID NO: 66721 - DNA, 815 bp, Zea mays
  misc_feature: Ceres CLONE 1540051
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
nnnnnnnnnnaataaaatagggattaactataaagggatgtatacaacccccccccataactggactccccgcggtggcggccgctctttaatagtggatcccccgggctgcaggaattcgtctcacccctagaaaaaacctatatctttgtataaaaatgttgcctttgctaaaacaatgagttcagactgcaccagtttagaagtttcagaactggcatcagaaacaagttctgaaatttttttggtcattggctggtacgatatcagagttgaatttgtgcgatcgcccgaaaatttctgaaaaaaatacatgaccttgttcttgtctggaaccctcacataaaaaaaaaacggacacgctccgaggtaacccaattcacccctatactcgagcacttattaccgcgccgcttcactgggccgtaaggttttaaccaactcccatgaactgggtaaaaacccctagacattttccccaacctttaattctctctttcgcaagcaacattccccccctctttccgcccgaattttggggctgaatttaatcccgaaagaaagatccccagaaaccctatatatgccccttctttccgaaacaagtttggccccccatcccttgatattgagcccaaattggtaacaatttgtgaaaggggtgtacatctttttttcgctcaaaaactagccccacaaccaactcttcttcgtctacaaatctgtgtttaatttttttttacacccaaattcacacccaaaacatctccgaccaaaaacccccctaattagattccaaaacgcaattgactccg

SEQ ID NO: 66722 - DNA, 713 bp, Zea mays
  misc_feature: Ceres CLONE 1540055
  misc_feature: Encodes the peptide sequence at SEQ ID NO. 66723
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
nnnnnnnnnncccctaaccctattctacaccgcgcgcgcaaacatataacaaataataataaaactggagctccccgcggaggcggccgctctagaactagtggatcccccgggctgcaggaattcgtctcacccctagaaaaaaaaccaagaacaaaccattgttggacgcgttcccctcctgcacgcaacctcatctcgtcctccagatccaggatggccgtcctccttgagaccttgcctccccgagtagctctcggtgagctactttgtttcgatttatcaggaaatccgtttgcttcatgttgtgcaagctcatatctgattgctggattcggcaaacccgcgttggatcctgtatcggttagtccttgcctgcaagagttcttgttgttttgttttggtggtcgagcatcgcatgttctgcttctggatccagatctggagaaatcgcgaagtcgtcgtcgttcggttcggagcggatctgaggcgacgatagatggaggcggcgggatcttctcggtctgcagtcctgctccacctcgatggatgatgtctctgccctgaaaattattggatcaatttcgaaaaattattactaagatctatgagaatatcccgccctgcgaagaggcgaaaggtaaacctcgcagccttgttaaaaaaaaaaaaaaaaaaaaacgaagacggcccccaggggtacccccaatttc

SEQ ID NO: 66723 - protein, 116 aa, Zea mays
  misc_feature: Ceres CLONE 1540055
MAVLLETLPPRVALGELLCFDLSGNPFASCCASSYLIAGFGKPALDPVSVSPCLQEFLLFCFGGRASHVLLLDPDLEKSRSRRRSVRSGSEATIDGGGGIFSVCSPAPPRWMMSLP

SEQ ID NO: 66724 - DNA, 655 bp, Zea mays
  misc_feature: Ceres CLONE 1540059
  misc_feature: Encodes the peptide sequence at SEQ ID NO. 66725
  misc_feature (518)..(518): n is a, c, t, g, unknown, or other
  misc_feature (634)..(634): n is a, c, t, g, unknown, or other
ggagctccccgcggtggcggccgctctagaatagtggatcccccgggctgcaggaattcgtctcacccctagaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatancaaggccagctggttatcttcccaaggcgtgctcgcaaggtcaaggctggtgactctactctggaggagcttacactgctacccaggtacagggtgactacatgccaattactcgncgtgagaagcgctctgtagag

SEQ ID NO: 66725 - protein, 163 aa, Zea mays
  misc_feature: Ceres CLONE 1540059
  misc_feature (6)..(162): Pfam Name: Ribosomal_L13e Pfam Description: Ribosomal protein L13e
  misc_feature (119)..(119): Xaa is any aa, unknown, or other
  misc_feature (158)..(158): Xaa is any aa, unknown, or other
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTXQGQLVIFPRRARKVKAGDSTLEELTLLPRYRVTTCQLLXVRSAL

SEQ ID NO: 66726 - DNA, 811 bp, Zea mays
  misc_feature: Ceres CLONE 1540061
  misc_feature (35)..(35): n is a, c, t, g, unknown, or other
  misc_feature (44)..(44): n is a, c, t, g, unknown, or other
  misc_feature (811)..(811): n is a, c, t, g, unknown, or other
tttatttttttattgatatataaattattaaagantacaatccncctccctaatactagaactccccgcggtggcggccgctcttccctaaaggatcccccgggctgcaggaattcctctcacccctagaaaatgtttgtcgaagtttcaatgtctgtcgcgtgacaaattatacttataatttatattttggcatgcacgaaacaagtgtatttattcattttcgaacgaacttttatgtcaaacaaaaaaaaataaaaaataacaaaaaaaaaaaaaaaaaaaaaaagcgaaaccctccaaggcacccaacttccccctatcttgagctccaattacacgcagctccctagacctgtatttataaaaagtatgggaactggaaaaaaccctgcgggtcttcccatgtgtatattattttgctatccacatccccattttcgcactgttgaggcttaatcaccaaagaagtcctgcaccgtatccgccccccccccccaacgtttcccgcaaccctgtatgggccgaatgagaaatctgaaatcccgtttaattatttccgatcaaaaatgccgacgtgaaaatttttctatccatttccactctccttcttcttttaaacctttctgtactctataacctgggccaataatccctctcacataactgcataactaaatatactacccacatactaaagggcttacaaacgatgttttttcccaagtatttggcaaacccttgatgttcccccttctttaaacacaaaacccttgggaccccccccaacggccttaaatagtatgtaaan

SEQ ID NO: 66727 - DNA, 769 bp, Zea mays
  misc_feature: Ceres CLONE 1540065
  misc_feature: Encodes the peptide sequence at SEQ ID NO. 66728
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
tttttttttttttttttttttaactcaccattttctaccttnnnnnntctttnnnnnntcatactggagctccccgcggtggcggccgctctagaatagtggatcccccgggctgcaggaattcgtctcacccctagaaaaagaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagctttggggtggtggttgaaccaataataaagcgaaggccgaaacttggctggccttttatttttattcctcgcttactaaacaacaacaacatgaacttacctaccaaatcctacctatcaacagcgggaaagaaataaataataactcccgggcccccctaggaagacccccccattcccccccctataaaaggggacctgtatttatacggccccgcccccactgggggcgcgttttttttataaacacctccccgggtgttggtgggagaaacaacgcccgcgggggtttcacccccacccattaattctctc

SEQ ID NO: 66728 - protein, 76 aa, Zea mays; identical to SEQ ID NO: 42649
  misc_feature: Ceres CLONE 1540065
  misc_feature (1)..(76): Pfam Name: Metallothio_2 Pfam Description: Metallothionein

SEQ ID NO: 66729 - DNA, 861 bp, Zea mays
  misc_feature: Ceres CLONE 1540068
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (861)..(861): n is a, c, t, g, unknown, or other
tttttttnnntnncnngcgcgacgcgcaatcgggcccccccctccttaacacggggaaagcggagtcccgggaggggggggtagctctatactagtgcgatcccccgcgctgcaagaagcatctcacccctagaaaaactataatccgtccccccttcctctcctcctctccctctttgattgtcctctccttttcttcatgctgtcatctatttttattgcgagggggaaaaatgatttgatggtcaccgatcgatcccgtccttggaaggcgttgattatgagatgatcgccatgctgttccaaaaaatttttccgtaaatccccctctttcttcagaccgtgcacaccactttatttaatccgtgaccgtcttatggtaccccaattcccccctatagtagaatcctaataaacgcgaagacccactggagacaaccacgtaccataacggcacctcgaaccgtgtaaaaaactcctggcttatttgccatcaaagcgccacccccccccttggcacgccacaaataacccccattttaaagtacatctttgcgctgatatttctccccgaatataagagccccccccatcacaaatattagccacttatcccctatccccaatttagagccaatcccccctgaaacaggagagaaaacgggaaaccacatctcaacggaacttattaacttaattatgcggtatacacaaatactcccacctcccaaaactccgtcctgccaacactcacccatcacaactgtttcttatttacctccctccgtcccgcccaaacatgtccacccctgatctccccctctaaaacaataccaacacaaatacaacaccactcagttn

SEQ ID NO: 66730 - DNA, 783 bp, Zea mays
  misc_feature: Ceres CLONE 1540070
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (227)..(227): n is a, c, t, g, unknown, or other
  misc_feature (228)..(228): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (490)..(490): n is a, c, t, g, unknown, or other
  misc_feature (595)..(595): n is a, c, t, g, unknown, or other
  misc_feature (655)..(655): n is a, c, t, g, unknown, or other
  misc_feature (729)..(729): n is a, c, t, g, unknown, or other
nnnnttttttttggggggaaatttagtctgcgtcttctnnntttannnnnntaaaactgggactccccgcggtggcggccgctctagaactagtggatcccccgggctgcaggaattcgtctcacccctagaaaaatttgtcgtctgtaagcatgtgaacttccgacgttgccacatgctggatcagtctgaataagtaagtatgcagctctaggtggtcagctgcnngtctaccnnncnnnnnnnnnntttgggggaaaaaagagggccccaaaaattgtgggcttttccacacccccaggctttctcaattttggagagggcatagagactctagaaaaaaaatttagttttttttttctcttccaagaggaggggcggccacgcagaaaaaaaaccaaccccccccccccggcctagcaccaatcctttcttgctacaggcaaaccagagtaaactattccctttcataatacaacacaacaaccanataacaagcaacaaaataatacactatattccacatgacaaatccccatcagatagagcctcaaaacacaaggaattattactcttccctacacgccgtcagggntcacgatcccacgcacatactactctcttttctttatccaccttccttcatccagtcctntattacctctcgttgaggacatagataataagagtctaactttcctttctactataataattaccgtacgcgcnaacacagttacctccacactttactcaaatataaacaaaaagataaagagaaaa

SEQ ID NO: 66731 - DNA, 652 bp, Zea mays
  misc_feature: Ceres CLONE 1540073
  misc_feature: Encodes the peptide sequence at SEQ ID NO. 66732
atagctggagctccccgcggtggcggccgctctataactagtggatcccccgggctgcaggaattcgtctcacccctagaaaaaatactccaccactctgctaaagagtaaagacccagcagacatagatcagtgggtcctccctcgtcaagcagcacggtgatccacgggcgcacagggctttttgccggccattacagaggagaggaggccgacaaaggcgtggcagaggtcccatccatgggagaggaagcggccgcggccacggccacggccaccgtggcggcagggaacgcacctccgcacctgctcctggtatgcttcccggggcagggccacgtgaacccgatggtccgcctggccaagcgcatcgcggccaagggccgcctcgtgaccttctcctcgctctccagcatcggggcgaagctcaccgcgtccgcgggcgtgtcggccggcggcgacggcgtgccggtgggccggggccgcgtccggttcgagttcatggacgacgaggaccccgggcctgacctggacgacctcatgcgccacatcgccaaggacggcccgccggcgctggccgagctgctggggcggcaggcacgggccgggcggcccgtggcgtgcgtggtggtgaacccgttcatgccgtgag

SEQ ID NO: 66732 - protein, 136 aa, Zea mays
  misc_feature: Ceres CLONE 1540073
  misc_feature (22)..(63): SWISSPROT Homolog: EC 2.4.1.210 Limonoid glucosyltransferase
  misc_feature (21)..(52): SWISSPROT Homolog: EC 2.4.1.121 Indole-3-acetate beta-glucosyltransferase
MGEEAAAATATATVAAGNAPPHLLLVCFPGQGHVNPMVRLAKRIAAKGRLVTFSSLSSIGAKLTASAGVSAGGDGVPVGRGRVRFEFMDDEDPGPDLDDLMRHIAKDGPPALAELLGRQARAGRPVACVVVNPFMP

SEQ ID NO: 66733 - DNA, 648 bp, Zea mays
  misc_feature: Ceres CLONE 1540074
  misc_feature: SWISSPROT Homolog: EC 3.2.1.23 Beta-galactosidase
  misc_feature (648)..(648): n is a, c, t, g, unknown, or other
aaagctggagctccccgcggtggcggccgctctagaactagtggatcccccgggctgcaggaattcgtctcacccctagaaaaaataggtacggtatagttacccgcgctgatgttcttcgcgtgttggaaggcatgttgaagatttaggagcgcagatacccatgctcggaagccacagcctcttgtaaatatgtagatgtgcccgggcatggtgtttctgagtagcagcaaagagatctaccatgtataggagtttctccttgtaaataatagtagcacgccaggagactccatcccaggttccgtactgcttgcgcgaccagatgctgtaaactagccagatacttgaagaccaatataaatggatatgtctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattgtaagcgttaatattttgttaaaattcgcgttaaattttn

SEQ ID NO: 66734 - DNA, 594 bp, Zea mays
  misc_feature: Ceres CLONE 1540076
  misc_feature (302)..(302): n is a, c, t, g, unknown, or other
  misc_feature (328)..(328): n is a, c, t, g, unknown, or other
atagctgggagctccccgcggtggcggccgctctagaactagtggatcccccgggctgcaggaattcgtctcacccctagaaaaacttccagtctcccacattcccctcccccggccctcgccatcctctcccgctaaccccaccccgtcgccccggcctcctcggtccagcggcgagcgggtccgtccggtcccgacgccgcaccacatcaccgcctgctcgcacggccgtcctcactcgacctcgatcggaacctccggatcggaggtaccttcgcgcgcggctccgctccgacctcgtncctcatcggttggcatcggaagcggncgcggcggcggggtcccatccagctttcgaaaagttttaatccctgattggcaggcatcaatcctccggcctctttgggaactgtggttggggggacccggggggaaaattgaagtacctgccgaggcttaacattttagtttgccaaaatgaagggcccaagggggcccaatttccccgggtttctttgggcccccggggtggggccctgaaagcggggggggaaatttttgggggggaaattttggggaaaatgccccctttca

SEQ ID NO: 66735 - DNA, 653 bp, Zea mays
  misc_feature: Ceres CLONE 1540077
  misc_feature: Encodes the peptide sequence at SEQ ID NO. 66736
aaagctggagctccccgcggtggcggccgctctagaactagtggatcccccgggctgcaggaattcgtctcacccctagaaaaaaccgggcacacaccatcacagtacacacacacacacgcacacgctcatcaagcttctctctcgcctactcggctgcaatggcgcgcttccagctcgcggccctggccatggcaatgctcttcgccgccgcggcggcgcaggccccggccgccaccccgacgccggctcccaaggcgtctcctcccccgccggcgacgccgcctccgacgcccgcgaccccgccgcccgccccggcgccggtgtcgccgcccgcccagcctccggccacgcctcccccggccccggcgcccgctcccaaggcccccgcccccgcgcccgaggcccttgccccggcgcccaaggccgaggcccccacccccgaaatgagctccccgccgatgtccacggaggggcccgacccgacgccctccgccgaggtgccccctggacccttcgactgcaccaaccctctccccccgccccccccaaagtgatataccacccgctttcgcacatgagtcaacaccttctcatctccctaccctcccaaataacgcaaatttccccacaaccaacctagatgttacttt

SEQ ID NO: 66736 - protein, 131 aa, Zea mays
  misc_feature: Ceres CLONE 1540077
MARFQLAALAMAMLFAAAAAQAPAATPTPAPKASPPPPATPPPTPATPPPAPAPVSPPAQPPATPPPAPAPAPKAPAPAPEALAPAPKAEAPTPEMSSPPMSTEGPDPTPSAEVPPGPFDCTNPLPPPPPK

SEQ ID NO: 66737 - DNA, 2111 bp, Zea mays
  misc_feature: Ceres CLONE 1540082
  misc_feature: Encodes the peptide sequence at SEQ ID NO. 66738
aacacgcctcttctccccccccaaaaaatccagcagcagcagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatcttcttctcggttgctactcagctaggcagatatgttatcactatgatgagcagcggtgttgtacttggggttggattccagctgtcaggcggagacagccaaatgaacgaactaatttggtatagctggcttggtggggtgattatcggcacaatgataggtgcaaacagtgtcctagaggaacactgcaaagctggacctcgcaatgtcgtcataactggaagcacaagagggttaggaaaagcgcttgctcgtgagtttcttctttctggagaccgtgttgtaattacttcacgaagtcctgaatcagtccttcagactataaaagaacttgaagagaacatacaggaagggttatctgttgccaaaaagaagcagaggaatattctatcgcatgccaaggttgttggtacagattgtgatgtctgtaaacctgaagatgtgaaggagttagtgaattttgctattaatgagcttggttcagttgatatttggataaataacgctggcacaaataaaggttttaggccattggtaaccttttcagatgatgacatcactcagatcgtctcaacaaacctagttggttctctactgtgcaccagagaagccatgaatgtcatgcaataccaagagaagggaggccatatattcaacatggatggagcaggttctggaggatcaagcacaccactaacagctgtctatggttcaactaaatgtggactaaagcagttccaaggatcacttctgaacgaaagcagaagatcaaaagttggagtgcatactgcttcacctggtatggtcctcacagaccttctgttaagtggttcatcgctcagaaataaacagatgttcaatttaatatgtgaacttccagaaacagtagccagaactttggttccaaggatgagagttgtaaaaggaagtggaaaggcaatcaactacttaacaccaccaaggatcttgcttgctttggttactgcatgggttcgacggggtcgatggtttgacgacgagggaagagcggtgtatgcagctgaagctgatagaattcgcaactgggctgaaagtcgagcacgcttctcgttcaccgacgccatggagatgtacacggaaaacacatgggtttccgtattctcgctctcggtggtctgtgcgttcataatcctctctagctctggtggacctcttccaggcacatgattcccagagctgccaaactactagtagacggccatgcatatgctcattttttaccccaccaaaggcattctactaccagaaaccatttgatacagcacttaatgaatggggaagaagagaaccccccacagatgtagatacattggtgcaagggagattagcagctgcctcctcgcaccatttaaagtttggctagctaacctatgtgctcatagaagggtaaatagaatttattgcgtgggcattccactgccgtacgtaagctggactgtgatccgtgacttttttaaggacatgtatgcaaagttaggtgagcaggatcagagtcgacattgcctcgtgtacatgcatgtagttgtcattataatcactgtaacttctggtatcgcttgtacccttcaaaaattcgaagacattatattgtgaagcgaagtggctaaaaaaaaaaaaaaaaa

SEQ ID NO: 66738 - protein, 509 aa, Zea mays
  misc_feature: Ceres CLONE 1540082
  misc_feature (176)..(363): Pfam Name: adh_short Pfam Description: short chain dehydrogenase
  misc_feature: SWISSPROT Homolog: EC 1.1.1.47 Glucose 1-dehydrogenase
MAAAAAVAHLSIHGRLRRSPEHRPSITTTTTSSSSSSAHRPSLLRCRAFKQEAGDGDPAEADARKRRKGPLYKLKAAIQGLAGSRSAAAEVYGGEYQYQRAVEKAEEIFFSVATQLGRYVITMMSSGVVLGVGFQLSGGDSQMNELIWYSWLGGVIIGTMIGANSVLEEHCKAGPRNVVITGSTRGLGKALAREFLLSGDRVVITSRSPESVLQTIKELEENIQEGLSVAKKKQRNILSHAKVVGTDCDVCKPEDVKELVNFAINELGSVDIWINNAGTNKGFRPLVTFSDDDITQIVSTNLVGSLLCTREAMNVMQYQEKGGHIFNMDGAGSGGSSTPLTAVYGSTKCGLKQFQGSLLNESRRSKVGVHTASPGMVLTDLLLSGSSLRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 66739 - DNA, 769 bp, Zea mays
  misc_feature: Ceres CLONE 1540085
  misc_feature (12)..(12): n is a, c, t, g, unknown, or other
  misc_feature (769)..(769): n is a, c, t, g, unknown, or other
gggggggggggnatagggggtgggtgggatataaactggatattctccctccctttaaagatggaactcaccgcggtggcggccgctctacccctagtggatcccccgggctgcaggaattcgtctcacccctagaaaaagtaggttgccgaggctagctagctcgatcttgcgttgattagggaggaaaacgtagctagccagccaggttgagatttgattagagttgagagggtacagagatacatacagaggctagtccagaccatagcgctagctagctgagacggccgagaggaacaaagacgatcgatctcgatccagagctctgggcatgatgaagctcttgttccagtgtccctgctgctcctggttctgcttcatgaaaacagccagcagcaagacccaacacgggcggcggcagccggcaacatggaaaggagcaactgccccacccagcagcgcaccgggttcccctcgcaaggaggagggaatagtggtagggcaagggccctgggacaaggggggtagctttaccctgcaatcctttgggcccagttttcaacttcgcttttttatttacctaaacctagcttattccctccttggcttttaagaagaaaaaaaaaaaaaactatgcccctttccagggaacccccaatttcacccctcatagcggggagccgctatttacccccccccctccctggggccttcctttttttataaaacgtccctggacctcggcggaaaaacccgtgggggtttn

SEQ ID NO: 66740 - DNA, 725 bp, Zea mays
  misc_feature: Ceres CLONE 1540089
  misc_feature: SWISSPROT Homolog: EC 3.2.1.23 Beta-galactosidase
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (43)..(43): n is a, c, t, g, unknown, or other
  misc_feature (44)..(44): n is a, c, t, g, unknown, or other
ttttttnnnccccnncccttgtcgtcacactacataattgttnngtttttttgtttaatagctggactccccgcggtggcggccgctctagaactagtggatcccccgggctgcaggaattcgtctcacccctagaaaaaaaaatagaaaaaatgtgaacttgtgatttatgggattaatttgtaatattgtgaacttgtgatctgtgtgatccattattatattgtgaacttgtgatattgtgaattgtgaacatgtgatattgaaaattgtgaacttgtgttttttgtgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacccaataaggccgaaaatcggcaaaaatccccttaataattccaaaaagaataagaccggaaaataggggttgaagtggttgtttcccagtttttgggaacaaaggagatccacttatttaaaaagaaccgtgggaac

SEQ ID NO: 66741 - DNA, 646 bp, Zea mays
  misc_feature: Ceres CLONE 1540096
  misc_feature: Encodes the peptide sequence at SEQ ID NO. 66742
  misc_feature (218)..(218): n is a, c, t, g, unknown, or other
  misc_feature (221)..(221): n is a, c, t, g, unknown, or other
  misc_feature (316)..(316): n is a, c, t, g, unknown, or other
agatcccccgggctgcaagaattcgtctcacccctagaaaaactatacattttttttttcgttcgcgggtcttgtttgtcttttcgtttttactttattgcccatttttggatgaattgttcttccctgtcattcaaattgctaggagtatgtcatgtcatgtaacgtccttgtcccatttttatgtaattttaactaaataaatatgagttgtgtcncanaaaacaaaaaaaaaaaaaaaaaaaaaaaaaaaaaaaaaaaaaaaaaaaaaaaaaaaaaaaaaaaaaaaaaaaaaaaaaaaaaaaaaaaatacccnacccccccaagaaaccaaatcccctctaaaaaaaaaaataattgtggggggctggggggccccccatctcccccactggaggggggataaaaacccgggtctatccgcccttttttacatcgggggaaaaaaaaaaaaccccggcgggacaaaataatataaagggtagaaaaaaaacccccttttccagaagggggggttaaacaaaaaaagcccccgcaaaattcccccccccaaaaattttttccacaacctcggcgggaaatataaattaatcccccccttatttttttttaaaaaaaaagccccaaaaaaaatttttaagaaacg

SEQ ID NO: 66742 - protein, 66 aa, Zea mays
  misc_feature: Ceres CLONE 1540096
  misc_feature (5)..(5): Xaa is any aa, unknown, or other
  misc_feature (6)..(6): Xaa is any aa, unknown, or other
MSCVXXNKKKKKKKKKKKKKKKKKKKKKKKKKKKKYPTPPRNQIPSKKKNNCGGLGGPPSPPLEGG

SEQ ID NO: 66743 - DNA, 728 bp, Zea mays
  misc_feature: Ceres CLONE 1540103
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (460)..(460): n is a, c, t, g, unknown, or other
  misc_feature (461)..(461): n is a, c, t, g, unknown, or other
  misc_feature (728)..(728): n is a, c, t, g, unknown, or other
tttttttttttcttttccttttttttttnttttnnngnnnnnngggagaaannnnnaaaataatgtaactccccacggtggcggccgctctagactagtggatcccccgggctgcaggaattcgtctcacccctagaaaatacttcctgtatgtgtcatgtgtataatgtttgtcgcaaagattcctccaattttataggtcgattgattattggtagtatgatgtggcacggacctattttaggtttcacatctggttcaatgttgatatgctaaccctggtttgggtcgctgacctgttttcgaccttcttgagaagctgccaattggtccccttgttttgtgacttgggagcatcaccacatcataatctgtttctcatcagatgattcttaatttttttttttttgtaatttttttttccccccccctgaggaggaagaagggggtgncnnnnccnncatcctttattacaactttcaaaattaaaaaaaatctgttccatggattaataaccgggggaacaattttttgccccacttttttaaaaaaaaaaaaataaacaccagccccctcccagggatccccaatttctcccacataaggccgtgcggtatttattttttcccccaccttagcaagctcttattttcaacatctctcgcactggaaaaaaaaatatttgtccttaccctcccactatttaattcctcctcaccaaaccttcn

SEQ ID NO: 66744 - DNA, 828 bp, Zea mays
  misc_feature: Ceres CLONE 1540104
  misc_feature: Encodes the peptide sequence at SEQ ID NO. 66745
  misc_feature (1)..(1): n is a, c, t, g, unknown, or other
  misc_feature (8)..(8): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
ntgggggntttnnntttttngttttctgtttttttttctgtcttccatattcaaagctggactccaccgcggtggcggccgctctataactagtggatcccccgggctgcaggaattcgtctcacccctagaaaaatgcacaacacttcgtcgatctacacacatacatagttctcttctactacacgacgacaaacatggcggaagcactgcgaagatcggagagtggggtggatacaccggcgatcgtctggatctgagggctactccggaccggctgaccgaggtgaaggtaacggcggacaacagcagctgcatccgctcgatctccttcatctacatcggagacgatggcaagccgtacgaggaggggccatggggtttctgccatgattggcacggagtacaagattgatctgagcaagttcttacgagagcttgacggaagatctcccgggaccacgggtcccatcactacaaaatgtgacaatgctggtacaagtcctctacaaattttgtcaccatacataaacgtaccttaccggcacacgttacccgccaggcgaacaaagaggctacgcacgaattccactgatccaaggatgaaagaaaacaacgttcccaacggtccgctgggccttccctttggaccagactcctggtaaaaatttgccctggtaacggcgaattctggggcatccaaaccgtcgaatcaccccaaacctaaatcaacctgataaacgcgatggggaagcgggagatcaatcccgggcaaggtctatgggcttataagtgcatgcaaatgtcaatgtcctgcgcgttagacct

SEQ ID NO: 66745 - protein, 137 aa, Zea mays
  misc_feature: Ceres CLONE 1540104
  misc_feature (3)..(3): Xaa is any aa, unknown, or other
  misc_feature (4)..(4): Xaa is any aa, unknown, or other
  misc_feature (5)..(5): Xaa is any aa, unknown, or other
  misc_feature (7)..(7): Xaa is any aa, unknown, or other
WGXXXFXFLFFFLSSIFKAGLHRGGGRSITSGSPGLQEFVSPLEKCTTLRRSTHIHSSLLLHDDKHGGSTAKIGEWGGYTGDRLDLRATPDRLTEVKVTADNSSCIRSISFIYIGDDGKPYEEGPWGFCHDWHGVQD

SEQ ID NO: 66746 - DNA, 648 bp, Zea mays
  misc_feature: Ceres CLONE 1540113
  misc_feature: Encodes the peptide sequence at SEQ ID NO. 66747
aaagctggagctccccgcggtggcggccgctctagaactagtggatcccccgggctgcaggaattcgtctcacccctagaaaaaacccacgaccaggccaccacttcgccatcgccacggctccacccacgtctcggcttttgcttgcttgcttcctcctctcccgtcgggcactcgggctcgtcagactgcgcccgggcgccgaatctccagacgggatcgcgccccccatctgacgccaccggcgccggagcccacggcgaccgcccgcctctgcctccgatctaaaagaaacattggagaaccgtactgaacaaaataagtactggtatttcatcgtttgtctcggtattccaataatgtggaaactcaatccctttggaggtaaagcacagagtgggttggatggtcgtactattgatgttggaaatttgaagatcacagtacaaaatgccattgcacaaggaggtttctcttgtgtatatctggcatgtgacacagtacatccatcaaagatgtatgcactaaagcacattatttgcaatgactcagaatcgcttgatcttgtcatgaaggagatccaggttatgaacctcctcaaagggcatcctaatgtggtcacacttgttgcccatgatgtttttgaaa

SEQ ID NO: 66747 - protein, 96 aa, Zea mays
  misc_feature: Ceres CLONE 1540113
  misc_feature: SWISSPROT Homolog: EC 2.7.11.1 Non-specific serine/threonine protein kinase
MWKLNPFGGKAQSGLDGRTIDVGNLKITVQNAIAQGGFSCVYLACDTVHPSKMYALKHIICNDSESLDLVMKEIQVMNLLKGHPNVVTLVAHDVFE

SEQ ID NO: 66748 - DNA, 753 bp, Zea mays
  misc_feature: Ceres CLONE 1540115
  misc_feature: Encodes the peptide sequence at SEQ ID NO. 66749
  misc_feature (45)..(45): n is a, c, t, g, unknown, or other
ttttttttttttttttttgatgatggcaaagaaagtaaaaaattnttctataaaaaaacaaactggagctccccgcggtggcggccgctctagaactagtggatcccccgggctgcaagaattcgtctcacccctagaaaaaacagccgccgccgccgcatcccagcctccatcaccgtttccgtctcgttgccatgggtaaggtgcacggatcgttggcgcgcgccgggaaagtccgcgggcagacccccaaggtggcgaagcaggacaagaagaagaagccccgcggccgcgcgcacaagaggatgcagtacaaccgccgcttcgtcaacgccgtcctcggcttcgggaagaagcgcgagccccaactcctcccaagaagtaaggcgcccctccggctcgttaccgggttcccccatccttttcctggctctccccttatggatagatgaccccttaaaagggtaacctatctttccatttggttccgccaacccaccaagaaaaaaacccctttctgggaaaaattcccgattttttggttttcgccatggggccccccaaataggggaaaactttggaaaattgggactaaaatttttgagaaatattgggggaatataaagacccaaaagaaatttttatttaagagcgcctaattgtgttgagccccccccccggaacaccgtgtttttttttctttggctcaataaagataaaaaaactaataccccccccccacagcggaccccc

SEQ ID NO: 66749 - protein, 85 aa, Zea mays
  misc_feature: Ceres CLONE 1540115
  misc_feature (3)..(61): Pfam Name: Ribosomal_S30 Pfam Description: Ribosomal protein S30
MGKVHGSLARAGKVRGQTPKVAKQDKKKKPRGRAHKRMQYNRRFVNAVLGFGKKREPQLLPRSKAPLRLVTGFPHPFPGSPLMDR

SEQ ID NO: 66750 - DNA, 698 bp, Zea mays
  misc_feature: Ceres CLONE 1540116
taaagctggagctccccgcggtggcggccgctctagaactagtggatcccccgggctgcaggaattcgtctcacccctagaaaaaccgtcaagccgtggcgcaactacatccccgacatcatcatccccaaatcaatctccccttgagctcagctcagctgctggttgctgtttcctgtgtaccactaggccctgcctgtacaacgagcgacgacggtgacttcccgcccggaaattaaaccctcgtaatgtaaagacttatgttatttagtagcggctactcttgcagtcttgtctgtatcacatatgaactggtttgttagctgaatcccaacgttatttccgaccctaaccaggggaaatttagctcaaaacggagaaaatacataccagacctttgaaagaaaagcaagcccactcctctctggctcctcttcttctccaccacaccataggcactggcaccagcaaagtctcatccctccctccttcttgacaccgagacggaccccatacacacaataccacaaaaatggaacggcaaccgccctatcctgaaaaaaagaaccctcttaaaatgtgcgccacgtacaatctaccattttatggtaggttaacctcccttggactaagttggaaagcgacatggtgagagctccctagtccctgtcacgcctggtaacacaaaaacatacaaa

SEQ ID NO: 66751 - DNA, 636 bp, Zea mays
  misc_feature: Ceres CLONE 1540118
  misc_feature: Encodes the peptide sequence at SEQ ID NO. 66752
ggatcccccgggctgcaggaattcgtctcacccctagaaaaactcctcagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaggttcttggatgaccagaaccgtctcatcatgaggaacgtcaagggccctgttcgtgagggtgacatcctcaccctgctcgagtctgagagggaggccaggaggctgcgctgaagccctggtggccttggatgtaattctgttaattttgttctatgtttgtcgaacttgccgtgtgaccttcacaacatctgctttgagatttactcagcctggattgcagttttattttctttcaatagaactaaagaaaaaaaaaaaacttcaagcagcctttgggttgcccgattaaaaaaaaaaaaacgagacgcctcgagggtacccaatttcccccttttgcgggagccgtatttaccccgcccttcccttggcccgttcgtttttaaaaaaccctccgatggactgggagaaaaccccg

SEQ ID NO: 66752 - protein, 65 aa, Zea mays
  misc_feature: Ceres CLONE 1540118
  misc_feature (1)..(65): Pfam Name: Ribosomal_S28e Pfam Description: Ribosomal protein S28e
MDTQVKLAVVVKVMGRTGSRGQVTQVRVRFLDDQNRLIMRNVKGPVREGDILTLLESEREARRLR

SEQ ID NO: 66753 - DNA, 744 bp, Zea mays
  misc_feature: Ceres CLONE 1540122
  misc_feature (34)..(34): n is a, c, t, g, unknown, or other
  misc_feature (37)..(37): n is a, c, t, g, unknown, or other
  misc_feature (51)..(51): n is a, c, t, g, unknown, or other
aacccgggaaaaaggggtggggatggtagtaaanctncctgctcacccctntaaactggtactccccgcggtggcggccgctctagaactagtggatcccccgggctgcaggaattcgtctcacccctagaaaaaaaacatgtgtgagctcaccattgctgtctcacacccccataggagaagaacatgtggttcaagaggagccacacaacgaggagtttgatctgatctagttggcgtttcccagttgactttatggcgccaaggacgattcttagttcgttttatatttaccttttattttgtaagactttcgctatttaataaatactctgatttcattgcgaaaaaaaaaaaaaaaaacgagacgctcgaggtacccaattcgccctatagtgagtcgtattacgcgcgctcactggccgtccttttacaacgtcctgactgggaaaaccctggcgttacccaacttaatcccctttgaagcacatcccccctttcgccaggctggcgtaatagccaaaaggccccgccccgtttcgcccttcccaacagttgcggcacccctgaatgggcaaatggaaatttgtaagccgtttaatattttggttaaaaatcccgcggttaaattttttgtgtaaatccagcctcaattttttttttcaccattaggggcccaaaatcccggcaaagatcccccttctttaaactcccaaaagattagaaccccgaaataaggggttg

SEQ ID NO: 66754 - DNA, 851 bp, Zea mays
  misc_feature: Ceres CLONE 1540125
  misc_feature: Encodes the peptide sequence at SEQ ID NO. 66755
  misc_feature (1)..(1): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (244)..(244): n is a, c, t, g, unknown, or other
naaagggggggtccctcacaatatttnnnnnnnnnnnnnnnnnggtccnnnnnnnttagctggagctccccgcggtggcggccgctctagaatagtggatcccccgggctgcaggaattcgtctcacccctagaaaaagatttccccttaacacagcacagaggaagcaggcggcggcgatggcatggcgggcgagcctgtctcggagcctaaaggagatccgcgtcctcttctgtcagtcctncccggccagcgccgctgcccgtgagttcgtgaagaagaactatggtgacatcaaggcccgcaaccccctccctcccctttcctggtcccgcaagtggctccggtgtccccgccccccggctccggggggccgcctccgaattcgggggtggtgggagaacaacgccgtggaaacttggcgatgggggttgggagggaatatttttttccccccccccccccacaggcggggggggggggggggggggggccactaacccctcctctccaccaaattcccccccttttaaaataccccagaaatgtggtgttcttgtggggagcaaccccgccaagttccccgcggccccgtgggcgtgttaaacagtgtcttcccgccccacaccaaacaacctgggtacgcccccgctcgcggcacgggggggggagagcccacccaactcggcgatatacgcgcccgctctttctccggcgacagtgaggaccgcgcagtatgtgtgccgccctctttggcccgtcattttattcccgccccctctgtgttgactaccgttgcggccgcacccccgcctcgtgggtgggtgcgcgcgacacaatgtacacactac

SEQ ID NO: 66755 - protein, 106 aa, Zea mays
  misc_feature: Ceres CLONE 1540125
  misc_feature (22)..(22): Xaa is any aa, unknown, or other
MAWRASLSRSLKEIRVLFCQSXPASAAAREFVKKNYGDIKARNPLPPLSWSRKWLRCPRPPAPGGRLRIRGWWENNAVETWRWGLGGNIFFPPPPHRRGGGGGGGH

SEQ ID NO: 66756 - DNA, 649 bp, Zea mays
  misc_feature: Ceres CLONE 1540136
atagctggagctccccgcggtggcggccgctctagaactagtggatcccccgggctgcaggaattcgtctcacccctagaaaaaaacctcatctcacctcactgctctcatgtgccagttgctcgcacaatcagtatgagtacggatccaacagtgagtgaaactgagacccaggaggagtcatggcgactccggcatgaccgcggcagctggttgctgtacctgtccctagccgcccaatgagtctgcgagcacccttaccgccttcgcgggcttcctggacggctgccccgtgcccttcgtcgtgacctgcctcctgcactggtgcttcccggtatgcccggtgtgaaggaaggggtgtctggacgcagagtctcttcgccagcgtcagtacaacgacatgcgattacggcagtcctgaccggggcccacgggcctgcaccgcggtcgcgatcattgttcttcatgacatgtctgaagctacgcaacctctcatgtgggcgtaagacacacaacgcctagaaccagacctccttctgcttcaagattgcgagattggtggtggcatcacgccattgcatgtgatgctgctacttacactgaccgccattatacgaatggaccagctgacaatactcatactagcgca

SEQ ID NO: 66757 - DNA, 640 bp, Zea mays
  misc_feature: Ceres CLONE 1540138
  misc_feature: Encodes the peptide sequence at SEQ ID NO. 66758
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (321)..(321): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (330)..(330): n is a, c, t, g, unknown, or other
  misc_feature (331)..(331): n is a, c, t, g, unknown, or other
  misc_feature (333)..(333): n is a, c, t, g, unknown, or other
  misc_feature (335)..(335): n is a, c, t, g, unknown, or other
  misc_feature (640)..(640): n is a, c, t, g, unknown, or other
ggagctccccgcggtggcggccgctctagaactagtggatcccccgggctgcaggaattcgtctcaccccctagaaaataacagagatgatatggtttagttctatctgagttgagcagtgtgcttagtgctactggtttctgcctggagagctgatcaaaggatatatgtagcgtgttgttatctgatctgaaagggagtgcttgacccccaacgttgttctactcgattttgctagcgtttcagtaggatttttctagaattgcaaacgttatgctttcgtcagaaaaaannnnnnaaaaaaaaaaaaaaaaaaaaaananannnaannanantttttccaccccaaagtgaaagcttgcataacccctatttattttttttgaaaaaggtttccccaaatactccggggttaaaataaataaaaaacggggggcccttttttttttttcccccccccctttttttttgttcccccccacaaaaaaaaaaaaaagggtgtttttttctaagagggagaaaatttttctttttttctttttttaaaaaaaaaaaaaaaaaaaaaaaaaaaaaatttttcttcttcccccggcgaggggaaaacgaaaacaacaaacccctctccttccccccgaggagn

SEQ ID NO: 66758 - protein, 32 aa, Zea mays
  misc_feature: Ceres CLONE 1540138
ELPAVAAALELVDPPGCRNSSHPLENNRDDMV

SEQ ID NO: 66759 - DNA, 654 bp, Zea mays
  misc_feature: Ceres CLONE 1540140
  misc_feature: Encodes the peptide sequence at SEQ ID NO. 66760
  misc_feature (486)..(486): n is a, c, t, g, unknown, or other
  misc_feature (652)..(652): n is a, c, t, g, unknown, or other
  misc_feature (654)..(654): n is a, c, t, g, unknown, or other
agagctggagctccccgcggtggcggccgctctagaactagtggatcccccgggctgcaggaattcgtctcacccctagaaaaaagcccaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcaaatggaggcgctccgcgccatgtgcggcgcgctcatcccctcgctacccgccgacgccgacgccggccgcggcgacccgcccggcggncaggacctcgagcgcttctacctcgcctccgcggccgactccaccatccccgacgaggtcgcggaactgatggtgacgcggtgcatccgcgaagcggtggccctggcctgggtggtgctttgggcgctgaacacccgggcgggcaccctgctgctgtgcggccggntn

SEQ ID NO: 66760 - protein, 140 aa, Zea mays
  misc_feature: Ceres CLONE 1540140
MAVQGGEERESGKGAAPAVVSGGEAGPPGRRTARGHPLLRGGWRRDRYTHGMRPAQMEALRAMCGALIPSLPADADAGRGDPPGGQDLERFYLASAADSTIPDEVAELMVTRCIREAVALAWVVLWALNTRAGTLLLCGR

SEQ ID NO: 66761 - DNA, 641 bp, Zea mays
  misc_feature: Ceres CLONE 1540141
  misc_feature: Encodes the peptide sequence at SEQ ID NO. 66762
aaagctggagctccccgcggtggcggccgctctagaactagtggatcccccgggctgcaggaattcgtctcacccctagaaaaaaggcacacaaaagaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccggattcctggatgaagatgctggcctgggtgctggagacgccggtgcttgactggatcgtgctcggcgtcctcaagagggacaacctcgtctacaagctcgtctcggacgctgagatcccggagccgccgctattcacggccacccacacatggcaagcgatccacgagcagagcgtgcgcgtgacggagtcgaggctgtagccggaggagcgcgtgcaggaggccgtcgcctgcgtcccatctgctgcccaggaccagttggagccggccgcggcgttcatgcgctggacggtgcgggacttccacaggacgtacagatcacgacaggctacccctaccatggtggcgcggctattcctgccaaccgtggaggaatgttcacggccgg

SEQ ID NO: 66762 - protein, 63 aa, Zea mays
  misc_feature: Ceres CLONE 1540141
MKMLAWVLETPVLDWIVLGVLKRDNLVYKLVSDAEIPEPPLFTATHTWQAIHEQSVRVTESRL

SEQ ID NO: 66763 - DNA, 652 bp, Zea mays
  misc_feature: Ceres CLONE 1540145
  misc_feature: Encodes the peptide sequence at SEQ ID NO. 66764
atagctggagctccccgcggtggcggccgctctagaactagtggatcccccgggctgcaggaattcgtctcacccctagaaaaattaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctactgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcaacagctcgacgtacggacccttcggcaccgaggatggcacacctttctcactcccagttagcagtggcaagatcattggattccacgggcggtctgggtcgtatctcaactcaatcggtttctacctgaagcagatacagcgcctatg

SEQ ID NO: 66764 - protein, 157 aa, Zea mays
  misc_feature: Ceres CLONE 1540145
  misc_feature (22)..(153): Pfam Name: Jacalin Pfam Description: Jacalin-like lectin domain
MSIKSINGKSPIVVGPWGGTGGYPWDDGVYSTIRQIVIGHGAATDSIRIEYDLKGRSVWSETHGGTDGGSETDKVKLDFPDEVLVSVSGHYGSVCGTPVIIRSLTFQSNSSTYGPFGTEDGTPFSLPVSSGKIIGFHGRSGSYLNSIGFYLKQIQRL

SEQ ID NO: 66765 - DNA, 701 bp, Zea mays
  misc_feature: Ceres CLONE 1540146
ggagctcaccgcggtggcggccgctctagactagtggatcccccgggctgcaggaattcgtctcacccctagaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgaagacggcgacgaacccgtcagccgcgaagagcggcggcgttaagaaggctgatcacaccccccgggaaaccaaaaggaaggtgaaaaagcatccaaacaggcggcggctggccaaaaagtgacgtacattttttttccccccccccccgggggggggggggggggagtgaatcccttgccatgtaccccccccacgccctttccttcctggaatcctcccagggaacgccgggggtggcccccccctcctggttcgaatgaagccccaaacgacccccaccaaataccaccgttggctgtgtcttaatccttacaaaagccccgcccccccgtttgccgttcccccatttcctccctatagtgaggccccaaattactcccccgcttccttgccccgtccttattaaagagatcccgggactgggcaaaaacccccgcggtgaatcccccactattttcccccctacccgtg

SEQ ID NO: 66766 - DNA, 615 bp, Zea mays
  misc_feature: Ceres CLONE 1540147
  misc_feature: Translation starting site: 378
aaagctggagctccccgcggtggcggccgctctagaatagtggatcccccgggctgcaggaattcgtctcacccctagaaaaaacattcagaacagcaacggtagatacaccagaaattctgagctggtcccctgattgctgcttttcgacctgggctcccttccgacaatcacttcactccgagcgacccgtgactcatccacccacagtgcactcgcatttccccccggaacggcgaatgccgctacagcgaaggagtaaagcaagatggcagaggaaacctcactacatactaagacgctgaacgacaacgtctagagggtgcactacgcagtgcgcgcagagctgtacctccgcgcctcccatctgcataaagatggcaagaagatcatcttctccaacgtcgcgcaacccgcacgccctcaggcagaaaccgctcacctacccgcgccaggtcaggaaaaaaggggagatcgtccacatctccgcttcgcatcgcattcccatcccggttcatccacaccttgtcttctactcgactatcccctggagactatgcgtggcgcccgagtatgtggacgcgctcgcgctcgacatcgaggtggcgctgtgcc

SEQ ID NO: 66767 - DNA, 678 bp, Zea mays
  misc_feature: Ceres CLONE 1540151
  misc_feature: Translation starting site: 159
  misc_feature: SWISSPROT Homolog: EC 1.11.1.6 Catalase
  misc_feature (47)..(47): n is a, c, t, g, unknown, or other
tggagctccccgcggtggcggccgctctagaactagtggatcccccngggctgcaggaattcgtctcacccctagaaaaaaaaaaaaccacacctccatctccagcactagaacacttcgattgattcagtggagtagctcagctcagctgaatcacaatgggatcgctaccaatgttccgtgccgtccaagtagccacgtacacgcacggtggacgacgactcaacgcttggctgctcctcttgtgggaacgacaacgagcgcgctgactgtggtggcctcgcgcgtcccactcctgcgtggaggactaccacctgcatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcacgcgcccggcgtgcggacacccgtgatcgtgcgcttctcgacggtgatccacgagcggggttccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcag

SEQ ID NO: 66768 - DNA, 829 bp, Zea mays
  misc_feature: Ceres CLONE 1540153
  misc_feature: Translation starting site: 236
  misc_feature (829)..(829): n is a, c, t, g, unknown, or other
aagtggaagatttttttcttttttattccagacgcaaatgataccccccaataaaactggaactccccgcggtggcggccgctctaaaactagtggatcccccgggctgcaggaattcgtctcacccctagaaaagtatgcacacaaacccatcgcagggcattctcgagcatagcttctctgcctctctctcccctcctctcctctcgtccactcctttgtccaaagcttcgagatggctcagcagcagaaggtggtggtcagggttccaaaccatgaccagatgacaagatcaagcagaaggccatcgaagctgtttgcggacatttacggtattgactcccatagcagcggatctgaaggagaacaagatgaccatcataggcgaaatgggattgcagtaaccgattgcccaagaagtttaaaagaagattcgggaaagattggacatttggtggtctgttgggacccttgcccccacgaagtaaaacacaacaagaacacacctaggcggcttcggagggtacacccacattcgcccctaattcagggggagtcccgaaataaaccggacgcgccctccaaaggggtccaggccctactttaacaaagcggactgtggaacgggggagaaaacacccctgcacgtagaacccccaactgttaatctggctttttgggcacggaacaatcccccccttttttcccccccgcattgggcgatcataagatgaaaaaagagtggcccagaaaaaacgaaagcggccctttatctaaacccgatatggctgcaaccctctctatatgggttctaattgcgtcaaaatan

SEQ ID NO: 66769 - DNA, 556 bp, Zea mays
  misc_feature: Ceres CLONE 1540162
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (242)..(242): n is a, c, t, g, unknown, or other
atagctggagctccaccgcnnngtggcggccgctctagaactagtggatcccccgggctgcaggaattcgtctcacccctagaaaaaagctctactcaaagagcgctctaccagtacaaccacactaaaccccaaacccaaacacaaaaaaaaagggaagcaggtgctgccgatagatcgatcgatcatggcggccgtgggcaagatcggcatggagtggctccaagaccctctgagctggntgttctgggcacggtgtgctggttgtcctgcacaactgcaaacttcgcgggaaaaccgccttccgcccggccttaggcctccaatcggggaaattgggattaatgacaattaaaaccccggggttggggcttgggaaaaaaacgggggttcttacccctgggtgggggggttccccttttccgggtgacaaccccaaaatcccccccaaaattgttttaaacaaaaaaaaggttttttttaaaaaacgggggcacaccccgggttatttttcttttataaaaaaacccccccgaaattggttttttccccccaa

SEQ ID NO: 66770 - DNA, 630 bp, Zea mays
  misc_feature: Ceres CLONE 1540173
  misc_feature: Translation starting site: 479
  misc_feature: SWISSPROT Homolog: EC 3.2.1.23 Beta-galactosidase
ggagctccccgcggtggcggccgctctattctagtggatcccccgggctgcaggaattcgtctcacccctagaaaaatacactgtccatgacgactctaagagacacaagcccctcctaggtgggcggtacaccgagtgagctggacgtcgagaaggccgttgctttggattggagctggatagcggaggtgggattttcttctgggatcggcgcctacttccggttgattcatgcttttacacgatgcagctttccccgctattactatgttatttttctctcacacagcttatgcggaacaagaaatggacgttggagacattgacggttgttgtatggcactacgatttctatctttaaagtttatctgcacttagattagtagatatattggtagacacatcactttctgctgcccctttttcataaatacatatatctcgatctctaaaaaaacaaaccccccgagacgctcgatgcacccaattcgccctatagtgagtcgtattacgcgcgctcattgtccatcgttttacaacgtcaagactgggaaaaccctggctttacccaatttaatcgccttgcatttcatccccctgtcgacagctggaaaagcccccgacaggcc

SEQ ID NO: 66771 - DNA, 687 bp, Zea mays
  misc_feature: Ceres CLONE 1540175
  misc_feature: Encodes the peptide sequence at SEQ ID NO. 66772
tggagctccccgcggtggcggccgctctagaactagtggatcccccgggctgcaggaattcgtctcacccctagaaaaaatcggctgctgtctgtttgttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtggattcgaccagttcatgaatctggtggtggacaacattgtggaggtcaatgggaatgacaaaacagatattggaatgggtggttatcagggaaacagtgttgtaatgatcgaggcactggagcccagtgcgaggtcacagtgaatcaatgttctttagcactaacagcgttgaaactgatgtaaaagaaatccgtggaccctggtgttatttgacaaatgtttttgcccacaaacctaatttccgaagggggaattggtcttccttttttctggaaaaaaaaaaaaaaaaccggagcccttgagggggccccaattcccccctaaagggagagtcgatattacccccgccccccctgggccgcgtctttttatacaaccccctgggcggggggaaaaaaccc

SEQ ID NO: 66772 - protein, 80 aa, Zea mays
  misc_feature: Ceres CLONE 1540175
  misc_feature (8)..(72): Pfam Name: LSM Pfam Description: LSM domain
MSRSGQPPDLKKYMDKKLQIKMNANRVVIGTLRGFDQFMNLVVDNIVEVNGNDKTDIGMGGYQGNSVVMIEALEPSARSQ

SEQ ID NO: 66773 - DNA, 636 bp, Zea mays
  misc_feature: Ceres CLONE 1540177
  misc_feature: Encodes the peptide sequence at SEQ ID NO. 66774
ggagctccccgcggtggcggccgctctagaactagtggatcccccgggctgcaggaattcgtctcacccctagaaaaactttgtaccttcatatatagagacaagagttctcgcttgtgagcataattgcatgatcgtgtggtgtatgtaacccgaaactgtttaccttttcgcaaaaacttcagtcttcaggcattgttccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaattcgcgttaaatttttgttaatcagctcatttttttaaccaataggccgaaatcggcaaaatcccttataaatcaaaagataaaccgagatagggttgagtgttgttccagtttggaacaagagtccactataaaagaacgtgaacccaaactcaaagggcgaaaaaaccgtctatcg

SEQ ID NO: 66774 - protein, 39 aa, Zea mays
  misc_feature: Ceres CLONE 1540177
GAPRGGGRSRTSGSPGLQEFVSPLEKLCTFIYRDKSSRL

SEQ ID NO: 66775 - DNA, 616 bp, Zea mays
  misc_feature: Ceres CLONE 1540185
  misc_feature: Encodes the peptide sequence at SEQ ID NO. 66776
tggcggccgctctagaactagtggatcccccgggctgcaggaattcgtctcacccctagaaaaaactcctcagctcacgcgagcagctgacccgatcagagcctcggagatgccggccactatttgtgctccggtcgatgcggagcccatcgcttcaccggctacgaggactatgggttccgtcacggacgactccaccgcgggagcggcagcagcggcgtcggcttggttcctgtccaagctacccgacgtccagatcccgcggaacctctcgctgcaggcctactgcttcgagcggctccccgaggtgtcctcccgcccctgcctcatctacgggcatactggcgccgtgcacacctacgcccaggtggaccgcctgtcgcgctccgcggcggctgcgctgcgcgtgctcgcggtgggcaagggcgacgtggtgatggcactgctccgctactgccccgagttcgccttggtcttcctctgcgcggcgcggctggacgccgccaccaccacggactacccgttctacaccgcgcacgatatccgccgccgggctgccgctgcgggcgccagtgtggccgtcacctatgcctgcgccgtcgactaggtgcgcgat

SEQ ID NO: 66776 - protein, 144 aa, Zea mays
  misc_feature: Ceres CLONE 1540185
  misc_feature: SWISSPROT Homolog: EC 6.2.1.12 4-coumarate--CoA ligase
MGSVTDDSTAGAAAAASAWFLSKLPDVQIPRNLSLQAYCFERLPEVSSRPCLIYGHTGAVHTYAQVDRLSRSAAAALRVLAVGKGDVVMALLRYCPEFALVFLCAARLDAATTTDYPFYTAHDIRRRAAAAGASVAVTYACAVD

SEQ ID NO: 66777 - DNA, 810 bp, Zea mays
  misc_feature: Ceres CLONE 1540185-R
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
cgacgccatcgctgggtcgaatactggtggtgggcgaatgcatgcaacagtgataaccgcatgagcggggaaggacgatttcttcgtgggatgcttgatacgctagtttgcacaacacaagacctcttgaaatcaatagtataaaacttttctacagttctgttcatagctttcacacgattgcagcctcaccttattgtacatcagttcccccaccttgtataagctgagctacctacttcttgttcactattatatatgatacaaagcctcatctaagctggtggtagggagcgccggcaagtagggcactccatcttaatgtccatccaacgctgtaaacagcctgagtgaaatatatgctcgcaaggtgccaccatgtattcacttgttctttgggtaaggtcgattgtagtcatgcaaataacacaatcgatgggctgatttgtgctgtcctctaccttcctatggtagcagtatttctcaggcagtatctggcgaggaaataagcagcgagaaccaagatagtgcctgagcagaagcactgctgcttggatacccatgaatactgtaacagctatggaccatttcttgtcgggctcgatacgcattgaaatactagggcaaccaannnttttgcattggaataggcagccctggtaactgtcatgcctaaaataaaattgggggtggcaaaaggttttcttggtacccctggaagacctgttgtggaaaattttggagggacccccaaagaggagttcatccggggaggagaaaagggggccgtaaaaaaaatttttggcccca

SEQ ID NO: 66778 - DNA, 652 bp, Zea mays
  misc_feature: Ceres CLONE 1540186
  misc_feature: Encodes the peptide sequence at SEQ ID NO. 66779
  misc_feature (652)..(652): n is a, c, t, g, unknown, or other
aagctggagctccccgcggtggcggccgctctagaactagtggatcccccgggctgcaggaattcgtctcacccctagaaaaaaggagtgtatcactgagggaagaagtgaagcggaatatagacgccgtcgacaatgggagagagccgcggcagcatcgcctttttcgccacctaccggccaccagtgccgctagacatcttctccgtgcccatcccgccgtcttcgatccgcgacgaggtacacctcacggacggcgtctcctacaactacaactgccgccccatccccaaggacgcgctcaagtccctgctcaagcgccccaagctcgctgccgacggcggcgccaccgacgccgacgtcgacagcggccgcgtctccggccttctcttcgtctccgagcgggacgatggccttgagacgctccgcgtggccctgcatttcaaagactccggcgagcaggcctgcaaggtgttctccctggctgacgtcttcggcgccgccgacttcagcggcgtgcgcctcgaggatagcggctgcgtcggcggcggctacaaggtgggctctcgcaccgtggaccactcgctcatctacgtttccaccaaggagccggtgcaagagcgacgcagcccgtggaccgtcgtgtacaaan

SEQ ID NO: 66779 - protein, 172 aa, Zea mays
  misc_feature: Ceres CLONE 1540186
MGESRGSIAFFATYRPPVPLDIFSVPIPPSSIRDEVHLTDGVSYNYNCRPIPKDALKSLLKRPKLAADGGATDADVDSGRVSGLLFVSERDDGLETLRVALHFKDSGEQACKVFSLADVFGAADFSGVRLEDSGCVGGGYKVGSRTVDHSLIYVSTKEPVQERRSPWTVVYK

SEQ ID NO: 66780 - DNA, 642 bp, Zea mays
  misc_feature: Ceres CLONE 1540193
  misc_feature: Encodes the peptide sequence at SEQ ID NO. 66781
atagctggagctccccgcggtggcggccgctctagaactagtggatcccccgggctgcaggaattcgtctcacccctagaaaaagcccacccacccacgccaccgtgtggtccgagtccgaccctgtgactgtgagtactactatcccagcatgtgctcaggacctcgcaagccgtccacccctcctctcccggcggcgatggcggcggcgctcctgctcgagctggcggcggcggacgacgtggtggcgttcaggcgcgccgcggaggacgacaaagccccggccttggacgccgtgggccactggtacggcccgtccgccgcgggcgcggccgccggccgcccccgcctcgaggcgcgcacgccggccatggtcgccgcgctctacggcagcacggcggtgctggcgtacgtgctgtcctccgcgccggcagatgccgggcgcgcgtcgcccacggacggcgccacgccgctccacctcgccgcggccggcggcgccccggcctccgtcgcggccgcgcacatcctcctcgccgcgggcgcgtccgcggacgcgcgcgccttctcgggcctccgcgccggggacctcctcctcccgcgctgcaacgccgccgccgacgcggacccggcgctccgcgtgct

SEQ ID NO: 66781 - protein, 147 aa, Zea mays
  misc_feature: Ceres CLONE 1540193
  misc_feature (87)..(122): Pfam Name: Ank Pfam Description: Ankyrin repeat
MAAALLLELAAADDVVAFRRAAEDDKAPALDAVGHWYGPSAAGAAAGRPRLEARTPAMVAALYGSTAVLAYVLSSAPADAGRASPTDGATPLHLAAAGGAPASVAAAHILLAAGASADARAFSGLRAGDLLLPRCNAAADADPALRV

SEQ ID NO: 66782 - DNA, 664 bp, Zea mays
  misc_feature: Ceres CLONE 1540196
  misc_feature: Encodes the peptide sequence at SEQ ID NO. 66783
aagctggagctccccgcggtggcggccgctctagaactagtggatcccccgggctgcaggaattcgtctcacccctagaacagagccaaggctgtggagattctcgtgaaggatcttaaggtattcgcctccttcaatgaggagctgttcaaggagataacgcagctgctgaccttggagaatttcaggcaaaatgagcagctgtccaagtatggggacacaaagtcagcccggaatatcatgcttttggagctcaaaaagctcattgaagcaaaccctctgttccgggacaagctgaatttcccaccattcaaagcttccagacttcgcacattgatcaatcaaagtctgaactggcaacatcagctttgcaagaaccccagaccaaaccctgacatcaagacactcttcactgatcactcttgtgctgctcctaccaatggagcaagagcacctccacctgccaatggtccacttggatccatccctaagtcagctggatttccaccaatgggtgctcatgctccatttcaacctgtggtgtcgccatctccaaacgcaattgcaggttggatgaacaatgccaacccctctttgcctcatgctgctgttgcacaagggccacctggtctcgttcatgctccaaacacacgggctttctaag

SEQ ID NO: 66783 - protein, 140 aa, Zea mays
  misc_feature: Ceres CLONE 1540196
MLLELKKLIEANPLFRDKLNFPPFKASRLRTLINQSLNWQHQLCKNPRPNPDIKTLFTDHSCAAPTNGARAPPPANGPLGSIPKSAGFPPMGAHAPFQPVVSPSPNAIAGWMNNANPSLPHAAVAQGPPGLVHAPNTRAF

SEQ ID NO: 66784 - DNA, 677 bp, Zea mays
  misc_feature: Ceres CLONE 1540202
  misc_feature: Pfam Name: MFMR Pfam Description: G-box binding protein MFMR
  misc_feature (494)..(494): n is a, c, t, g, unknown, or other
  misc_feature (503)..(503): n is a, c, t, g, unknown, or other
  misc_feature (544)..(544): n is a, c, t, g, unknown, or other
aaagctggagctccccgcggtggcggccgctctagaactagtggatcccccgggctgcaggaattcgtctcacccctagaaaaaatctcctctccattcacatcagcgctccacgcctgcgcccctgaattcccaaatcctgcgcgcctctgccccaaccccgctcgtcgactcctctctgccaaacacgtcggaggaatccttctccggaactcgtcttcgtcctgtctgtcgggctggcgtggagtggagatccatcaccacgtggataggtctcttcttctgctggttcaacgctgaatctgtccttcaatgccttcacaggctctacccctgaagaagttgcagagttagaagctattgccgcattttttgttgaagggaacattttttttgggtcatatccagattggatacgaaacatgctcgtccttttgggactttaagagaataagaggcaaaaggaacataaggatagaggagagaaataaacnatggggaangggagatgtggctaccaggtcaaaatctcaaaatcaccagncatacagaatgagcagagtacacctgctgacccgcccacagcatatcctggatgggtctcagttcccagcatactataatgctgcttgaacagctccagtgaccccccctttttttcatccatctgtagctcc

SEQ ID NO: 66785 - DNA, 647 bp, Zea mays
  misc_feature: Ceres CLONE 1540220
  misc_feature: Encodes the peptide sequence at SEQ ID NO. 66786
  misc_feature (470)..(470): n is a, c, t, g, unknown, or other
  misc_feature (515)..(515): n is a, c, t, g, unknown, or other
  misc_feature (516)..(516): n is a, c, t, g, unknown, or other
  misc_feature (529)..(529): n is a, c, t, g, unknown, or other
  misc_feature (600)..(600): n is a, c, t, g, unknown, or other
  misc_feature (603)..(603): n is a, c, t, g, unknown, or other
  misc_feature (606)..(606): n is a, c, t, g, unknown, or other
atagctggagctccccgcggtggcggccgctctagaactagtggatcccccgggctgcaggaattcgtctcacccctagaaaaaacctccctcctccttcactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctcctcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagcgacggcggggacgacgaagagttctcgnagaagatcccagagctcgcggtgggtcagcacccgggcgcccgcnngctgcggtggccngcaagcgtgaaacgaacgcgagcaacgtcgggctgccgctgtccctgcggatgctcaaaccgaggaagcancancanctggaccaagggccgttggaccaaacggcttggtcaacggc

SEQ ID NO: 66786 - protein, 151 aa, Zea mays
  misc_feature: Ceres CLONE 1540220
  misc_feature (93)..(93): Xaa is any aa, unknown, or other
  misc_feature (108)..(108): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
MGIQVAAVVIPPPCSSPSSSSSSPASPSSSAIATSPQHAVLGARLARSQSSLACWNAAGLGRRRGGEHTIRRALSASIDSVGSDGGDDEEFSXKIPELAVGQHPGARXLRWPASVKRTRATSGCRCPCGCSNRGSXXXWTKGRWTKRLGQR

SEQ ID NO: 66787 - DNA, 579 bp, Zea mays
  misc_feature: Ceres CLONE 1540228
  misc_feature (179)..(179): n is a, c, t, g, unknown, or other
  misc_feature (227)..(227): n is a, c, t, g, unknown, or other
  misc_feature (228)..(228): n is a, c, t, g, unknown, or other
  misc_feature (390)..(390): n is a, c, t, g, unknown, or other
  misc_feature (403)..(403): n is a, c, t, g, unknown, or other
  misc_feature (495)..(495): n is a, c, t, g, unknown, or other
aaaaaaggaggtcaccgcggtggcggccgctctagaactaatggatcccccgggctgcaggaattcgtctcacccctagaaaaacgagaccgccacctccccgaagctgccgcgaccgatcgagcgaagcgtcgctccccgcgccgccgccaaaaacctagcttctcctactccatgancactgtctcgctcaccccgcaggctgtcgtctcaacgagtcccgtggnngcctggcctctgctacatcctccgctttctcgcaaactttgttcgcccagctaacaccaaagcaagccggaactgaggaaacattgggttccgcaaaatttcccccccccctgggtccattggccccccgctcgccactagagggggggggggggggggggnaaaaaaaaaggtnttttttaaagggggtgttgataatatattgaaaaaaaaaaaaataaaaggggggagagggggaagaaaaaaaaacaaaggtttttagggaanaaagtaggagaccaaccccccggaaaatttttttttctggggggtttttttgtggggaaaaaaaaaaaaaaaaatctccccccc

SEQ ID NO: 66788 - DNA, 660 bp, Zea mays
  misc_feature: Ceres CLONE 1540232
  misc_feature (660)..(660): n is a, c, t, g, unknown, or other
aaagctggagctccccgcggtggcggccgctctagaactagtggatcccccgggctgcaggaattcgtctcacccctagaaaaagaaacgcggacaagtctctacagcctcagcacggacccggcctgcctcctcttctctctcacggcgacgactgggcgaccgaccaaccgtcgctgcgctacgccaggtgccaaggtcttcttcgggtccttcgccggcgaccagcagcaccaggcaattagacttgtgtaagaaatggatgctactgccggttaattgcgacacagatttatatggatagatattggggccatgtgtaagggcggaagctgttcctaccgcgtcaataaggggagtcctgctggttctaccaggaagatccgttcctcagccgctcaaggtcggatggcatctgacacagcgagggtaacgaaaacagaggcatcaaagctgaagaacctgatctcggcatcattcaaacccttgtctctgaccattcccatcggcgacggattccacgaatcgctccctttcagccattgtcatttatagtagagaaaggcctacaaaaacgtcgaggtgctttctgcacgatctcatagtacttgcacgagctaggatgcacctcaagcctcctgcaagacccaacctctattn

SEQ ID NO: 66789 - DNA, 607 bp, Zea mays
  misc_feature: Ceres CLONE 1540238
  misc_feature: Encodes the peptide sequence at SEQ ID NO. 66790
  misc_feature (374)..(374): n is a, c, t, g, unknown, or other
aagctggagctcaccgcggtggcggccgctctagaactagtggatcccccgggctgcaggaattcgtctcacccctagaaaaaatcgctcgtccgttccttcctctctcctcctcctcctcctttccctgctccctccaaactccaactaaacgccattggtgaatggatctcaaggaggtcaaactgatgcagagcaagttggacttttcagtcagtggcctggccttgcagatggctcccgcgaccgcgaggctggccgacgaagcaggggcttgttagtagtccagtcgctgctataaaatagagcggccatgaacccgtgtctcgcgtgtgcgtcttctctgctcacatgccgcgaggtgctccaggaancagtgtcgtccaccagatccagggctcgcatggtcgtgatcgaagaccagggcggcgccatcccctgatgcctgcgtccttcctgttcctggcaactggccgggccggcctaccttgcttgaacgcccgggccggcttcccaaaccaccgtacctggaatatccattcccaaactcctccggggccgggttatttggctcctcctttgggcaatttgggaaaaccagggccgc

SEQ ID NO: 66790 - protein, 38 aa, Zea mays
  misc_feature: Ceres CLONE 1540238
MDLKEVKLMQSKLDFSVSGLALQMAPATARLADEAGAC

SEQ ID NO: 66791 - DNA, 773 bp, Zea mays
  misc_feature: Ceres CLONE 1540240
  misc_feature: Encodes the peptide sequence at SEQ ID NO. 66792
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
ntttttttnnnnnnnnttnnnccaccacgcgacggccagcatttttttttttaaaactggtgctccccgcggtggcggccgctctagaactagtggatcccccgggctgcaggaattcgtctcacccctagaaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaaccagcaggtcgcggcggcggcgtcacgcgcgtcctacccgctgctgtgggtgcgccggaacgaggcggcgtacccacccggccacgcagatccagggcatccccctggggcaacaaggtgttcccgtccggcccaagaacgtgacgggctaacttggtccccgggcctgggcccaacgttgaacgcccacgcctgggccacagctccggccctccaaacggggagcccctccaaagggggttccgtcccccccctatcggccgcctcacaggggtgccttcccccgttacgctcccttttaccccggtgtcccttcgcggccggggggggg

SEQ ID NO: 66792 - protein, 194 aa, Zea mays
  misc_feature: Ceres CLONE 1540240
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNQQVAAAASRASYPLLWVRRNEAAYPPGHADPGHPPGATRCSRPAQERDGLTWSPGLGPTLNAHAWATAPALQTGSPSKGGSVPPLSAASQGCLPPLRSLLPRCPFAAGGG

SEQ ID NO: 66793 - DNA, 611 bp, Zea mays
  misc_feature: Ceres CLONE 1540243
  misc_feature: SWISSPROT Homolog: EC 2.7.7.27 Glucose-1-phosphate adenylyltransferase
  misc_feature (605)..(605): n is a, c, t, g, unknown, or other
  misc_feature (606)..(606): n is a, c, t, g, unknown, or other
aaagctggagctccccgcggtggcggccgctctagaactagtggatcccccgggctgcaggaattcgtctcacccctagaaaaaaactgggactgagctgttgtgattcacatgtctaactcccgaaaagaaggcagaaggtcctttttatagctttcctcagtctgatgtgtgcttccatccttcgctttcgaaatctcccttgtgtttgtgtacaccattgcaccaccaccctttaatcctttattatccagtccgttattccgcgagtacgttgatgatccctccttacggcagtaaggattccgcaaaagtatggctcccttttcccttgattgatgcggggatttgtcaggaactaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcnngagaa

SEQ ID NO: 66794 - DNA, 625 bp, Zea mays
  misc_feature: Ceres CLONE 1540249
  misc_feature: Translation starting site: 252
aaagctggagctccccgcggtggcggccgctctagaactagtggatcccccgggctgcaggaattcgtctcacccctagaaaaagacagcaagcaagtttctccatccaaccaacctctcagcgatcacccctgctccttgcattggtctcatccgccggccggccgggtaccaacgatggcctgcacccaggtacgtacgtgtgcgacgtacaatgctcgtcggcagcttagcagcaagtacacgtcgccatgcatttctactaccgcgccaacgcaactgcctcactagctcactcatcacattcgtattgcattgcgccgccaacgactaattcgctgccggccaggaggtggtggtgttcggcgtgaacctcctcgagagcggcgcgacggaggacgacggcctggtggccggctgggcggcggtgggcccgtgcacggcgctgtccccgcgcgacgaggagccggccaaggtcccgaccgagacgatcaacgacgtggcggacggctacaggcccagcggccggtacgtcctggcgtcgggccgcgccggcgaagccgacggcctgcgccgggcgctgaaacgggccgcgctccggcccgggtcacgtaccgcgtcgccg

SEQ ID NO: 66795 - DNA, 593 bp, Zea mays
  misc_feature: Ceres CLONE 1540253
  misc_feature (227)..(227): n is a, c, t, g, unknown, or other
aaagctggagctccccgcggtggcggccgctctagaactagtggatcccccgggctgcaggaattcgtctcacccctagaaaaagttcggttgttccttcccacttcctctctctcgcgcgcctgtactacttttgaagccgcagggtcagaaagagagatccacctctcagttcgattttcggtggctgaagtccttctacctcgggggggtttgagccgtttccnttgataaatttgggtttcctcaagagtttattttttggggttttccctgagaaaatcctgcgaaagacgtcgccctcgggccattttcttggggaaccgaattggccctttacaggggccaagcttccaactttgacttcccccgggggggcttctcccaaaaaccccggggttgcccaggggaaaaattttacccttttttttaaagggggggagaggcgctttccccaatttgcccttaaaagggggaaaaaaaaaccccccttttccccggggggtttttgggggccctccccccgcaaaaaatggggggggaaaaaaaaaccttttgggggctttaatccccccccttttttgggggagaaa

SEQ ID NO: 66796 - DNA, 672 bp, Zea mays
  misc_feature: Ceres CLONE 1540255
  misc_feature: Encodes the peptide sequence at SEQ ID NO. 66797
ggagctccccgcggtggcggccgctctagaactagtggatcccccgggctgcaggaattcgtctcacccctagaaaaaccccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacaggcgcacgcttgctgactacaacatccagaaggagagcaccctccaccttgtgctccgcctcaggggaggcatgcagatctttgtgaaaaccctgaccgggaagactatcaccctccgagtggaatccctctgaaccattgacaacgtcagggccaagatccagggaaaaggaggggtcccctccaaaaacaaaaagaggttcattctttctggggaaacaaacttgaaaaaggggcccacccttttgccaaattacaccttccaaaaaagaaaaacccctcccattgggggcccgccgcccccggggagagcttcgcaatttttccggaaaaaacccccgcccggcaaaatttt

SEQ ID NO: 66797 - protein, 96 aa, Zea mays
  misc_feature: Ceres CLONE 1540255
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDRRTLADYNIQKESTLHLVLRLRGGMQIFVKTLTGKTITLRVESL

SEQ ID NO: 66798 - DNA, 664 bp, Zea mays
  misc_feature: Ceres CLONE 1540258
  misc_feature: Encodes the peptide sequence at SEQ ID NO. 66799
aaagctggagctccccgcggtggcggccgctctagaactagtggatcccccgggctgcaggaattcgtctcacccctagaaaaagtccacaattcccagtggcgcacggttctgctgtccctccatcctcccgcgctccctccgtgctacatcaacgcccgcaggttctgcctctccctgtcactacgccgcctgcccccgccgcacccctccccgttactaggtgcggcgccgcgccgcgccgcctcctcggcctcgcctccgcgctcgccgacgactcgtcctgctccgacctcctcccgctgttcccagtccccgccggctacgccgcctctgacgccgcggatccccgatgccgagagctgcccgtcgcccgctgccgtcagcagcgtcttcagtaagttccgcgacccggcgccatctcctgtgacccctgacgacgctgcggcggcgcctgacgagccccaggatcttggcttcgacgatgacgacagtttcgacgccgattctattctgtgcggcgtccaccagagcgcggccgagggcatcgatggcatcatgggtaagctctctatggaaaacacgggggcgtcccgatcaggctcaagcgttgactcccacatgcccgaatcaagatgcacccctacctcaggaaaccctatgg

SEQ ID NO: 66799 - protein, 221 aa, Zea mays
  misc_feature: Ceres CLONE 1540258
KAGAPRGGGRSRTSGSPGLQEFVSPLEKVHNSQWRTVLLSLHPPALPPCYINARRFCLSLSLRRLPPPHPSPLLGAAPRRAASSASPPRSPTTRPAPTSSRCSQSPPATPPLTPRIPDAESCPSPAAVSSVFSKFRDPAPSPVTPDDAAAAPDEPQDLGFDDDDSFDADSILCGVHQSAAEGIDGIMGKLSMENTGASRSGSSVDSHMPESRCTPTSGNPM

SEQ ID NO: 66800 - DNA, 619 bp, Zea mays
  misc_feature: Ceres CLONE 1540266
  misc_feature: Encodes the peptide sequence at SEQ ID NO. 66801
  misc_feature (465)..(465): n is a, c, t, g, unknown, or other
tccccgcggtggcggccgctctagaactagtggatcccccgggctgcaggaattcgtctcacccctagaaaaagaaaaaccttcttcggttattcctcgccgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccnttggcgagaagctgactgacgaggacgtcgacaagatgatccgtgaggccgacgtcgacggggaccgccagatcaactacgaagagtttgttcaggttatgatggccaagtgaggagcgggtccccgtgaaaatagtatctattggatggaagc

SEQ ID NO: 66801 - protein, 118 aa, Zea mays
  misc_feature: Ceres CLONE 1540266
  misc_feature (12)..(40): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (113)..(113): Xaa is any aa, unknown, or other
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNXWREAD

SEQ ID NO: 66802 - DNA, 641 bp, Zea mays
  misc_feature: Ceres CLONE 1540270
  misc_feature: Encodes the peptide sequence at SEQ ID NO. 66803
  misc_feature (419)..(419): n is a, c, t, g, unknown, or other
aaagctggagctccccgcggtggcggccgctctagaactagtggatcccccgggctgcaggaattcgtctcacccctagaaaaaagatacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggaaatggcgagcatcgggctgtcggtgccgccggggttcacggtgtcgacggangcgtgccagcagtaccaggacgccgggtgcgccctccccgcggggctctgggccgagatcgtcgacggcctgcagtgggtggaagagtacatgggcgccaccctgggcgatccgcagcgcccgctcctggtcttccgtcgctcccgggccgccgtggtcatgcccggcatgattggaaccggtgctcacctggggctcaacgacaaaatggccgcccgggct

SEQ ID NO: 66803 - protein, 105 aa, Zea mays
  misc_feature: Ceres CLONE 1540270
  misc_feature: SWISSPROT Homolog: EC 2.7.9.1 Pyruvate, phosphate dikinase
  misc_feature (31)..(31): Xaa is any aa, unknown, or other
MKELLGGKGANLAEMASIGLSVPPGFTVSTXACQQYQDAGCALPAGLWAEIVDGLQWVEEYMGATLGDPQRPLLVFRRSRAAVVMPGMIGTGAHLGLNDKMAARA

SEQ ID NO: 66804 - DNA, 762 bp, Zea mays
  misc_feature: Ceres CLONE 1540273
tctccaactacacccctctgatccccttttctaaacataaacccccccataacattgtaggactccccgcggtggcggccgctctattctactggatcccccgggctgcaggaattcttctcacccctagaaaaacattgggacagactctgtacatctcattacagccccggccccggcggctgcgtgccggcgacgaagaagcggccggaggcggcgtcctggctggcgtagtacaccgtgctggggctggcgtggttgtgcgtcccctcgtacgtggtgaccacgtagccggggtcgtccctgtcccgctccacccgcttcttcacgttgcacccttccgtggagcaccggtagtagttcctgacagacagtagttgtcgtgaagtgagtgcgctagcgctagcagtccattcgtgtggtgttgtaaattgtgacgcacacagttacctaccttgggttggggctgttcttaaaaaaaaaaaaaaaaaaaaaaaaaatcctgatttttgtggctctgcccacgaatcctcgggtccgaagacccctccagggaacccaaatttcccccccaaaaggggagccgcgaatttctccccccccctacccggggccccccttcttttatcaaaaccccctcggaaaacggggaaaaaaaaaccccccggggcctgtttccccccatctattttattattcccctttttttattttgaaacattataatcccccccccttttttttttcacatcgcggagtgag

SEQ ID NO: 66805 - DNA, 811 bp, Zea mays
  misc_feature: Ceres CLONE 1540276
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
tgggggtttttttttttttttttctnnnaannncnnnnggagccannnnnnagcacactggagctcaccgcggtggcggccgctctagactagtggatcccccgggctgcaggaattcgtctcacccctagaaaaaagcagaagaggacaaaccagattcgattcctcctcctgtcctccatctccccaattcgcacggccatcggaccatggattccggcgtgcctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccggccaggttctaccaactgctcgccgcgcccgaggaccccgacgctcccgggttgcaacccttgacttggccccctttcctacgaacgacgccccaagactaagccaaacttttggctggtttcccaaaggggcctttatctttaaacccccaggtccccaatcctaccggttttcgccttttgggagaccccccttcctatatcccccctctaaacccagctttacaaaaattaataccatttctattggaacgattttaaactacaaattttggcgtttccagaaaatggtttatagtgaccatacagttatttcttgggggtccgctcctagaggtgaacccgaagtggctccctagtaaggggggaggcgctaaataaaagcgcccgcgtctcgggtaggtctggt

SEQ ID NO: 66806 - DNA, 818 bp, Zea mays
  misc_feature: Ceres CLONE 1540277
  misc_feature: Encodes the peptide sequence at SEQ ID NO. 66807
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nccccccgnnnggggcgnnnnnctttttgtttctttaannnnnnnnnnnnnccacattggagctccccgcggtggcggccgctctataactagtggatcccccgggctgcaggaattacgtctcacccctagaaaaaaccagcaacccgcatccacacctcgcagccgtattcctgtctcgaatcctctctcgccgctccgatggcccgcacgaagcaaacagcaaggaagtcgaccggcggcaaggccccccggaagcagctggccactaaagctgcgcgcaagtcggccccggccaccggcggcgtgaagaagccccaccgcttccgccccgggaccgtcgcgctccgcgaggatcgcaagtaccataaaaagcacggagctgctacatccgtaggctccccccttcagcgcccttcttcccccaaactctcgcaaggagttgcgagaatgatcttaaggttcccagttattccccccctcctgttgggctcttgaagagaggccccccgaaggccgaccccgggggggggcccctttcccgaagaaacaccaatccttttggggcctatttccagggcgcaacagaatgttccattatatattgccccaaagaaatctcacaattttcctggcgagggagctctaactgtacctaaaatgggcattataccccccactaatcatatcctcctcccttccattttttacattggtgaattaattcgctgccagggggtcgccctttcgcccccgccgggtggttccccctcacccctctaccacatacatcagaccgcccgtacaatcgcacggga

SEQ ID NO: 66807 - protein, 98 aa, Zea mays
  misc_feature: Ceres CLONE 1540277
MARTKQTARKSTGGKAPRKQLATKAARKSAPATGGVKKPHRFRPGTVALREDRKYHKKHGAATSVGSPLQRPSSPKLSQGVARMILRFPVIPPLLLGS

SEQ ID NO: 66808 - DNA, 807 bp, Zea mays
  misc_feature: Ceres CLONE 1540280
  misc_feature (20)..(20): n is a, c, t, g, unknown, or other
  misc_feature (22)..(22): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (455)..(455): n is a, c, t, g, unknown, or other
  misc_feature (807)..(807): n is a, c, t, g, unknown, or other
ttcgccccccctggcgcctntncctncnnaaannnnnnnnnnnttaaannnnaaaaaactggaagctcccgcggtggcggccgctctagaatagtggatcccccgggctgcaggaattcgtctcacccctagaaaaacatactccagatcatatagggtactatggagggtgtttgacaagctgttcaccgacttccgcgactgtttcagcggggctgagtaccatgatgttctatcgactgctaagtctaggtttcagccggtgccttccacatggcttggccattagcgcactgcatttgctcttgttgtgcgcactctacagtgtcgtagataaagctctgatacttacagcagtcctttctagtacatgtatcatcttgacagcttcaagagcattaaaaatgttgttttttttttccccactcagtggggggggggggggcctttcaaantaattctcatcccttccggttatttgccccagttaaaaaaaacaaacttgtcctgagccgctcggggggacccccatttccccccctaaaagggggggttcccaactcccccggctgccttcacttggcccagtcccctttttaaacctgtacttggaccgggggtaaatccccctggcggtttcccccacgctacattccccctgtggcaacgccatccccccttttccgtccgactagaacccgcaaagcgcgagaagagcccccctctcccaacgcccccccctccaccaactatttccgcctgacgcacttgtaataggggcgccttggtgcatttatgtccaccccn

SEQ ID NO: 66809 - DNA, 866 bp, Zea mays
  misc_feature: Ceres CLONE 1540281
  misc_feature (1)..(1): n is a, c, t, g, unknown, or other
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (302)..(302): n is a, c, t, g, unknown, or other
ntttttttttcntttttttnnnnnnnccnnnnnnnnggggggnnnnnnnntccctggagctccccccggtggcggccgctctatactagtggatcccccgggctgcaggaattcttctcacccctagaaaaaaaagcgaaaggagagaaggaatccgatccatccaagccaagccaaggcagagaagaaaaaaaagaggaggaaaattatgcctcggcggcgtggcggaggggactgccctctgcgtggacatcctgatcgccctcatcctgcctccgctggcggtgttcctccaatacggnggccgcccccagttctggatctgcttcctccctctctttccccggggaggggggcgggatccttctaccccctctttctttttcacaaagaacaacttagcccagccatctttttttttttccccccccccccgggggaaaagaaaagggaacttcccccttccttttttccccaatttttttcctcccacctcaaaaagaaaaaaaaccaccctccttctcctggggcgccggacgaccccactcacacacttccctacccactacaatccgctactgcggacccgcacctgttccccccgtctacgcataagaaccaccagaactccctcttcttccataactcctatgttacccccccacctagccccttatcttcctcgcccccctgtttttctgtaccagcgcccccgcgcggccacgcggtggagatggatgcgtcgcccgcttccacccccacgtccctcccccttgtgcgccccccaccgcacccagccacccctccgtccgcacggtctggcccccgcgtcagggtccaccctgtgcccacgcccctccccattc

SEQ ID NO: 66810 - DNA, 603 bp, Zea mays
  misc_feature: Ceres CLONE 1540282
  misc_feature: Encodes the peptide sequence at SEQ ID NO. 66811
  misc_feature (117)..(117): n is a, c, t, g, unknown, or other
  misc_feature (236)..(236): n is a, c, t, g, unknown, or other
  misc_feature (245)..(245): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (277)..(277): n is a, c, t, g, unknown, or other
  misc_feature (283)..(283): n is a, c, t, g, unknown, or other
  misc_feature (305)..(305): n is a, c, t, g, unknown, or other
cccgcggtggcggccgctctagaactagtggatcccccgggctgcaggaattcgtctcacccctagaaaaagcccgcctccctccgtccactcggatccggaaaaccctaaccctangacgtcgcccggccgccgcatggacccgacggcgacccggccttccccgcaagaggccatctccgcggtcaggatgtcgacagtactatggcgacgacgacgacttcgacgacctctancacgacgtncacgtcggggacggcttcnnntcacgctcctnacaggngccgccgccgctgccgctgccngcgccacctccgactcagcaggcccccacgccgcagaagcaccagctcccttcggcgtcccagaagctgccggccgccccagaagcaatcaccttgcccagttccttccgccaccgccccccccagccccacccgcccaaaaaacaggggaacctccccgggggggggcttccttgtccctgggaaaattcccgcccaaaaaaaatttccttcccccgccttaaaacccgggggttttttcgggggggggggggcgggttttttggcccccctatttttttcgagaagggggggtaac

SEQ ID NO: 66811 - protein, 199 aa, Zea mays
  misc_feature: Ceres CLONE 1540282
  misc_feature (39)..(39): Xaa is any aa, unknown, or other
  misc_feature (78)..(78): Xaa is any aa, unknown, or other
  misc_feature (88)..(88): Xaa is any aa, unknown, or other
  misc_feature (92)..(92): Xaa is any aa, unknown, or other
  misc_feature (94)..(94): Xaa is any aa, unknown, or other
RGGGRSRTSGSPGLQEFVSPLEKARLPPSTRIRKTLTLXRRPAAAWTRRRPGLPRKRPSPRSGCRQYYGDDDDFDDLXHDVHVGDGFXSRSXQXPPPLPLPAPPPTQQAPTPQKHQLPSASQKLPAAPEAITLPSSFRHRPPQPHPPKKQGNLPGGGLPCPWENSRPKKISFPRLKTRGFFRGGGGGFFGPPIFFEKGG

SEQ ID NO: 66812 - DNA, 665 bp, Zea mays
  misc_feature: Ceres CLONE 1540283
  misc_feature: Encodes the peptide sequence at SEQ ID NO. 66813
ggatcccccgggctgcaggaattcgtctcacccctagaaaaaattcccctctccactagctccggtccgaagagggagggaggaccggaggaggacgcccgttgccactgccgcgccgctcccgcctccctctctccatccgccgagctcgagaaggcaccatgatctccgcgcgcaccgccgcagcttcccccgcttccctgtggaagcagggaggacgaagcgagggcggcggcagctgcgacggatgtcggacttacaggaacactttgcggagggccgcagcagcgaaggtgcgtgccttgccatcaagggcggtggaggcggtcaaaatgggctccgcccgcggagatggagcaggaggaggccgagggggccgcggccgcggccggggtcctcgtctaggaccactacgggggaggactgcgcccccggggaagctgcccatcctggccctgggccctgttccggacccagggggttacacccctggtggggggatcccctttccacacaaggggttttgcctttcctggaaaaaagggaagggatgcccccccctttggggggggggttgcttcctccctgcggttttggccttccagaaactccgagattagagaagattcgggctccaacttggggcgcggagcacaggggtctgt

SEQ ID NO: 66813 - protein, 152 aa, Zea mays
  misc_feature: Ceres CLONE 1540283
MISARTAAASPASLWKQGGRSEGGGSCDGCRTYRNTLRRAAAAKVRALPSRAVEAVKMGSARGDGAGGGRGGRGRGRGPRLGPLRGRTAPPGKLPILALGPVPDPGGYTPGGGIPFPHKGFCLSWKKGKGCPPLWGGGCFLPAVLAFQKLRD

SEQ ID NO: 66814 - DNA, 681 bp, Zea mays
  misc_feature: Ceres CLONE 1540284
  misc_feature: Encodes the peptide sequence at SEQ ID NO. 66815
  misc_feature (402)..(402): n is a, c, t, g, unknown, or other
  misc_feature (403)..(403): n is a, c, t, g, unknown, or other
  misc_feature (681)..(681): n is a, c, t, g, unknown, or other
tccccgcggtggcggccgctctagaactagtggatcccccgggctgcaggaattcgtctcacccctagaaaaaaagaaaaaatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgnnccccaccctgatcgtgtcgtcgcccagcgccgccgaggccctgatgcgcacccacgaccacatctttcgcgtcccggccgttggtccatggcctcccccattctccgttacaacacctgcgacggggccttctccccgctccgggaatactggcagccgaacaggaagctgaataacaccccacctgctccacaaacaagaagggctactcctttccccatggccccaaggaaaaaggttgctcctttctggaaaacttcccggaaggggccgcaagn

SEQ ID NO: 66815 - protein, 193 aa, Zea mays
  misc_feature: Ceres CLONE 1540284
  misc_feature: SWISSPROT Homolog: EC 1.14.13.68 4-hydroxyphenylacetaldehyde oxime monooxygenase
  misc_feature (101)..(101): Xaa is any aa, unknown, or other
MALQAAYEYLQQAVGHGAWSSTQTLTLLLIAVPTVLLLLASLAKSTSSSGKGKPPLPPSPPGTLPIVGHLHHIGPQTHISLQELVAKYGHNGFLFLRAGAXPHPDRVVAQRRRGPDAHPRPHLSRPGRWSMASPILRYNTCDGAFSPLREYWQPNRKLNNTPPAPQTRRATPFPMAPRKKVAPFWKTSRKGPQ

SEQ ID NO: 66816 - DNA, 650 bp, Zea mays
  misc_feature: Ceres CLONE 1540289
  misc_feature: SWISSPROT Homolog: EC 3.2.1.23 Beta-galactosidase
caccgcggtggcggccgctctagaactagtggatcccccgggctgcaggaattcgtctcacccctagaaaaatgtactgccctaataagtggtgcttatgaggactgtttctggttttgctgcttatgttgtaatgctttgaaacaatgaaagaagctacaggccacagctattttgagaagtaatggaacctcgtgccgttttgattatatcgcaaaaaaaaaaaaaaaaacgagacgctcgaggtacccaattcgccctatagtgagtcgtattacgcgcgctcactggccgtcgttttacaacgtcgtgactgggaaaaccctggcgttacccaactttatcgccttgcagcacatccccctttcgccagctggcgtaatagcgaagaggcccgcaccgatcgcccttcccaacagttgcgcagcctgaatggcgaatggaaatgtaagcgttaatatttttgttaaattcgcgttaaatttttggtaatcagctcatttttttaaccaataggccgaaatcggcaaattcccttaaaatcaaaaaatagaccgagatagggtgaatgttgtccagtttggaaaaagaatcactattaagaacgggactccacgtcaaagcaaaaaacctcaacagggcatggccat

SEQ ID NO: 66817 - DNA, 758 bp, Zea mays
  misc_feature: Ceres CLONE 1540296
  misc_feature (228)..(228): n is a, c, t, g, unknown, or other
  misc_feature (232)..(232): n is a, c, t, g, unknown, or other
  misc_feature (501)..(501): n is a, c, t, g, unknown, or other
acccgcggtggcggccgctctataactagtggatcccccgggctgcaggaattcgtctcacccctagaaaaacctttttttgtttttgtttttgtttttgacagtgtatgtaagagctgtccacaagaaaatttacaagtggtgtaacctgccctcgtttgtacattgtactactactacatgacaatcatatgtcctttgtctttatccaaaaaaaaaaaaaaaagnacgncccgatcacttaccaaaaggaaaaaaaaataaaaaaacgagacgctcgaaggtacccaattcgccctatagtgagtcctaataccgcccgctcactggcccgtcctttttacaaacgtcgggactgggaaaaacccctggtctttaccccaactttaatccccccttgcggacatattcccctcttttccccccagctttgcggttaaataaccaaaaaaagccccccccacccgattccgcccctttcccaaaacaatttgtgcccancccctaaaaagtggccaaaagggaaaaaatttgtaaaccgctttaaaaaatttttgtttaaaaatttccccgcaaaaaattttttttgtaaaaaaccaccccccctttttttttaaacaaaaaaaggcccaaaaaatcggaaaaaatcccctttataattcctaaaaaaaaaaaccccaaaaaggggtgtgaagggtttttcccaattttgaaaaaaaaaaccccccattaaaaaaaagggggccccccaccccaaa

SEQ ID NO: 66818 - DNA, 787 bp, Zea mays
  misc_feature: Ceres CLONE 1540298
  misc_feature: SWISSPROT Homolog: EC 3.2.1.23 Beta-galactosidase
  misc_feature (23)..(23): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (245)..(245): n is a, c, t, g, unknown, or other
  misc_feature (251)..(251): n is a, c, t, g, unknown, or other
  misc_feature (252)..(252): n is a, c, t, g, unknown, or other
tttttccttcccccccccaccancccatncaccnnnnaccacaaggnattctactggagctccccgcggtggcggtcgctctatactagtggatcccccgggctgcaggaattcgtctcacccctagaaaatgattatttgttgtctcatactgtttacctgagtattgtttgcaagtgctttatcactgtccgaactgtgcatgcaattcaatggtctagagaattgttcgtggattgtttccnacctcnncctactgaattaaaaaaatcaaaaaaccacctatctttaaaacaagaattatatttaaacacccgagacgctccgaggtacccaattcgccctatagtgagtcgaattacccccgctccctggccgtccttttaccacgccgtgcctgggaaacccctgtcgttccccaacttaaaccccttgaaggacatccccctttcgccaactggagaaaaaccgaaaaggcccgcacctatatcccttccacaaagttgcaccgcttgaatgcctaacggaactgttaccccctttactcttttgtcaaaatctctctttaaattttttgtcaacccgattctccttttttaacccaataagcccaaaaagtcgcccaaatccccccttttaaatcccatatcaatcaccccccgaaattttgggggtgaaaagggtttgttcccattttttgtaaaccaagaaccccccccttatctcttaaataaacccgtgttacaccccgctaccctccacaatagaggttttaataaaaaaatca

SEQ ID NO: 66819 - DNA, 679 bp, Zea mays
  misc_feature: Ceres CLONE 1540303
  misc_feature: Encodes the peptide sequence at SEQ ID NO. 66820
tccccgcggtggcggccgctctagaactagtggatcccccgggctgcaggaattcgtctcacccctagaaaaagtatcgggcaggggctgcaacccaagctgtgcgggcgcggcagggcagcggcggcgacatctgcatctgcatctcccacctcgtctccctcccgcatctgccctgcctcgatcccgccgccagccatcaaacggagccgggagccatgtctccctccggcgagctgctggcgtccatctcctccgctctcgccgtggacttcgtcttcctcgcctgcgtcgagctcggcgacgccgccgccagcttcagcgtctaccgcctcatccagtacgacctcgccggcgccccgctcggctcccgcgccgcggtcctaaatcaccacgccacgccgctcccggtccctgccggcgcagacatctcccgctccgcgctcgtcgcgccgctcctggacctttcgctctcgttcctcagagagtacctggtggagaaaaaacagctggtgggattgctcattttgctcccgacaaaccagggtgataaggatagtgcggatgacaaaggtcaagtcaaatgtgtactgactgagctggagaagttgcttgtgcacgaacgagtccatatccagcggactttgctttggatgacgaccattttggtaacctgctg

SEQ ID NO: 66820 - protein, 153 aa, Zea mays
  misc_feature: Ceres CLONE 1540303
MSPSGELLASISSALAVDFVFLACVELGDAAASFSVYRLIQYDLAGAPLGSRAAVLNHHATPLPVPAGADISRSALVAPLLDLSLSFLREYLVEKKQLVGLLILLPTNQGDKDSADDKGQVKCVLTELEKLLVHERVHIQRTLLWMTTILVTC

SEQ ID NO: 66821 - DNA, 685 bp, Zea mays
  misc_feature: Ceres CLONE 1540305
tcccccgggctgcaggaattcgtctcacccctagaaaaatttttcgagctctaagacaagtactactgatccttgcgcttcacacgccctcttgctccctgcgtgttcttgattcggcctcaaaatttgttgcctgttttctcgtggtaacgaactatcttccctacttgttagttgttaggggatgggacgtttttttatttctccttgaaatttatatgcatgctaatttgtttgattctttttgcagtttgaggtgatatctcggttcttaaaatctgccagatttcttctccccgtttgtttggacaaatttgggaaccaaccctagtctgtgtgtgaagcctccaaagtggtgtgtctggccccccccaagcaaagcttaagcgttgcgccgtttggttaggaatcctgtagatacggaagggggtttgttgaattcttgtaaagaacacttcttttatagctgaatatcttttttttccattcaattgggggcccggtttttccggagttccgcccttctttggatttaagccctctcaatttccaggtttccggcccggcaccattcccttcaagtgacccagaacccttttggtcttgggcctggtagaattatccccccccccgggatggggccctaggagaaatttaagaccttcctgggggaaaaagaaaaaat

SEQ ID NO: 66822 - DNA, 736 bp, Zea mays
  misc_feature: Ceres CLONE 1540306
  misc_feature (220)..(220): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (437)..(437): n is a, c, t, g, unknown, or other
  misc_feature (736)..(736): n is a, c, t, g, unknown, or other
cgctctatactagtggatcccccgggctgcaggaattcgtctcacccctagaaaaatagtgtatggttttccacttagtttaagtctttttagctcttatagaaaggactatctgtgtctgtatgatgaggaagtttcacttaggtgtttttttctgatgccaaggaccactgcatgataatgagataggtatatgtgctatggttggtacagcccttgntaatgctttctttagtgcacctttgtttttgtgcaactttatttttcaaggaaaccaaaagcttaaaaaannnnnnnnnnnnnnnaaannannnnnnnnnnnnannnnnnnnnntatttttttattttaaataataaaataaagagaagaggcgatatatattttatttatttttttttgttgtcccccccggggggcattcgttgataatataatntaattttttggcgggggccccccgggggacccccccaccccccccccttaagggggcgctataataaccccgccccccctcgggccgccccttttttataaaaaaccgcgtgggggggagaaaaaaccctcggggggttcccccaattttattatcccgttggtggaaaatccccccctctctttctccaggtggtggtaataaaaacaaaaaaaaaacgccccacaaaattaccccctttcccacaaaaatttgctccccccccccaatgggggcagaaaaaaattatctcttacccn

SEQ ID NO: 66823 - DNA, 651 bp, Zea mays
  misc_feature: Ceres CLONE 1540307
  misc_feature: Encodes the peptide sequence at SEQ ID NO. 66824
gcggtggcggccgctctagaactagtggatcccccgggctgcaggaattcgtctcacccctagaaaaaagctgcgtctgcgtctgcgtcgtggccggcgcggcgctgcgctgcgcggaaaccaaatcctcagctccggtgttctctccaatctccatccatccatcctcctcgcggctcgcgccccgaaaaatggcgccaacccctccccagtctcccgcgcggcgctgccccagctatttccccctcccctgaattgaccccagccgcgcctcccaaaccctaacctaacccccgccccctgggccccggccatggcgtcactgcccaagccgccgccgccgccgcgccccaagacgaggggcaactacaactgcggccgctgcggccagcctaataacccccacgtctgcgtcggccccggccccggccccggcgccgctgcgtcgccctcctcctcgtccggggccggaggggagcacgggctgcgccgcgccctctccttcgacgaggccggcacgccgtcctctccggaaaagaagcccaatgtggaggacgtcgacgaagcggagctggacgaggaggccacggtggacgtgggcgctcgcgcggtgtccaggtaggtcatggcggaggttctgcaccgcctcgg

SEQ ID NO: 66824 - protein, 102 aa, Zea mays
  misc_feature: Ceres CLONE 1540307
MASLPKPPPPPRPKTRGNYNCGRCGQPNNPHVCVGPGPGPGAAASPSSSSGAGGEHGLRRALSFDEAGTPSSPEKKPNVEDVDEAELDEEATVDVGARAVSR

SEQ ID NO: 66825 - DNA, 679 bp, Zea mays
  misc_feature: Ceres CLONE 1540308
  misc_feature: Encodes the peptide sequence at SEQ ID NO. 66826
tcaccgcggtggcggccgctctataactagtggatcccccgggctgcaggtattcgtctcacccctagaaaaaaggtgcaggcagcggataacgtgctaaagtgtcctcactgctgctctcctccgctccgcagctcatggcttcctcggtctccctccgtggcgccatcctccagcgcccccacctcaggccccgccccgacgcccgccgcgcgcccacgacgaggcgccgcgccgtgcctgcaaagatctgctgcatcggatgggaccccgagggcatcctgggcgcgccgcagggcggccacatcgcgcgcctcgagttccgccgccgcctcgagagggactccgaggcgcgcgaggacttcgagcgccaggtgcgcgaggagaaggatcggctccccaccgagcgcgaggcgcgggtgatccctgacacggacgccggcctcgtcgagttctttctccacaccgacgcgcgcgagatcgagatcgagatcggcaggctgcggcccaggttcagccaggactttcttcgggccacgtctcgcgcgaagaaagcgcaaaatcaaattttgcagtcaccaaggacacccgaaaaatggaaagacaaaactggatccgagccttgagggcgaaatccccaaagggtcctttcttctcaagggaatgttgaagggcgtta

SEQ ID NO: 66826 - protein, 162 aa, Zea mays
  misc_feature: Ceres CLONE 1540308
MASSVSLRGAILQRPHLRPRPDARRAPTTRRRAVPAKICCIGWDPEGILGAPQGGHIARLEFRRRLERDSEAREDFERQVREEKDRLPTEREARVIPDTDAGLVEFFLHTDAREIEIEIGRLRPRFSQDFLRATSRAKKAQNQILQSPRTPEKWKDKTGSEP

SEQ ID NO: 66827 - DNA, 665 bp, Zea mays
  misc_feature: Ceres CLONE 1540309
  misc_feature: Encodes the peptide sequence at SEQ ID NO. 66828
tagctggagctccccgcggtggcggccgctctttactagtggatcccccgggctgcaggaattcgtctcacccctagaaaaacccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcacaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccaaataaatttgaaaccagattgctgatgcgcaaaaaaaaaaaaaaaaacaaaacgctcgagggtaccaattcgccctatagtgagtcgtattacgc

SEQ ID NO: 66828 - protein, 62 aa, Zea mays; identical to SEQ ID NO: 6893
  misc_feature: Ceres CLONE 1540309
  misc_feature (3)..(61): Pfam Name: Ribosomal_S30 Pfam Description: Ribosomal protein S30

SEQ ID NO: 66829 - DNA, 684 bp, Zea mays
  misc_feature: Ceres CLONE 1540310
  misc_feature: Encodes the peptide sequence at SEQ ID NO. 66830
tccccgcggtggcggccgctctagaactagtggatcccccgggctgcaggaattcgtctcacccctagaaaaattctcaacagttctcaccgcgacaccgcccatcctctctccgacatcgattcgcgccgagccgccgaccacctgccgccgtctcctccttggtcccagccatggccggcggcgacggcgatcggcatcgcgcgccgaagcggcacaagtcctcgacgccgtcgaaagcggccctggtggacgagagcgccgagttcgactacgctgatgactttgatgacgacgcccacgatgctgatacggaggttaagaagagggattttacgaagctcgagttgaaggtggaccacgcgagccgtccgctctgggcgtgcgccgacagccgcatcttcctcgagaccttctcgccgctctacaagcaggcttacgattttctcatcgccatcgccgagcctgtgtgcaggccagaatctatgcatgaatacaatctaactcctcactcattgtatgctgcggtctcagtgggacttgagacaagcactatcatcagtgtccttgagtaaactatctaaaaccccagttgcccccgtgaataattgattttcatccatggatcaactgctaactacggcaaaggtcagctttgtcttggagaagacccgatattttgtg

SEQ ID NO: 66830 - protein, 133 aa, Zea mays
  misc_feature: Ceres CLONE 1540310
MAGGDGDRHRAPKRHKSSTPSKAALVDESAEFDYADDFDDDAHDADTEVKKRDFTKLELKVDHASRPLWACADSRIFLETFSPLYKQAYDFLIAIAEPVCRPESMHEYNLTPHSLYAAVSVGLETSTIISVLE

SEQ ID NO: 66831 - DNA, 652 bp, Zea mays
  misc_feature: Ceres CLONE 1540312
  misc_feature: SWISSPROT Homolog: EC 3.2.1.23 Beta-galactosidase
ggagctccccgcggtggcggccgctctataactagtggatcccccgggctgcaggaattcgtctcacccctagaaaaaatttgttaatcaatcaataacggtgaggtgaggttgctattgtatgaagtagtagtaacacctcaacaacaacaacccaatgcaatgggaactcgcgtgtaatttgctccttcttcttcaaatataattccgcctcaattgtatgtatgtatgtattacgtctgtccgtctgtctgcctgtaaaaactaaagctttttttgtttctttaaaaaaaaaaaaaaaaaaaaaaaaaaaaaaaaaaaaaaaataaaaaaaaaaaaaaaaccgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaaaaggcccgcaccgatcgcccttcccaacagttgcgcagcctgaatggcaaatggaaattgtaagcgttaatattttgttaaaattcgcgttaaatttttgttaaatcagctcatttttttaaccaataggccgaaatcggcaaaatccctt

SEQ ID NO: 66832 - DNA, 876 bp, Zea mays
  misc_feature: Ceres CLONE 1540319
  misc_feature (30)..(30): n is a, c, t, g, unknown, or other
aaacggcactttaccccccacatggctttnctcgcaccctggtcacccaacccaaaaacaagaactccccgcggtggcggccgctctagaactagtggatcccccgggctgcaggaattcgtctcacccctagaaaaagagccctgcctttcttctcccgttccccgcggcctgcgcgcgcgttctctccctcacctccgcccctttctctctctctctctctctctctctctctctctctcgccccccttatatcgcgtcatcatccaccccctcctctttggctactcgccaccccgttttctgcaggtctcctaccgcctcctcgcgcatcttctccccccccctccttaccccccttcgttatacccttaactcctggtcttcccgtcatatccctcccccccccctcgttgcctattttttttatacccccggcctatcgctattccctatattgggtaatctcgtgtttatttgcccccccccccccaccccattgtcgcccctcctaacattcgtttgtttgttatagactacgtggtcacgttattcgccgctgcgattcgacctcgtcacacatcacctaaatcccatgttcccccgacatcgcggtatatcataaatgacgccattcgggtgcactctccctcccgcgaacgccgctatttgctgcgccgcaaatgataattcccggccacgccatgactccgtattattcaccccggcgtccgctattcctttccccgttacgtaaaactaatttctcacataactgtgcctagcgttccccccattgcccttcagcgccggtatcttaaatgggtgaagctctgtataccttctatactttcacacccgccctttcttgttgct

SEQ ID NO: 66833 - DNA, 511 bp, Zea mays
  misc_feature: Ceres CLONE 1540320
gcggtggcggccgctctaactagtggtcccccgggctgcaggattcgtctcacccctagaaaaaaaaacggtggtatgcgtgtgaagaagaagatgatgacgacgaaaatagtgtgttggatcgatgggccagcacagtgtagactagcttttgtatattatctcgggtggaatctgtgtgtactaaatgtgtctgtcatcgcttgtgaacattgccggctgcaaaaaaaaaaaacaaagctcagtacattcgcctaatgatcgataccccgtcccggctccttttcactctggctggaaacctgggtaccaattaatccctgaaaatcccctttccagttggtaatacaaaagccccccattccccttccaaatttcccccctaatgggaaaggaattttaaccctatatttttttaaaaacccccggtaaaattttttttaaaacccccccttttttttaaaccacaagggggaaaaaacgggaaaaatccccttttataaaaaaaaat

SEQ ID NO: 66834 - DNA, 733 bp, Zea mays
  misc_feature: Ceres CLONE 1540321
  misc_feature: SWISSPROT Homolog: EC 3.2.1.23 Beta-galactosidase
  misc_feature (37)..(37): n is a, c, t, g, unknown, or other
  misc_feature (38)..(38): n is a, c, t, g, unknown, or other
ttgtgggcgcgcccccctcccatatttcgctcccccnnttttatccattcttttaaaactggtactccccgcggtggcggccgctctttactagtggatcccccgggctgcaggaattcgtctcacccctagaaaaatatgaaatatgtggcaggtgtcaataaagttatctcatacagcagacagttcgttccgtgtcacttctgtttaaaattaagttttgccgagacaagctatatgtaccggatgaaagtgtggttccttattgtatgctctggaattttatttttggtagaaaaaaatcaaaaaaagcaacaaaacaaaaaaaaaaacatcaactagcaaataccaaagaaaaattaaaaattaatcgagacgctcgaggtacccaattccccctatagtgagtcgtattacgcgcgctcactggccgtcgttttacaacgtcgtgactggaaaaaccctggcgtaacccaacttaatcgccttgaagaacatccccctttcgccagctggcgtaataccaaaaaggcccccaccaatcgcccttcccaacatttgcccaccctgaatgccaaatggaaattgtaagcgttaatattttgttaaaattcccgttaaatttttgctaaacccccctcttttttttaaaccaaaaggccaaaatcgccaaaatccccttataatccaaaaaatataaaccggaaataggggtggaagtgtgtgttcccat

SEQ ID NO: 66835 - DNA, 673 bp, Zea mays
  misc_feature: Ceres CLONE 1540322
  misc_feature: Encodes the peptide sequence at SEQ ID NO. 66836
ccccgcggtggcggccgctctagaactagtggatcccccgggctgcaggaattcgtctcacccctagaaaaaatccactagctgcccggccggccggctagcggagaaacagcccgcccgctcgcctctgcctctgcccctgcacgcccaagatcctcaggccgggccggccgcgtggcagtgccgcgcgcgcgcgagagcgagagggatccatgggcgtctccgaggaggcggcgcgggtgtgggcggagctgcccgtgcgggtggactgggcggccgcggcggcgcaatgcgcgtccctgtgggcgcacgcgcgcgcgctgctggtcgcgccagcggtgcgggtcctggtgctcctgtcgctggcgatgaccgtgatgatactggcgagaagctgttcgtctgcgccgtgtgcctcgccgtgcgggcgctccggctcggcccggaccggcgctaccgctgggagcccatcggcggcggagtcggagacgaggaggaggagtccgggtccggccacggcgccaagtaccccatggtgctcgtgcagatccctatgtacaacgagcgggaggtgtacaagctgtcgatcggggcggcatgcgagctggagtggccgtcggagcgcttcatgatccaggtgctggacgactccacggagcccgttgtacaggag

SEQ ID NO: 66836 - protein, 128 aa, Zea mays
  misc_feature: Ceres CLONE 1540322
  misc_feature: SWISSPROT Homolog: EC 2.4.1.12 Cellulose synthase (UDP-forming)
MRVPVGARARAAGRASGAGPGAPVAGDDRDDTGEKLFVCAVCLAVRALRLGPDRRYRWEPIGGGVGDEEEESGSGHGAKYPMVLVQIPMYNEREVYKLSIGAACELEWPSERFMIQVLDDSTEPVVQE

SEQ ID NO: 66837 - DNA, 566 bp, Zea mays
  misc_feature: Ceres CLONE 1540323
  misc_feature: Encodes the peptide sequence at SEQ ID NO. 66838
  misc_feature (280)..(280): n is a, c, t, g, unknown, or other
aaagctggagctccccgcggtggcggccgctctagaactagtggatcccccgggctgcaggaattcgtctcacccctagaaaaaatccattcccagctactgcaggtgtgcaagcctgagccatccattgggctccgtttccacccaatccaatggcgctcatgctctccctcgccgcgccagcagctgcacccgcggcctacacatgccgctgcagcatcgcaagcttcatccggccggcggtctcagatgggagcagctgggcaggaccaccgctgcntgtggccatggcctacctgctgggcgacttggcgcggcgacccctccccgagagatccagagcaatttgggaaaaagtgctggccacgtggaacgctccacagaatcttgtccccacctttcccagggtttcccttttgaaacctcccgttaaacccaaaacggaaacccttttccctggaaaagagccgagggggcccctttaaggaggaagggggaaaggttctccccctccggggggaaaagagaaaaaaaaagggcccccccgcccaaaaaaaggcccttag

SEQ ID NO: 66838 - protein, 110 aa, Zea mays
  misc_feature: Ceres CLONE 1540323
  misc_feature (43)..(43): Xaa is any aa, unknown, or other
MALMLSLAAPAAAPAAYTCRCSIASFIRPAVSDGSSWAGPPLXVAMAYLLGDLARRPLPERSRAIWEKVLATWNAPQNLVPTFPRVSLLKPPVKPKTETLFPGKEPRGPL

SEQ ID NO: 66839 - DNA, 711 bp, Zea mays
  misc_feature: Ceres CLONE 1540331
  misc_feature: SWISSPROT Homolog: EC 2.7.11.1 Non-specific serine/threonine protein kinase
ggcggccgctctataactagtggatcccccgggctgcaggaattcgtctcacccctagaaaaattttttctttgagaaaattcgcccgcgagatctttagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatagagaggcggttcctttgcgggctctgaggttcagctctcgctcttgatttgtctcatcgacgcatcagttggcccccaggcttagagctggaaggaataatttgactagagaaatggggcagtgttgtagcagagctcccgcccccggactcctggacggggagggcaccaatggttatggctattctaaccaggccaaagccagcgccaaaacaccttcgagttacaacccctccctcaccagcccggcccaaggggagggaacacgcccccccggcgaagaaacccccccgggtagtcccccccttgtggccctggggccccccggaaacccccccgggggggaaacccgattttctttgggcaaaacaggatcccaagggaacctttggccc

SEQ ID NO: 66840 - DNA, 656 bp, Zea mays
  misc_feature: Ceres CLONE 1540332
  misc_feature: Encodes the peptide sequence at SEQ ID NO. 66841
tccccgcggtggcggccgctctagaactagtggatcccccgggctgcaggaattcgtctcacccctagaaaaatcttgagaaagaactcctcgtcctcgctccctccccaaccatcaagagcgcacacgcacacgcacacgccgcgcgcaagccggccgacgtacggcatggagaagagcgctacaactggcggcggttcaagcagcggcggcggagaggctgcggaggaggcgaaggtgcctctgctgcagccgagggctgcggcggcggccgcggcggccgaggaggaccatggaggaggaggaggagacgacggcaaggcggcgtcggcggcggcggatgaggagggcagggacgcgtcgtggtcgtcgctgccgctgcggcggcgcgcgtgggaggagaacaagaagctgtgggtggtggccgggccgtccatcttcacgcgcttcgcgtccttcggcgtcaccgtcatcagccaggccttcatcggccacatcggcgccaccgagctcgccgcctacgcgctcgtctccaccgtcctcatgaggttcagcaacggcatcctgctgggcatggcgagcgcgctggagacgctgtgcgggcagtcgtacggggcgaagcagtaccacatgctgggcatctacctgcagcggtc

SEQ ID NO: 66841 - protein, 162 aa, Zea mays
  misc_feature: Ceres CLONE 1540332
MEKSATTGGGSSSGGGEAAEEAKVPLLQPRAAAAAAAAEEDHGGGGGDDGKAASAAADEEGRDASWSSLPLRRRAWEENKKLWVVAGPSIFTRFASFGVTVISQAFIGHIGATELAAYALVSTVLMRFSNGILLGMASALETLCGQSYGAKQYHMLGIYLQR

SEQ ID NO: 66842 - DNA, 750 bp, Zea mays
  misc_feature: Ceres CLONE 1540334
  misc_feature: Encodes the peptide sequence at SEQ ID NO. 66843
ggcggccgctctagaactagtggatcccccgggctgcaggaattcgtctcacccctagaaaaagtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgcttgccggcggtggggcgtctacccgatcaactttgtcttggccctgttcccggcagaatctttctgcgggggagcttgggaaacccgggagcttggccgccgcggtcgctcgggaaaaaccggggattccgggcccctcggctcaacgggcctcatgcctggggaataggggccccccccggtggaaaaaccccttgggcgggaaggggttaccgggcccgcccacaaacacggcattgcgggggggggtggacacctcgcaaacgggccaaaaggggttttttttatggggcacccccccccaggccttcttgaaacggggggggtataaccttattttgcggggccgcatattctttgggggccccttgtgggggaagcg

SEQ ID NO: 66843 - protein, 194 aa, Zea mays
  misc_feature: Ceres CLONE 1540334
MDSTTTTTAPLLQPAAAASSKEEPAPASPHGAGSWELEAVLADASSPVLRRAWEGARLELPLLLRVALAGGGASTRSTLSWPCSRQNLSAGELGKPGSLAAAVAREKPGIPGPSAQRASCLGNRGPPRWKNPLGGKGLPGPPTNTALRGGVDTSQTGQKGFFLWGTPPQAFLKRGGYNLILRGRIFFGGPLWGK

SEQ ID NO: 66844 - DNA, 664 bp, Zea mays
  misc_feature: Ceres CLONE 1540335
  misc_feature: Translation starting site: 147
  misc_feature: SWISSPROT Homolog: EC 4.3.1.5 Phenylalanine ammonia-lyase
tgtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaaggacgcgtccggcgtcgccgtcgagctcgacgaggaggcccgcccccgcgtcaaggccagcagcgagtggatcctcgactgcatcgcccacggcggcgacatccacggcgtcagcacgggctttcgggggccctccccccggcggaacaaggaacgggccgcggtccaggttgaggtgctcaggcattttaaagccggaaatttctggaccgggagacaacggggaccccccttgccgttggaaggtaacccattttcggcgaagcttgggagccaaataaaacccctttctcccgggggtatctcgggggatccggtttttgaaaacctctcgg

SEQ ID NO: 66845 - DNA, 738 bp, Zea mays
  misc_feature: Ceres CLONE 1540339
  misc_feature: SWISSPROT Homolog: EC 3.2.1.23 Beta-galactosidase
aataaacaaaacaccacacaaacaccaatctttttttttattctccctaatactggagctccccgcggtggcggccgctcttttctagtggatcccccgggctgcaagaattcctctcacccctagaaaaattataaccaggagtgcacgacatacagttaatcaaaatgttatagtatttgctgtacaattcacgcagtgttaagctggagataccaaagttgtaggcaatccatgtccaaatgctcagtgcacttggtttggaacacatttgttttctgcaatttgtgattaatcatccagctttaacccagatggtatgctaccagattgcagcagatgcagcaaacagcctagcaccctgctactgctttaataaatcctgcctggagtcattaaatcagttttgcaaaaaaaaaaaaaaaaacgagacgctcgaggtacccaattcgccctatagtgagtcgtattacgcgcgctcactggccgtcgttttacaacgtcctgactgggaaaaccctggcgttacccaacttaatcgccttgcagcacatccccctttcgccagctggcgtaatacccaagaggcccgcaccgatcgcccttcccaacagttgcgcagcctgaatggccaatggaaattgtaagcgttaatattttgttaaaattcccgttaaattttttgttaaatcagcctcatttttttaacccaataaggccaaaaatcggcaaaaatct

SEQ ID NO: 66846 - DNA, 677 bp, Zea mays
  misc_feature: Ceres CLONE 1540341
  misc_feature: Translation starting site: 174
  misc_feature: SWISSPROT Homolog: EC 3.2.1.23 Beta-galactosidase
ggagctccccgcggtggcggccgctctatactagtggatcccccgggctgcaggaattcgtctcacccctagaaaaaattgataagacctcctcgattgtagccaatattttattgcaaataattccgacaacctccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacgtgcgactatctccactataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaa

SEQ ID NO: 66847 - DNA, 693 bp, Zea mays
  misc_feature: Ceres CLONE 1540345
  misc_feature: Encodes the peptide sequence at SEQ ID NO. 66848
gcggtggcggccgctctagaactagtggatcccccgggctgcaggaattcgtctcacccctagaaaaaaaggtcacttctcccgatgacatggcactccatgcagccttagagtacctgcagcaggacggcggccatggtgcgtggtcgtctctcagcacagctgatgctggtgctcatcgctgtcgccaccgtactactgctgttagcttccgtcgtctgcagcacgtcctctgacggtgaggggaaggtgtttctcgctctgtcggctccgggaactctccctatcgtgaggcaccttctgacatcgagcaccagatccacatctcgctccttgagctagtgggcaagatgggcatcgacggatcctgtgctacgcgcactgcgacgccccacctctgatcgagctatcacgtagttgctgctagacttgatgcacgcccattgacacagattcgggttcgggacggagagccatgggtgccattccttctttaaaaaccttgcaactagtccttctcatcttttcgaaaagtattggctttctatgcggaaggagatgtaggcgcacctttccttggtaaaacaaagggccttagcccttgccgtcttgaccgccaaacaaaacgggtgtccccccacctttgaaaatcctccacccaaggaggaacggtcaatttttccctgtgaaagg

SEQ ID NO: 66848 - protein, 68 aa, Zea mays
  misc_feature: Ceres CLONE 1540345
MVRGRLSAQLMLVLIAVATVLLLLASVVCSTSSDGEGKVFLALSAPGTLPIVRHLLTSSTRSTSRSLS

SEQ ID NO: 66849 - DNA, 734 bp, Zea mays
  misc_feature: Ceres CLONE 1540346
  misc_feature: Encodes the peptide sequence at SEQ ID NO. 66850
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (660)..(660): n is a, c, t, g, unknown, or other
  misc_feature (662)..(662): n is a, c, t, g, unknown, or other
  misc_feature (664)..(664): n is a, c, t, g, unknown, or other
  misc_feature (667)..(667): n is a, c, t, g, unknown, or other
  misc_feature (672)..(672): n is a, c, t, g, unknown, or other
  misc_feature (673)..(673): n is a, c, t, g, unknown, or other
ggcggccgctctataactagtggatcccccgggctgcaggagttcgtctcacccctagaaaaagtctccgctttcccacttggcgcgagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctaccaggtggcggttgacccggatgaggggcggcggcggcgcgaggacaatatggtggagatccgcaagagccgccctgaggagagccctctcaagaagcgcggtgagggcccccccaaccaaggttcctgccccttccctccggggtccagaaaaaaccttgaaacccttccccgctatggtagggggttgttcggatgtaataacttatggtgggggcactcctgttcggaatggtctctaaaaggggccccccatgagaattataaaaggggggtccaaattgtgcattcccccgaaggctccccccctccttttagcccggttcatgtgccaacgttgcgctcttatacttgtcgggnnnnnnnnnnnnaaaggnanantgntgatnnagaaaggattaggggcattatagtaaaccgctttctttcagcagcccatttttgttttttg

SEQ ID NO: 66850 - protein, 166 aa, Zea mays
  misc_feature: Ceres CLONE 1540346
  misc_feature (4)..(85): Pfam Name: IBB Pfam Description: Importin beta binding domain
  misc_feature (136)..(136): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (146)..(146): Xaa is any aa, unknown, or other
MSLRPSERVEVRRNRYQVAVDPDEGRRRREDNMVEIRKSRPEESPLKKRGEGPPNQGSCPFPPGSRKNLETLPRYGRGLFGCNNLWWGHSCSEWSLKGAPHENYKRGVQIVHSPEGSPPPFSPVHVPTLRSYTCRXXXXXRXXXDXERIRGIIVNRFLSAAHFCFL

SEQ ID NO: 66851 - DNA, 694 bp, Zea mays
  misc_feature: Ceres CLONE 1540351
  misc_feature: Encodes the peptide sequence at SEQ ID NO. 66852
  misc_feature (352)..(352): n is a, c, t, g, unknown, or other
tggagctccccgcggtggcggccgctctagaactagtggatcccccgggctgcaggaattcgtctcacccctagaaaaaaagttccccacccatatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccnatggctcgtcttggaaacctgcacttcagtaggccatctatcgtggtttctagctatatccagagttttgtgctaagacaaatcagtcagtcggtttggtgaccttattatgaagggacctttatttgctggcaataccggccctaccctggtaagtaaaaaaaaaaaaaaaaaccggaacgcttcgggtcccccattcccccctaaagggggcccaatttaccccgcccccctgggcccgcctttttaaaacggccggggcgggggaaaccccgggggtttcccacatttaaccccctttggggaaaatccccccttttccccgggggggggaaaaacgaa

SEQ ID NO: 66852 - protein, 47 aa, Zea mays
  misc_feature: Ceres CLONE 1540351
MSHPSSSSPFAMGPMARLGNLHFSRPSIVVSSYIQSFVLRQISQSVW

SEQ ID NO: 66853 - DNA, 704 bp, Zea mays
  misc_feature: Ceres CLONE 1540356
  misc_feature: Encodes the peptide sequence at SEQ ID NO. 66854
ggagctccccgcggtggcggccgctctagaactagtggatcccccgggctgcaggaattcgtctcacccctagaaaaaccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaagagcggaagaacagggccaagaagatccgcggtgtcgagaagaccaaagctggtgacgccaagaagaagtacacgttcgtttacatttgtattactgttctgggctctgggtggtctagctgcaatgtcataattatggtcgtgttaaggttttgttccacccttggcactgaaatgattttttgcaccccctcggccctgaagtgaagtttttgtcaaatattgcctcctaacataattgccccgtcccttgttctatttgtggcgcaaaaaaaaaaaaaaacccaaacgctcaaggtacccattcgccctaatgggaatcgtattaccccccctccctggccgttccttttacaaccttcgggactggggaaaacccttggcgttaccccaaatttattcgccttggaaaaaactcccccccttttctcccaagttggggataaaaaaacaaaagagggccccgtacctatattccctt

SEQ ID NO: 66854 - protein, 70 aa, Zea mays
  misc_feature: Ceres CLONE 1540356
MKERKNRAKKIRGVEKTKAGDAKKKYTFVYICITVLGSGWSSCNVIIMVVLRFCSTLGTEMIFCTPSALK

SEQ ID NO: 66855 - DNA, 691 bp, Zea mays
  misc_feature: Ceres CLONE 1540362
  misc_feature (292)..(292): n is a, c, t, g, unknown, or other
  misc_feature (312)..(312): n is a, c, t, g, unknown, or other
tcaccgcggtggcggccgctctagaactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaagggggcgggggggtggancaccaggggatgctagaggngaagccgccgtcgccggggctcctccggcggggccgggggcggcggtatacattcacgctcactgccggtgggggggggccgcttctttgcttcccccccccccgcgcatccatctctcagctttgcggaggggttttgtttggcattctgccaggaaactaggaccgaaccatattacgaagttcccttgcgtggccttctgcagacgcccctcttcccccctaggcgaagttccccgaataatatggtgggccaacacggatacccccgcccggggccaacgggccaggaagtgcaacatatcgtgtttggagccacaaggggggtacaaaacataagctctgcccagaacctcctgggccgagaaatagagtgggg

SEQ ID NO: 66856 - DNA, 635 bp, Zea mays
  misc_feature: Ceres CLONE 1540363
  misc_feature: Encodes the peptide sequence at SEQ ID NO. 66857
agtggatcccccgggctgcaggaattcgtctcacccctagaaaaaacgagaccgttcaccgggacgagctctcttgcgcgtgcccccgtcctccccttccacctccacctccacggcgcccgatgtaacgtcaccacgccacattcattgcgagcaccaacggtccccagccctctaattaagctgtctgcttccggcgatcctgtgtcctcctgctgctccgctagatgaggatcacgaagaggaacgcggtcgcgggtcggaacactgttcgaactacatcgccgggccacgctcacaccactaggtcgccgatcagctcggacgtttaagataataggcagcagcctcctgccatagaggataatccccccccccacgggttgcaccagatgagaatcctcctaaggaagataagccccacccgttgatgttgaagggccccatgctgaaacagatgatgaccagaagaaacctgtccctgactattatgggaggagcaatggtatcaccggcgcggtatggcctcaccacggagagtgctccggccaaaaaccccggcgtgcgatcaccaaaggcccggtgggccgtcccacctttgccaaaatccactggcgacgcgccagtatccccgg

SEQ ID NO: 66857 - protein, 34 aa, Zea mays
  misc_feature: Ceres CLONE 1540363
MRITKRNAVAGRNTVRTTSPGHAHTTRSPISSDV

SEQ ID NO: 66858 - DNA, 673 bp, Zea mays
  misc_feature: Ceres CLONE 1540364
  misc_feature: Encodes the peptide sequence at SEQ ID NO. 66859
gcggtggcggccgcttttcaatagtggatcccccgggctgcattattcgtctcacccctagaaaaaacgtctccggctccggcgtccgcttccaaccaactcacaccaaagtggcgacatcgccttccgccgcctgacagtctgacacgtttggagttgtagttttagccgccagctccatggagtctgctcccgccgcggtcatggagcgggagcgcctcacggccgagatggccttccgcggcgcggacgaagcgcggcgggacggcggcgagccggcgcccagcatcgtcatcaagatccgccgccggctcccggacttcgcccgcagcatcaagctcaagtacgtcaggctcgggatccgacacggaggtagccccacgtcaccacccccgatgctctgcgtgccggcggtcgccgccgccgcctaactcgttcgtccgcctcgacgtcatcttactactccttcgacctgctcacctgcgttgcctggctcggaaccgcgcttgctctgctcaccgtcaactacttcaagcggccccgccccggtgtacctcctgggacttcgcgtggtacaagccggagcaagcggtttaagaactccagaggcccgcctttccttccaaatgaaccggagaagcacgggggtccctttccatggaggcgggattcg

SEQ ID NO: 66859 - protein, 83 aa, Zea mays
  misc_feature: Ceres CLONE 1540364
  misc_feature: SWISSPROT Homolog: EC 2.3.1.119 Icosanoyl-CoA synthase
  misc_feature: The sequence is a functional homolog of SEQ ID NO 2 in US patent 7038112
MESAPAAVMERERLTAEMAFRGADEARRDGGEPAPSIVIKIRRRLPDFARSIKLKYVRLGIRHGGSPTSPPPMLCVPAVAAAA

SEQ ID NO: 66860 - DNA, 796 bp, Zea mays
  misc_feature: Ceres CLONE 1540368
  misc_feature: Encodes the peptide sequence at SEQ ID NO. 66861
  misc_feature (796)..(796): n is a, c, t, g, unknown, or other
tgaaaaccccccttcgaatctcatacaacaccaatacacaccaaccgccccaaacatggagctccccgcgatcggggccgctctagactagtggatcccccgggctgcaggaattcgtctcacccctagaaaaagccaatccatccgcacccgccaccatgtccggcctcctccggtggcgtcgcctcgccaacgccgccacgcgcgccgcctccaccctcaccgcggccgagtgctccccggacgccgcgtcggctgctggcgcggttgcccagccgccgccaccgcaccggcgcctccaggagcggcgcaagtgggagtcctcctcgggctccgggggcagctcctcatcctccaccgatgagcccgagccgcgccgtatccgcgcggaggcccactgcccgcgctgctccaagcacatggacatcctcttttcccaccggggccctccgaacgccccccccgccgccggctaccaaggcgctcaacctctggccctaattggccgcagcgccctacttctgtccaaccccaacgtaattagcggccgcttcccaggggaaacccttcgtccaagattcggccagtggcccgggttcctaacctccttacgacccaccccctcccgcccagggcacaagggaagaaggggaaccattgtgttcttcctggaggagggcttattccagggcgccaggcttcctttgtgacatcacaaaaaacaccgggggtaaagaggagggcgaggtccgcttcctccgttgcacacagtacaccaaccccggggatcctaccn

SEQ ID NO: 66861 - protein, 183 aa, Zea mays
  misc_feature: Ceres CLONE 1540368
MSGLLRWRRLANAATRAASTLTAAECSPDAASAAGAVAQPPPPHRRLQERRKWESSSGSGGSSSSSTDEPEPRRIRAEAHCPRCSKHMDILFSHRGPPNAPPAAGYQGAQPLALIGRSALLLSNPNVISGRFPGETLRPRFGQWPGFLTSLRPTPSRPGHKGRRGTIVFFLEEGLFQGARLPL

SEQ ID NO: 66862 - DNA, 678 bp, Zea mays
  misc_feature: Ceres CLONE 1540369
  misc_feature: Translation starting site: 171
  misc_feature: SWISSPROT Homolog: EC 1.4.1.2 Glutamate dehydrogenase
ccgcggtggcggccagtctagaactagtggatcccccgggctgcaggaattcgtctcacccctagaaaaaaaaaaaaaaaaaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagccccccaccggcaggaggttcagtgatgcgtctgtccagagtgatatcaagttgtggcccttcaaggtcatttctgggcctggtgagaagccaatgattgttgtcccccacaagggtgaggagaagcattttgccgctgaaagatctcctctatggttcttatcaagatgcctgagattgctgaagcttaccttggtaccacgatccagaatgctgtggcccagtcctgcctcttcatgactcccgagcagcacaagatctggcgatgctgcctaaggctgtcgcc

SEQ ID NO: 66863 - DNA, 662 bp, Zea mays
  misc_feature: Ceres CLONE 1540370
cccccgggctgcaggaattcgtctcacccctagaacagcagcgaacagcaaagcacctccgactccgagtcgcgagagccttctcattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggcctccatgcgtccgaggtggacgagggagcgaggcggcgccagaccgaggttgcgtcgggctcgatttctactgggctgctgtctgctgagtttacggaagtgtttggccctagaagagttgaagataaggagtggagccaccccccaaactctggtgacttggttgttgtgtgcaacgaatcacctatgctgagttttttctgttgagtaccaaaattggaatcaattccagttgaggtctaggaggaagattttaggtactccttgcgtcagggccaagcatttggttgggaaatattgaaggaggagctctccttggtttttgccgaacctcctattccaaggtggacaaaccggaaccgcctggttgaaacgtttccccctaacaatttcagagttcccttttttcccccgatatttggaggagtgggagaa

SEQ ID NO: 66864 - DNA, 672 bp, Zea mays
  misc_feature: Ceres CLONE 1540372
  misc_feature: Encodes the peptide sequence at SEQ ID NO. 66865
tacccgcggtggcggccgctctagaactagtggatcccccgggctgcaggaattcgtctcacccctagaaaaacctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctggtggcaggtctacctttggacgtatcattaatgttatcggtga

SEQ ID NO: 66865 - protein, 171 aa, Zea mays
  misc_feature: Ceres CLONE 1540372
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPGGRSTFGRIINVIG

SEQ ID NO: 66866 - DNA, 779 bp, Zea mays
  misc_feature: Ceres CLONE 1540373
  misc_feature: Encodes the peptide sequence at SEQ ID NO. 66867
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
tggtccccccaccccaccccccttcttacccanngnnnggaaattatccaaaacttgcactccccgccgaggcggccgctctacactagtggatcccccgggctgcaggaattcgtctcacccctagaaaaaaaaaggacattttgattggtgatggagaggatgcagcgtttgatgttctactgggcaagacgacaatgttccctccaaatgtcttgctagatcacaatgttcctgtctataaagctgtacaaagacctggagagtttgttataacgtttcctcgttcttaccacgcaggcttcagtcatggcttcaattgtggagaggctgttcattttgctgttggcgattggttccctcttggttctttggctagcaagcgctacgcgcttctgaacagaactccattgcttgcacatgaggagctactttgtcgttctgctatgcttcccaacacaccagctgttaaactgtgacccaagatccttgcaaaagttggaacatccctgttccccagtattctgtgacatccttgatttgtgccggctgctaaaattccaccggaaatgcacccccccctacctggctaaaaatggctttctgaaatatgccccttatgcccaaagacattcccccccaattacaattcctgtaaacatttttaacgcgcgggggctggctaaaacccacccaagcgctgtagtcgccggaatggcaaccttatggagtcccggttattgcgctctaccttccttgtacacaaaaaacctggccgg

SEQ ID NO: 66867 - protein, 93 aa, Zea mays
  misc_feature: Ceres CLONE 1540373
  misc_feature (1)..(48): Pfam Name: JmjC Pfam Description: JmjC domain
MFPPNVLLDHNVPVYKAVQRPGEFVITFPRSYHAGFSHGFNCGEAVHFAVGDWFPLGSLASKRYALLNRTPLLAHEELLCRSAMLPNTPAVKL

SEQ ID NO: 66868 - DNA, 958 bp, Zea mays
  misc_feature: Ceres CLONE 1540374-R
  misc_feature (1)..(1): n is a, c, t, g, unknown, or other
naacaccattgggacctcgacgtctcgtttttttttttttttttagtttaatgactttcaaaactttcatgacatgcatccttcatgttcttagtgcatgcttctttaagaaaagaagaaatgaacataaattgttcagcaggcatctgtggcccacgagacaataaaaacagtgcccttcacttgttagaggaaacattttattcaaaaggacagattaaaattgcagacacaggaaaaccttcaacaggacaggcctctgcattccgatgaatgcttcttttatccaaaagggtgttagaagtcaaggggttgcctccagaacgcctccatttgcttcgccctggtcctgaattgagattcaaggaccccttctgccccaaatccaatccctaatcccccccgtggaggggtggggggccaacctggggggtgcgagggggaacccgcgccccccccccccccccaaaaaaaacaaaaaaaaggaattccccgggagggtgctttcccgccccccccccctgtggggtcaaccaaaataagggggggttgtggggcccgccccacaactgtgtgggtgggtgccccctggatggggttccccacaggggggggaggtgtccccccccaaacggcaaacacgggtcgggtgggtcaaattaaatggagaaagcggtaccagcctctcccctaaatgtggcccaccccgcgggggggggggggggtgtctctatcacatatcggtactggagggttactatggtgggggttgggtgggcgacaggggggggtgttcgtggaacccctcgcctttcggtggggggaggccaccacccacattatgtgagcgaggttcaatccccacctagccggcgcgtgcataccggctggggcaccgggccatacattctgccccttctaaccccacccccagcggttcggctgcgagcgcaagcct

SEQ ID NO: 66869 - DNA, 649 bp, Zea mays
  misc_feature: Ceres CLONE 1540376
  misc_feature: Encodes the peptide sequence at SEQ ID NO. 66870
gcggtggcggccgctctagaactagtggatcccccgggctgcaggaattcgtctcacccctagaaaaactctctctctcctcccggccaaccaaaccctaaccctaaacccctcccccaccaacctcggcccagtctccccacccccactgacccggctccccacctccgactcgccacgctggcccgattcgatcgatgtacgtgagcgagctcccgacctcatgatggttttggctgcggggtgaaaagaggcacagcaagcgtcgatggcattgggagatctcatggcgtccaggctcgtccactcctcgtcctccaggggactgtcgtcctcgccgacgccgccgttgcccaatcaacaccaccaccagaaccacaaccataccggggatggcctcctggctgccagcgggccggagcccaggaacgggctggaggccgacgaggtggataagtcggcgcccgtgccgtacctgccccagctggtcgtgctgtgcgagcagcgccacgagcctgaggggatcgatgaggctgcggccgcagccgcagggccctccaccagtggcctcgtctccaagtggcgccccaaggatcggatgaagacaggatgtgttgcacttgtattatgtttaaacataagtgtggat

SEQ ID NO: 66870 - protein, 127 aa, Zea mays
  misc_feature: Ceres CLONE 1540376
MALGDLMASRLVHSSSSRGLSSSPTPPLPNQHHHQNHNHTGDGLLAASGPEPRNGLEADEVDKSAPVPYLPQLVVLCEQRHEPEGIDEAAAAAAGPSTSGLVSKWRPKDRMKTGCVALVLCLNISVD

SEQ ID NO: 66871 - DNA, 850 bp, Zea mays
  misc_feature: Ceres CLONE 1540377
  misc_feature: Pfam Name: Ribosomal_L29e Pfam Description: Ribosomal L29e protein family
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (238)..(238): n is a, c, t, g, unknown, or other
  misc_feature (745)..(745): n is a, c, t, g, unknown, or other
tttttgccccttttttattnnnnnnnnnaannnnnnnnaaaggtaannnnnnaaaaaatggggctcaccgcggtggcggccgctctagaactagtggatcccccgggctgcaggaattcgtctcacccctagaaaaaaaaccctagctcacttaacgccgccgcggagctgctccgcgcccccgacgccggtgattaggagcaggagcaagaggggttcggaatgggccaagtctaanaaccacacggcgcataaccagtcgttcaaggcgcacaagaacggcatcaagaagcccaagcgccaccgccagacctccaccaaggggatggacccccagttttctgaggaacttgaggtactccagggaagggcaataagaaaaggtgtggaggctgagcccaagaagtgagaatgatgccttgaattctccgcccaacaaggggggggggggggaacggtaaggggtctttattttggggccccccccttttcacgtcttgtgaggatttaaaaaaagatttccggcgagtggggcaccggcaaagcgcttttttttatttgtggctcgggggggcgcctaaccgggggagtttttattttagcccttaaaaacccctcgagtttggtggcgcccttggaaaaaactggaggcgccccctaaatggggcccgcctctccgcggggttccccaatcagcgaatagagatacagcggcgccggttcgctcctcgggggggtggcctcnatgcctccccccctattagcgagtcgccccgtttatcttaagcgtgtgttcacccgtgcgccccgtcattgttgttgtaaccaaggggtcggagctctggtggga

SEQ ID NO: 66872 - DNA, 643 bp, Zea mays
  misc_feature: Ceres CLONE 1540380
  misc_feature: Encodes the peptide sequence at SEQ ID NO. 66873
ggcggccgctctagaactagtggatcccccgggctgcaggaattcgtctcacccctagaaaaatttccccttccagtctcccacattcccctcccccggccctcgccatcctctcccgctaaccccaccccgtcgccccggcctcctcggtccagcggcgagcgggtccgtccggtcccgacgccgcaccacatcaccgcctgctcccacggccgtcctcactcgacctcgatcggaacccccggatcggaggtaccttcgcgcgcggctccgctccgacctcgtcctccatcggttggcatcggaagcggcggcggcggcgggttcccagccagctttcgaaagggcaatcaatcgtcaggctttttgggagctgtgttggggggaccggggggaagagtgaagttactgcagaggctaacatttaggttgtcgagtgatggcgcaaggcgccaatttccctggtttcattggcgccgtgggtggccatgatggcggtgtgaactttggcgggaacttctgtgacatggccttctaccagaagctaggggagggctccaacatgtcggttgacagcctcaacagcatgcagaccagcatgcatggcggatccatcaccatgtctgtggacaacaacagcagt

SEQ ID NO: 66873 - protein, 68 aa, Zea mays
  misc_feature: Ceres CLONE 1540380
MAQGANFPGFIGAVGGHDGGVNFGGNFCDMAFYQKLGEGSNMSVDSLNSMQTSMHGGSITMSVDNNSS

SEQ ID NO: 66874 - DNA, 642 bp, Zea mays
  misc_feature: Ceres CLONE 1540383
  misc_feature: Encodes the peptide sequence at SEQ ID NO. 66875
caccgcggtggcggccgctctataactagtggatcccccgggctgcaggaattcgtctcaccccgagaaaaagtcacaagctctctttcatcgcatccacaccattccacttccaccccacgaggatccagcctgcctgtccctctcgccgcacgccacgaccgtagtcgctcgccggcgtgtctagcctagccggggcctgggcctccgcgctcgtgctcccgggaaacaacgaccgacgcgtcctcatagtcatagaggcagcgctaggcagccacgcattcgtcgctcgctcgaccggcgatggcgagaggtggcacggcgggcgcgggcgcgggcggggaggggagggcggctagcgaggcgctgacggcggactcagccgacgaggaggggcgccccccgagcagctccagcgccagctccgacgccgcctccagcttctcctgcacgtactccccggccccccccgacgagtggcacaaggtggccatcatcaagacctgcgtgtctgtgtcggccgacgtcgcgggcggcggcaaggaccaaaagccgcgcggcgtcgtcgacgcggcccgacggcacggaggagcctcagatatggatatgatgaaggagcggttctccaagctgctgctcggc

SEQ ID NO: 66875 - protein, 113 aa, Zea mays
  misc_feature: Ceres CLONE 1540383
MARGGTAGAGAGGEGRAASEALTADSADEEGRPPSSSSASSDAASSFSCTYSPAPPDEWHKVAIIKTCVSVSADVAGGGKDQKPRGVVDAARRHGGASDMDMMKERFSKLLLG

SEQ ID NO: 66876 - DNA, 2000 bp, Zea mays
  misc_feature: Ceres CLONE 1540385
  misc_feature: Encodes the peptide sequence at SEQ ID NO. 66877
agctcattgaggataagctgcggttactgatcatctagtcccatgtccaccgccgccgtgctcccgtcgccggcgtcgaccagacacccggccggcggtggcgccctgacggcggaccgcgcagcggcgctactggcgggctgcgcgtccgcaagccgcgccgccgagatccacgccgcggcggtgcgcgccagcgtggaccaggacaaagcagtggccttccggctccagcgcgcgtacgcggcgtccggccgcctggacctagccgtggcgctcctccggcgcacgcccgacccgaccgccgtcttctacacgtccgccatccacgcgcactcctcccggggcctccaccgcgcggcgctggcgctcctctccgagatgctgctgtcccgccacggcctcctcccgaccgcgcacaccctctcggcctccctcccggcgtgcggctgcctcgcggtcgggcgcgcgctgcacgggtacgccgtgaagctggcgctctccggcgagccgtacgtggccaccgcgctgctgggcatgtacgcgcgcgccggggaggccgccgcggcgcgcgcgctgttcgacgggatgcggccggacccgcacgtggtgtcggtgacggcgatgctgagctgctacgccaagatgggccagctggacgacgcgcgcggcctgttcgacgcgctgccccgcaaggacctggtctgctggaacgccatgatggacgggtacacgcagcacgggcggcccagcgaggcgctccggctgttccggcagatgctgaggtccggggtggagccagacgaggtgtcggtggtgctggcgctctccgcggtggcgcagctgggcacggcggagtccgggaggtggctccactcgttcgtggcgaacggcggccgccgggcccgggtgcggctcaacgccagggtcggcacggcgctcgtcgacatgtactacaagtgcgggagcctggaggaggccgtggccgtgttccgcgacctcggcggcggcggcgacagggacgtggtggcgtggaacgccatgatcaacgggtacgcgatgcacgggcgcagccgggaggcgctggaggcgttcgggcagctgcgggcgcaggggctgtggccgaccgacatcaccttcatcggcgtgctgaacgcctgcagccactccgggctcgtcgacgaaggccgcgcgctgttcgcggcaatggaggaagagtacggcatcgtgcccaaggtggagcactacggctgcatggtggaccttctgggccgcgcggggcgcgtcgaggaagcgttcgacctggtgcagagcatgaaggcgaagcccgacgcggcgatgtgggcgtcgctcctcggcgcctgccggctgcacaagaacctggcgctggggcagcgcgtcgccgactacctcgtgggcaacgggctggccaactccggcacgtacgtgctgctgtcgaacatgtacgcggcggcggggaagtggcgggaggtggggcgggtgcggtcgatgatgagggcgagcggcgtgcagaaggagcccgggtgcagcgccgtggaggtcgggcggcgggtggtggagttcgttgccggggaccggagccacccgcggtcggcggagatctacgccaagctagaggaggtgaacagcatcgcgagggcgcgcgggcacgtgccgcacaccgagctggtgctgcacgacctcgacgacgcggccaaggagagggcgctggcggtgcacagcgagaagctcgcgctggcgttcgggctcattagcacgcctccccggacgggcatcaagatcgtgaagaacctccgcgcgtgcgccgactgccacgccgtgctgaagctggtgtcggaggcgacggggaggaagatcgtgttcagggacaggaacaggttccaccatttcgtcgacgggtcgtgcagctgtggggattactggtgaatgctgctagctcttgtgcacaaagtttgcagaaccaaccaaaaaaaaaaaaaaaa

SEQ ID NO: 66877 - protein, 633 aa, Zea mays
  misc_feature: Ceres CLONE 1540385
  misc_feature (220)..(254): Pfam Name: PPR Pfam Description: PPR repeat
  misc_feature (328)..(362): Pfam Name: PPR Pfam Description: PPR repeat
MSTAAVLPSPASTRHPAGGGALTADRAAALLAGCASASRAAEIHAAAVRASVDQDKAVAFRLQRAYAASGRLDLAVALLRRTPDPTAVFYTSAIHAHSSRGLHRAALALLSEMLLSRHGLLPTAHTLSASLPACGCLAVGRALHGYAVKLALSGEPYVATALLGMYARAGEAAAARALFDGMRPDPHVVSVTAMLSCYAKMGQLDDARGLFDALPRKDLVCWNAMMDGYTQHGRPSEALRLFRQMLRSGVEPDEVSVVLALSAVAQLGTAESGRWLHSFVANGGRRARVRLNARVGTALVDMYYKCGSLEEAVAVFRDLGGGGDRDVVAWNAMINGYAMHGRSREALEAFGQLRAQGLWPTDITFIGVLNACSHSGLVDEGRALFAAMEEEYGIVPKVEHYGCMVDLLGRAGRVEEAFDLVQSMKAKPDAAMWASLLGACRLHKNLALGQRVADYLVGNGLANSGTYVLLSNMYAAAGKWREVGRVRSMMRASGVQKEPGCSAVEVGRRVVEFVAGDRSHPRSAEIYAKLEEVNSIARARGHVPHTELVLHDLDDAAKERALAVHSEKLALAFGLISTPPRTGIKIVKNLRACADCHAVLKLVSEATGRKIVFRDRNRFHHFVDGSCSCGDYW

SEQ ID NO: 66878 - DNA, 650 bp, Zea mays
  misc_feature: Ceres CLONE 1540387
  misc_feature: Encodes the peptide sequence at SEQ ID NO. 66879
  misc_feature (650)..(650): n is a, c, t, g, unknown, or other
ccccgcggtggcggccgctctattactagtggatcccccgggctgcaggaattcgtctcacccctagaaaaacttcttctctcttggtagttttcgcccctcgcgttgcgtgtatagactgtgaaaaagaggagtggggaaggggaaaaagcagaaagaaagagagagagagagagagagagtgttcccctcagcagccgttcaccgagaatggccgtcgcctccggcgaacgcccggcgtacgggcagtagcacgctgggactggtggttggtttaggccggtggtgtgttggtgcggttggctctgggttggttacttgtgcgagcgagattttgtggatgtaggcagtcgctgcgcctcatccctcatgcgatcgatgccgttccagctcaagaccggtcaccaccaccacggcgccgccatggaagggaagccgccgccgccgccgacgacgcagcagcctgcgccgacgccgagggtgtcgaggctccggaggctgctcgggcgggtgtcttcatcggagaagttcgccgcggatgggaaggacagggacaaggacgagaagctgccgccgccgccgccgccgttgccgcccgcgaccgacgatgcggacgccgcggggtcactggggctggaccgcatggtgcn

SEQ ID NO: 66879 - protein, 75 aa, Zea mays
  misc_feature: Ceres CLONE 1540387
MEGKPPPPPTTQQPAPTPRVSRLRRLLGRVSSSEKFAADGKDRDKDEKLPPPPPPLPPATDDADAAGSLGLDRMV

SEQ ID NO: 66880 - DNA, 633 bp, Zea mays
  misc_feature: Ceres CLONE 1540388
tctttcacagtggatcccccgggctgcaggatgtcgtctcacccctagaaaaaagacgcgcacgccttgcatttggcttcttcgcggcttcagcagcgaccgcctccccgcccccgtcgggcaccaacccagcccaacgctctcccccctgctcctccccttttcctctgcccaccaattgatagctcacctcacctccgcgcccgttgtttcgtgcaccgtacttcaccccccaccaaccttccccctcaaaaactatccacccctccacggctccacccctacccgccgacgagcgcgatcgattgattcggttcgagccgggcggaggaggaggagggagcgccgcggggcggggtgagcccaccagatccgactaccgcacccgctatgatgaagtcgctgctgccgcagagccagctgcggcgctcggcggcggcggccgcgcggtcatcggcgggcggcgcctcgggggcagacggggctatgtcctaccgcagcggcgcagggcccgcgggcccccgcctccctcaccttctggttcctagctccacgcgcttctgcttgcctcatctcgctctttcctcgggttcccgctttcctcgagtctccctctttcttcctggctcatct

SEQ ID NO: 66881 - DNA, 523 bp, Zea mays
  misc_feature: Ceres CLONE 1540394
  misc_feature (157)..(157): n is a, c, t, g, unknown, or other
  misc_feature (215)..(215): n is a, c, t, g, unknown, or other
atgtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccnggccgccccaggcccaggctcatccggaacgcccccgtcttcgccgcccccgccaccngtcgtggtaaacggggacgggcgggggcaaacctggagggaatctcaaacgcaaaaaaaaaatcgaaagaaaaaaaaaaaaggggggaggggtttccccccccccccccggggtaaaaaaaggggggaaaaaaaaaacccccccctaaaaaagggggggggaaaaaaaaaaaaaaaaaaatagcgccccttgtccctttctctcttctcaaaaaaaaaaaaaaagggggggcccccccaaaaaaaaaaaaaaaacccccccccaaaaaaaaaaaccccccccccccccggggggggcttttctttaaa

SEQ ID NO: 66882 - DNA, 769 bp, Zea mays
  misc_feature: Ceres CLONE 1540396
  misc_feature: Translation starting site: 207
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (21)..(21): n is a, c, t, g, unknown, or other
  misc_feature (22)..(22): n is a, c, t, g, unknown, or other
  misc_feature (49)..(49): n is a, c, t, g, unknown, or other
  misc_feature (54)..(54): n is a, c, t, g, unknown, or other
  misc_feature (334)..(334): n is a, c, t, g, unknown, or other
  misc_feature (339)..(339): n is a, c, t, g, unknown, or other
  misc_feature (342)..(342): n is a, c, t, g, unknown, or other
  misc_feature (347)..(347): n is a, c, t, g, unknown, or other
  misc_feature (388)..(388): n is a, c, t, g, unknown, or other
  misc_feature (390)..(390): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (413)..(413): n is a, c, t, g, unknown, or other
  misc_feature (421)..(421): n is a, c, t, g, unknown, or other
  misc_feature (426)..(426): n is a, c, t, g, unknown, or other
  misc_feature (432)..(432): n is a, c, t, g, unknown, or other
  misc_feature (440)..(440): n is a, c, t, g, unknown, or other
  misc_feature (483)..(483): n is a, c, t, g, unknown, or other
  misc_feature (484)..(484): n is a, c, t, g, unknown, or other
  misc_feature (511)..(511): n is a, c, t, g, unknown, or other
  misc_feature (563)..(563): n is a, c, t, g, unknown, or other
  misc_feature (585)..(585): n is a, c, t, g, unknown, or other
nttttnnnaaaaaaaaagggnntgtgtttggtatgtgtctgtggccccnccccnccacagcggttattcagcgagggagggggtcactctctctcaaaaggatcccccgggctgcaggattgcctctcacccctagaaaaacttgccgggcgcctgaccttatctcctcctcctttccgagatatttccacgtctcctccgccaccatggagtccggcctcgttgcaagccaccgcctccgcgtcccgtccccctccgcctccgccgggcaccaccacctcatccgccaccgccacgcccacgccccggtggccgctgcgcccctccgcctcancctcntgngccanctcccccggttcatgggggtcggggtggttgttgtgctccngntccgcnnntggcctgcggccccncgcgctgnctccncccccnccgccgcnggctgagtggttggggttgttgtgtgtgtgtccccaccccccnngcgcgtggacgcaaccacaatcacgangaacatgcccctaggagctcaagattcttcatggcaaaactcgtagactatnacagtccctgccggaataccancggaccccgcacgtctagcaccttccaaggtgcaacaagtatagcagataagtcccgattcctctcttttcctcctgcccaaccggacaccatatcaccactgccttacatgcgcgactttaaaatcttattttttgccgaattgtttatactccaagagtagtagccgtcctttcctttccct

SEQ ID NO: 66883 - DNA, 645 bp, Zea mays
  misc_feature: Ceres CLONE 1540400
ccccgcggtggcggccgctctagaactagtggatcccccgggctgcaggaattcgtctcacccctagaaaactagtattccaccgccgcacacctcctgtgcttccttcaccttcgcgctccgccacacgccgtccattcgtgctgatctcacccctaacctgtccgacatctccggggagggaagcagcagaagaagctccccttacctccggctatcgcctgaggataaagtggggtctgtaggggagtcttaggggggagcaaaagggataggatagggagagatgaagcaatcaatttcttcgtccgccttcgacccctgcttacgtccccgctactaaccctaggatcattctgtcttttctcgattcttatccgactcttcttcgatttatgcctatcagttatgaggttgaacgccttcacaaacttctctactagattagtgtaaatagtacacttgttcgagtttagcttggctggaagaattagtctctggtccgtgtttatatctgctaacaataatggctgcgatgaaccgaaaggtattgggtgaatgtggcaaggaacataaatagtctcaagagaaagcggggagaagccccgctgcatatgctgcctggcgtatttctgcaccctctga

SEQ ID NO: 66884 - DNA, 636 bp, Zea mays
  misc_feature: Ceres CLONE 1540404
  misc_feature: Pfam Name: COX3 Pfam Description: Cytochrome c oxidase subunit III
  misc_feature: SWISSPROT Homolog: EC 1.9.3.1 Cytochrome-c oxidase
gctctagaactagtggatcccccgggctgcaggaattcgtctcacccctagaaaaacttctttcgggggggttatcccatgacatgataaagaccaatcaaaaacttcttcgtttcgttggtagaaccaacgccgactcttctctaaaataatagagagatcttttgatagtatcacttctatcaatgcaatgaaagaactatcccttcctatttgtttgtcctaatgagacaaagaagagcctccttctttaccactttaggggatgggggtgaaggggggtttacatacaaccggggcaaagtggtttatgattgaatctcagagggattcttatcatttggtagatccaagtccatggcctatttcgggttcacttggagcttccccaatcaccgtaggaggtgtgatgtacatgcactcatttcaaaggtgtgcaacacttctcagtttgggcctaatatttctcctttataccatgttcgtatggtgggcgggatgttctacgtgaatccccttgggaagggcatcatacaaaagctgtacaattaggacttcgatatgggtttattctcttcctaacctcagagggtagggtccttttttgcctttttttggggctttttttccattctg

SEQ ID NO: 66885 - DNA, 646 bp, Zea mays
  misc_feature: Ceres CLONE 1540408
  misc_feature: Encodes the peptide sequence at SEQ ID NO. 66886
  misc_feature (213)..(213): n is a, c, t, g, unknown, or other
gcggtggcggccgctctatactagtggatcccccgggctgcaggaattcgtctcacccctagaaaaactggcttcaatatccgggagcccccgtatactgcgaatctgtggccgttacatcgtacataatgttttgagttcgctcaataatgatgtacataagcagtggtgtactggtgtgttcaaataatattgtagtgttttgtgacacanatttatatggacataaatattgagtccgcgtagatccggagattcccaaataggtcaaccttttgaactgcctgctgaatccatgaccaggcaatagacaacctggccaactgaaacatcttagtagccagaggaaaagaaagcaaaagcgattcccgtactagcggcaagcgaaatgggagcaccctaaaccgtgaaaacggggttgtgggagagcaatacaagcgttgtgctgctaggctaagcggttgagtgccgcaccctagatggctaaagtccagtagccgaaagcatcactagcttacgctctgacccgagtagcatggggcacgtgaaatcccgtgtgaatcagcaaggaccaccttgctaggctaaatactcctgggtgaccgatagcgaagtattaccgtgaggaaaacgtgaatagaccccc

SEQ ID NO: 66886 - protein, 62 aa, Zea mays
  misc_feature: Ceres CLONE 1540408
RWRPLYTSGSPGLQEFVSPLEKLASISGSPRILRICGRYIVHNVLSSLNNDVHKQWCTGVFK

SEQ ID NO: 66887 - DNA, 666 bp, Zea mays
  misc_feature: Ceres CLONE 1540410
  misc_feature: Encodes the peptide sequence at SEQ ID NO. 66888
  misc_feature (666)..(666): n is a, c, t, g, unknown, or other
ggcggccgctctattctagtggatcccccgggctgcaggaattcgtctcacccctagaaaaagactagactccttgagccttctcgtctccccccttcatcggcaccctataacctttgcatcatcttccttgcccgcgccctaacccttgcaccctcctccttgctgccgccggggccgatctccgctgccgccagccatgtaggacttctgcgtggtgtgcgcagataatctggactgcgtggcctaccggccgtgccgtcaccgccacctgtgctccacctgcgtcgctctcctccgttatgtgatggacgataagaagtgctgcatctgcaagaccgtctgccccttcatcttcgttactaatgccatgggtgaatacactagaatgcctcctcatttctcagtgttccccattacgtcaaatgacggcaaagctggtgattactggtaccatgaggatactcaggcatactttgatgatgtggaccactacaggaaggatcgggtaaagcgccccactttcttgcatcctcttgggacattgccaaaaatcaagttgcccttcgctgctcaagcaaagcgcttaaacaagttcagggagcaccccatcaacctaaggggacttttttttcccctggtgcaaaaagtttgcaccctttacan

SEQ ID NO: 66888 - protein, 119 aa, Zea mays
  misc_feature: Ceres CLONE 1540410
MDDKKCCICKTVCPFIFVTNAMGEYTRMPPHFSVFPITSNDGKAGDYWYHEDTQAYFDDVDHYRKDRVKRPTFLHPLGTLPKIKLPFAAQAKRLNKFREHPINLRGLFFPLVQKVCTLY

SEQ ID NO: 66889 - DNA, 647 bp, Zea mays
  misc_feature: Ceres CLONE 1540411
  misc_feature: Encodes the peptide sequence at SEQ ID NO. 66890
ccccgcggtggcggccgctctagaactagtggatcccccgggctgcaggaattcgtctcacccctagaaaaaatcccccttcttgttgcctcgcttcgtgctccccccttcccacactcccgtcccaaaaccctaaacccagcgccgccgccgccgccgccgacgcggaagcggtacagccatgtacgccgtcctccgccgcgcggcgccccttcggcggcgcgccgtctccgcgctcgcgaccgcgctgctccagcagcagccggcggcgctggatgcggtggcccggcgggcgccgctccctgcggccgcgtggttccactcctctcccgcgtggctggggttccgggagacgggggctgcaggggcggcggcgcgcgcggagttcgcggcggacaacgggtcgttctacgaggaggacaagagggcgcccgccggctccggtgcggcggcggaggggctcgagatttccaagcttgggatatcgtccaagatcgtcgaaaggctcgccagcaagggcatcaccaagctgttccccatccagagagctgtccttgagccagcaatgcaaggaagggacatggttggccgtgccaaaactgggactggtaaaactttggcatttggaatccccataatggatgcaa

SEQ ID NO: 66890 - protein, 155 aa, Zea mays
  misc_feature: Ceres CLONE 1540411
MYAVLRRAAPLRRRAVSALATALLQQQPAALDAVARRAPLPAAAWFHSSPAWLGFRETGAAGAAARAEFAADNGSFYEEDKRAPAGSGAAAEGLEISKLGISSKIVERLASKGITKLFPIQRAVLEPAMQGRDMVGRAKTGTGKTLAFGIPIMDA

SEQ ID NO: 66891 - DNA, 629 bp, Zea mays
  misc_feature: Ceres CLONE 1540412
  misc_feature: Encodes the peptide sequence at SEQ ID NO. 66892
gctctttactagtggatcccccgggctgcaggaattcgtctcacccctagaaaaagagagggaaaggcagcaggcagcgagcccgtttttaaaatccaaatccacctccactctgctccagtccaggctctcttgcctctctcactgccattcctgttcttgaagctgaggcatccgggggagccaagaacacccgtcgcccgcttccgagatgaggctggatccttgaagcccgctcgccgccttcaccgttcgcctccgggaaggaaatgaggtgcgccaggtcgcgcggcactttccagcaagcttccgaagccttgtgattcggctgtagcaggcttctagccatggaggacgagcgaaaagctccgagctttctcgatgcaccgcccaaggatatccccatcgccaccgccaacccgctcaccatccggaccagcgccaccgcgtccggatgcggcggcggcggctccgaccgctcctgccccatctcgccggccatctccatcacgccgcacctctactcgccgtcgccgccgtcgtccgcgttcgtgtccgcgctgcagtccccgtacatctcggccccgggttctcgaaccggcagctcctcctcctggtcggcggaagcg

SEQ ID NO: 66892 - protein, 94 aa, Zea mays
  misc_feature: Ceres CLONE 1540412
MEDERKAPSFLDAPPKDIPIATANPLTIRTSATASGCGGGGSDRSCPISPAISITPHLYSPSPPSSAFVSALQSPYISAPGSRTGSSSSWSAEA

SEQ ID NO: 66893 - DNA, 823 bp, Zea mays
  misc_feature: Ceres CLONE 1540412-R
ccgattgagtacctcgagcgtctcgtttttttttttttttttggaagttcagcatgggaagctcaatggtagttctaccaaatagcaaatggactgcactgtacataacacctccacttacatatggcacctgctctaaaataagttacacatggcatcatggaccttggctattatactgatgatcgctaacaaaactgtagccgggggcataacaaattcaggaacaaaaatgggggcgtgaaaacttctgaaacaacaggggggaaaaagcttgcaaagggtcttggacaccatcatctcatctcatattttgctcctatacctgaccagctttgccagcgtctcctgaacaactagcgtctgggcgtggccgtggccaagcatgacaatccggatgctgatgcaggtcctgcacagctcctcgcccgtgtcgaacagcccgccgcggatcagcagcttcaccctcgtctccaggagcgtcgccttgagcagcgtcacctcctgccaaaaaaactcttcaaaccggtggttcgggtggaactttttcctccagcaaaggaacccgcgggtcccagtcctggatccccgaaccgtacaacttctccccctccccccggaaagttgggcacacctttgagcagctcccaaacccgaacccccccccgaaaacaaaatgaaagaatccaaccgccagggggcccccccctcctccctttataaaaaagaaccatttcccacccccctttaaaccttgataggggggggcgcccccggatcttgaaaacccaaaccccgaagaaaaagcccctttgccccacaa

SEQ ID NO: 66894 - DNA, 627 bp, Zea mays
  misc_feature: Ceres CLONE 1540413
  misc_feature (279)..(279): n is a, c, t, g, unknown, or other
  misc_feature (369)..(369): n is a, c, t, g, unknown, or other
  misc_feature (371)..(371): n is a, c, t, g, unknown, or other
  misc_feature (378)..(378): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (391)..(391): n is a, c, t, g, unknown, or other
  misc_feature (394)..(394): n is a, c, t, g, unknown, or other
ctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactganagcagattacataatattgaacttcagcaccgcttcggcgacccccgacaatttcaacaccttcatcgggggtagaacggggtggcttgntnaacaaancnnngggcaacancancgggatccccgtgctggtcgacgaagacgacccgctcgcgctccaatcgtttctaaacatccctctggtgaacaaggcaggcccctccctaaccttgaagatggatgtttcccgagcctacctccgggcttacgtaacagggcaaccctcctggcctccccaagaaaacaggccgcccgttctccccggggattttgttattacggggggcccgggggaaaaagtttccgccg

SEQ ID NO: 66895 - DNA, 647 bp, Zea mays
  misc_feature: Ceres CLONE 1540416
  misc_feature: Encodes the peptide sequence at SEQ ID NO. 66896
ccccgcggtggcggccgctctagaactagtggatcccccgggctgcaggaattcgtctcacccctagaaaaaaagccagaggtcagatccagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgaccacagctactcgtgcgtgcctccgccaaagatatcgcctttgaccagggctccagagccgcccttcatgccggcgtcgagaagctcgccgccgcagtcggtgtcaacctcggacccagaggaaggaatgttgtcttggatgagtttggaactcccaaagtggtcaatgatggagttaccattgcccgcgctattgagcttgctgatcccatggagaatgctggtgcttccttgattcgtgaagttgctagcaagacgaatgactcggctggtgatggaccacaactgcctctgttctcgctagggagatcatcatattgcgcatgttgagcattacttcatgtgcaaatccagtgtacgttacg

SEQ ID NO: 66896 - protein, 149 aa, Zea mays
  misc_feature: Ceres CLONE 1540416
MATIPTTDSGLVLSSSALLRRTRRAASSVTARLPAVARRRPQLLVRASAKDIAFDQGSRAALHAGVEKLAAAVGVNLGPRGRNVVLDEFGTPKVVNDGVTIARAIELADPMENAGASLIREVASKTNDSAGDGPQLPLFSLGRSSYCAC

SEQ ID NO: 66897 - DNA, 655 bp, Zea mays
  misc_feature: Ceres CLONE 1540417
  misc_feature: Encodes the peptide sequence at SEQ ID NO. 66898
  misc_feature (430)..(430): n is a, c, t, g, unknown, or other
  misc_feature (462)..(462): n is a, c, t, g, unknown, or other
acccgcggtggcggccgctctagaactagtggatcccccgggctgcaggaattcgtctcacccctagaaaaaagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcngaaggagacagtgaggaagagcagggacagtnccccaagcgttgggccatcgtcttcctctgctttctcgcatttctactctgcaacatggaacgcgtaaatatgagcattgctattctggctatgtccgcagagtttgggtgggaacccacagaccggtggtctcaatcagtcatctttcttctggggctacccctaaactcaaaaactggaaggaaattgggc

SEQ ID NO: 66898 - protein, 162 aa, Zea mays
  misc_feature: Ceres CLONE 1540417
  misc_feature (98)..(98): Xaa is any aa, unknown, or other
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQGQXPKRWAIVFLCFLAFLLCNMERVNMSIAILAMSAEFGWEPTDRWSQSVIFLLGLPLNSKTGRKLG

SEQ ID NO: 66899 - DNA, 664 bp, Zea mays
  misc_feature: Ceres CLONE 1540418
  misc_feature: Encodes the peptide sequence at SEQ ID NO. 66900
  misc_feature (424)..(424): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (461)..(461): n is a, c, t, g, unknown, or other
gcggtggcggccgctctattctagtggatcccccgggctgcaggaattcgtctcacccctagaaaaaacctcaccaccatctccagctccatccgcaccaacatctccaccaaccgacacggcgaggagatgaacgcgtcgcagttcatggacaagcagatcctcggcctcgccgcctccgcctccccgtccggcggcggcgcggggggcggtgggggtgtggatctcagcgatctgatgatcccgatcccccaggaggacggcgaggaccgtctccgtcgccggcgtagcagtagcagcgtcaacggcacatcagacgacatgctacccagctacgatttccagccgatccgcaccggcggcgccaccgccggccgccccgtgtctcaggcctcgtggggatcgctcgactccaaggcacccntcagctctagctctgggctcgcnnngcgctcatacanctcaagagtgctggtatattggagccacatgtgctgaagaaagttagtcctgaggaagaccggagttacttcccttacgttactattgcaaaatttgttccaaccctgaaaaagcccccgaaaaccttttccctggccctggaagggggaaatttcaaagcgttcccccaggggggggggaaacccccccctttgaaaccccg

SEQ ID NO: 66900 - protein, 122 aa, Zea mays
  misc_feature: Ceres CLONE 1540418
  misc_feature (99)..(99): Xaa is any aa, unknown, or other
  misc_feature (107)..(107): Xaa is any aa, unknown, or other
  misc_feature (111)..(111): Xaa is any aa, unknown, or other
MNASQFMDKQILGLAASASPSGGGAGGGGGVDLSDLMIPIPQEDGEDRLRRRRSSSSVNGTSDDMLPSYDFQPIRTGGATAGRPVSQASWGSLDSKAPXSSSSGLAXRSYXSRVLVYWSHMC

SEQ ID NO: 66901 - DNA, 691 bp, Zea mays
  misc_feature: Ceres CLONE 1540422
  misc_feature: Translation starting site: 285
  misc_feature (112)..(112): n is a, c, t, g, unknown, or other
  misc_feature (117)..(117): n is a, c, t, g, unknown, or other
  misc_feature (377)..(377): n is a, c, t, g, unknown, or other
  misc_feature (378)..(378): n is a, c, t, g, unknown, or other
  misc_feature (385)..(385): n is a, c, t, g, unknown, or other
ggcggccgctctagaactagtggatcccccgggctgcaggaattcgtctcacccctagaaaaaggaaatggaccgagagagagggccaagatgggcaaaaggaaggtggctntcagngtatttacttgcatgaggagggcttacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagtctgtgcccaaccctgcagggggggagggggggtannaatacanatcctccaacaatttgctggcatcaacggcgttctctactacactcctcaaattcttgaacaaccccgcgtcgggtgttcttctgtccaaaccccggccttaacgcttccttcggcatcaatccccattagcccctttgaccaaccttattggagccccccaagccctcggttttgccaatgaacgcttcagggatatgcccccgcaaggcaattttttcccccccttccgccaaatctccgtgccgtattagaggcccccttcctgcttgccccggtagttccccccaccccctctgacataccg

SEQ ID NO: 66902 - DNA, 751 bp, Zea mays
  misc_feature: Ceres CLONE 1540427
  misc_feature (8)..(8): n is a, c, t, g, unknown, or other
  misc_feature (15)..(15): n is a, c, t, g, unknown, or other
  misc_feature (21)..(21): n is a, c, t, g, unknown, or other
  misc_feature (24)..(24): n is a, c, t, g, unknown, or other
tgacgcanccccccncatttnccnaagtcgcgtcccccgccaacaatctatttggggctgctccaaaaggggacgatctaaactagtggatcccccgggctgcaagaattcctctcacccctagaaaaaaaaaaaaacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaaagcgttcatagcgacgttgctttttgatccttcgatgtcggctcttcctatcattgtggaagcagaattcaccaaagtgtttggattgttcaccccaccaaatagggaaaccttgagctcgggaattaaacccgtcgttgagaacaggttaaaaaaaaaaaaaaaaaacaccaagacgcctccgaaggttaccccaaattccgccccctataagtgggagttccatatttaacagccgccgcctccaccgtgaacccgttccagtttttataacaa

SEQ ID NO: 66903 - DNA, 622 bp, Zea mays
  misc_feature: Ceres CLONE 1540430
  misc_feature: Encodes the peptide sequence at SEQ ID NO. 66904
  misc_feature (124)..(124): n is a, c, t, g, unknown, or other
  misc_feature (359)..(359): n is a, c, t, g, unknown, or other
  misc_feature (423)..(423): n is a, c, t, g, unknown, or other
ccccgcggtggcggccgctctagaactagtggatcccccgggctgcaggaattcgtctcacccctagaaaaaaggcttctagggttttcgcgccgccgccgccgccgcttcgtcgtctccgccngcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcnttgtgtttctgtaaagctagcaaaacagttccagaaagcttttgtttagattttgatgacgctnagaggattgatgctactatgctgtactcaggaatccatgctgcattgcaatgctaaatttaaggaacctctggtaccctaaaaaaaaaaaaaaaaacgaaacgctccgggggtcccattccgcccttttgggggggcgtatttacccccggctcctgggccggtgttttttaaacgggcgggactggggaaaaacccgg

SEQ ID NO: 66904 - protein, 51 aa, Zea mays; identical to SEQ ID NO: 2355
  misc_feature: Ceres CLONE 1540430
  misc_feature (9)..(51): Pfam Name: Ribosomal_L39 Pfam Description: Ribosomal L39 protein

SEQ ID NO: 66905 - DNA, 641 bp, Zea mays
  misc_feature: Ceres CLONE 1540431
  misc_feature: SWISSPROT Homolog: EC 3.2.1.23 Beta-galactosidase
ccccgcggtggcggccgctctagaactagtggatcccccgggctgcaggaattcgtctcacccctagaaaaaaaattgttatctggtcttaaactaaatgacactggggaggagtccatggcagcattgtgtataatctaatgctttggatcaacgatgtttttttcttctatttcattgaatcgaacttttccttccatggatattggctgtgtatggattttacggaccgtgaagttaaaagaaaggtgaattagataacttacaataaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgtttgtcc

SEQ ID NO: 66906 - DNA, 648 bp, Zea mays
  misc_feature: Ceres CLONE 1540434
  misc_feature: Encodes the peptide sequence at SEQ ID NO. 66907
gcggtggcggccgctctagaactagtggatcccccgggctgcaggaattcgtctcacccctagaaaaaaccgaaatcttccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaagtccgccggtaaggagggcggcgagggcaagaaggggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacaataggccgaaatcggcaaaatccctttataatcaaaagaatagaccgagatag

SEQ ID NO: 66907 - protein, 132 aa, Zea mays
  misc_feature: Ceres CLONE 1540434
  misc_feature: SWISSPROT Homolog: EC 3.2.1.23 Beta-galactosidase
MAPKADKKPAAKKPAEEPATEKAEKAPAGKKPKAEKRLPAGKSAGKEGGEGKKGKKKKKNETLEVPNSPYSESYYARSLAVVLQRRDWENPGVTQLNRLAAHPPFASWRNSEEARTDRPSQQLRSLNGEWKL

SEQ ID NO: 66908 - DNA, 629 bp, Zea mays
  misc_feature: Ceres CLONE 1540439
ggcggccgctctagaactagtggatcccccgggctgcaggaattcgtctcacccctagaaaaagtttattttcatcggaactgactcttctcggggttagcacctacctttgtatgttgtggctccctgtgctagcatgctgtgttctatcagctggtttgtgatattagttgttcgtgaaacttgcttggttttattggttgagcacttaaaagatgataatttatacttatattgctttgctataccgcccctatatctctgcattcttgaaagtatgatactggactctgagatgagttaatgaacttcgaacagcctttgtgttgcctatattttgagatgacggtaaaccaaaagaaaattacgagtcgctcgaggctgcccattctccctataaagatccttattacccgggatatcagccctgaggtttaagccgacgaggatggtgataacattgctttacactcccttaatcaaattagaaaacatcaccctttaggcagctggtttaatatctaataagcccgatcagatcggccttcccaacagttgttttaccctgaatggcctagggaaaatgtaagcgtttacattttgttaaaacttgcggttaaattttcttt

SEQ ID NO: 66909 - DNA, 598 bp, Zea mays
  misc_feature: Ceres CLONE 1540446
  misc_feature: Encodes the peptide sequence at SEQ ID NO. 66910
tggagctccccgcggtggcggccgctctattctagtggatcccccgggctgcaggaattcgtctcacccctagaaaaaaaaccctagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttccctgaggaaacctgaggtattctaggaaggggcacaaaaagagtggtgaggctgaagctgaggagtaggaaggaaagcatggcttttgtttcctctgtttttagctcagttcccacctttagacctgggggttttgctaaagatggaccttaagtggtgttactgtattgatggcaaggaccctttttgctgccaaaagtttatgtttttgaaagttcaaggcttacctttttaaaggaacgggattacccttgggccctattgttcaaaaaaaaaaaaaaaaaaaacccggacaccccccccagggggaaccccccaatttttcccccccccccaaaagg

SEQ ID NO: 66910 - protein, 43 aa, Zea mays
  misc_feature: Ceres CLONE 1540446
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFPEET

SEQ ID NO: 66911 - DNA, 570 bp, Zea mays
  misc_feature: Ceres CLONE 1540451
  misc_feature: Encodes the peptide sequence at SEQ ID NO. 66912
gctctagaactagtggatcccccgggctgcaggaattcgtctcacccctagaaaaataatgaaaattaagaaatcttttaatataattgctatgcttagtgtgtgactcgttagttttttctttagggtcaaaaatggaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtgaagcaaaactaaagggatgtggataaaaggagggatgatagatagaaggaagaagaataagaaagatataggattcccatatgtatggtctatgaattacatcataaaaaaaaaaaaaaaaacgagacgctcgaggtacccaattcgccctatagtgagtcgtattacgcgcgctcactggccgtcgttttacaacgtcgtgactgggaaaccctggcgttacccaacttatcgccttgcagcacatcc

SEQ ID NO: 66912 - protein, 77 aa, Zea mays
  misc_feature: Ceres CLONE 1540451
MWIKGGMIDRRKKNKKDIGFPYVWSMNYIIKKKKKTRRSRYPIRPIVSRITRAHWPSFYNVVTGKPWRYPTYRLAAH

SEQ ID NO: 66913 - DNA, 616 bp, Zea mays
  misc_feature: Ceres CLONE 1540453
  misc_feature: Encodes the peptide sequence at SEQ ID NO. 66914
  misc_feature (616)..(616): n is a, c, t, g, unknown, or other
ccccgcggtggcggccgctctataactagtggatcccccgggctgcaggaattcgtctcacccctagaaaaagtaattctgatagtgtccgttgccggttgtgataaaataaaatagcaatagagtactgggtacagaagacttgccggaggattcggcatcaatggacatgtatatccattgcctttttatatgttgatcctttttgtatcacacgtaatgttgcatagatacaacaatgatgtacaacacacagtgtactcatgcatttatacatgtattcagataactggattcaatagtagagtctttgtctgacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaan

SEQ ID NO: 66914 - protein, 38 aa, Zea mays
  misc_feature: Ceres CLONE 1540453
PRGGGRSITSGSPGLQEFVSPLEKVILIVSVAGCDKIK

SEQ ID NO: 66915 - DNA, 768 bp, Zea mays
  misc_feature: Ceres CLONE 1540454
  misc_feature: Encodes the peptide sequence at SEQ ID NO. 66916
  misc_feature (14)..(14): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
aaaaaaaagagaanaacagaatcaaaaanaaaacnnnncggnccccccacaaaacaagaactccccgcggaggcggccgctcttccctagtggatcccccgggctgcaggttttcgtctcacccctagaaaaagataaacaacgtccgcagcccacttccaacaattaaccctgtcctcgcatatatcacaaagaagaaacccatggacacaatcatcctttgcctcgtacgatcaatctgcgagttcctcatcgtcatctactggctgtcgaattctcttaacaacaccaaatgactcacggagtggaaacgcttagaatcacacctacccgtactgatgatcgtaattggtgcctgtaccaaaatggatgaataacagctactacgattccggattacggtcccccccgggtccccaattacatcactgacttagatgcaaaaattgtgttgaattattatcccccccccgcgggaatggaaaggaaaaaatactcaagggggtcccaatatagaataaatatccagaacgcttcgagacatcccaattagggcccacctatcggagcaatgaaaaaaaacgaatattacacgaggccctcatttctcaaacacaaaaaacatacgaagagaaaaactccgcggccgaatgccgccacctgtagttctatacaataaaaaaaacaatccacaaccttatcaaccagccgcgcccgataagttgaccacaaaaattgcccgctaacaacaaatcgcttccttccctt

SEQ ID NO: 66916 - protein, 30 aa, Zea mays
  misc_feature: Ceres CLONE 1540454
MDTIILCLVRSICEFLIVIYWLSNSLNNTK

SEQ ID NO: 66917 - DNA, 557 bp, Zea mays
  misc_feature: Ceres CLONE 1540457
  misc_feature (74)..(74): n is a, c, t, g, unknown, or other
  misc_feature (146)..(146): n is a, c, t, g, unknown, or other
  misc_feature (182)..(182): n is a, c, t, g, unknown, or other
  misc_feature (203)..(203): n is a, c, t, g, unknown, or other
  misc_feature (210)..(210): n is a, c, t, g, unknown, or other
  misc_feature (211)..(211): n is a, c, t, g, unknown, or other
  misc_feature (220)..(220): n is a, c, t, g, unknown, or other
  misc_feature (231)..(231): n is a, c, t, g, unknown, or other
  misc_feature (246)..(246): n is a, c, t, g, unknown, or other
  misc_feature (414)..(414): n is a, c, t, g, unknown, or other
  misc_feature (433)..(433): n is a, c, t, g, unknown, or other
  misc_feature (434)..(434): n is a, c, t, g, unknown, or other
ggagctccccgcggtggcggccgctctagtaactagtggatcccccgggctgcaggaattcgtctcacccctangaaaaaatcaggcatccaagaagctcaaagcaagcagatctaagctccaggcagcgtcgcgacagagtgagntgagtagcacgacaaccaactatgggcttcccctgnaagggccgcgaagcccagcgnagttgcnngcgcagggncaagggagccnggcgcccaagctcancgagaccgggccaacaaaaaccccgtccaacccgccaaaaaaaccggccggcctttaaaaaggctggaacaaaaacccccggggaaacccaaaagggagggggtaaaaagcccccaaaaaaaggggggggggggggggggggcgcaaaaaaaaaaggggggggcgccncaaaaaaaaaggggggggnnaaaaaaaaggggaaaaaaaagaaccccccccccccggggaagaaaaaccccccccggcggtaaaaaaaacccccccccccctttttttttttccttctttgttagggggggggggggggcccc

SEQ ID NO: 66918 - DNA, 629 bp, Zea mays
  misc_feature: Ceres CLONE 1540459
  misc_feature: Encodes the peptide sequence at SEQ ID NO. 66919
  misc_feature (109)..(109): n is a, c, t, g, unknown, or other
  misc_feature (443)..(443): n is a, c, t, g, unknown, or other
  misc_feature (521)..(521): n is a, c, t, g, unknown, or other
ccccgcggtggcggccgctctagaatagtggatcccccgggctgcaggaattcgtctcacccctagaaaaacgactctaaagctgtcttgctattcaagtctgggtganttgctcgcagccgacgcaatcaaccttgcacgcctacgttccattgctcccatgtatgcaccgcacccttccccccaggcccagggtcgtctgcagccaagctggaagccggtaatcttaatgagcctgcatgttgatgtatatcagcaacggattattcttcgtatgcccactagtgtgagatcagattgcatcttacttatgtctgatatatctagctagggtaggtgttgtgagtacattgtcttgctgcaatatgattgcgggacactgggtgaactgcctctccgctgtttgggattatctcaatagaagcgtccttgctcaaaaaatnaaaaaaaaaaaaaaaaaaaatattccttaaacaaaaacataattcttataccccccacctcctaccccggaaaaaatntttgtttccccgaaaccccccgagggccccaattccccccctaaaggggggggcattttaaccggggcctcctcggcccctctttttttaaaaaccccggagaagggg

SEQ ID NO: 66919 - protein, 56 aa, Zea mays
  misc_feature: Ceres CLONE 1540459
MYAPHPSPQAQGRLQPSWKPVILMSLHVDVYQQRIILRMPTSVRSDCILLMSDISS

SEQ ID NO: 66920 - DNA, 664 bp, Zea mays
  misc_feature: Ceres CLONE 1540463
  misc_feature: Encodes the peptide sequence at SEQ ID NO. 66921
ggcctgctcaatccaaaagaggctccgggctgcaggaaatgcctcacccctagtaaaactaacccacccaagcggcaaccatggagccctcccctttcggcgccagcggctcggcggagcggtggcgcgcggaggcggcgcgggcgttccagcactacctggaccgctcggcgccgcacacggcggggcggtgggcgggcacgctcgtggccgcggcggtgtacgcgctgcgggtctactacgtgcggggcttctacgtcgtcacctacgggctgggcatctacctgatcaacctcctcatcggcttcctctcccccatggtcgaaccggagctctttgccgggcccgggctcccaaccagcggctcctacgagttcaagcccttcatccgtcgcctccccgagttcaagttctgggatccaattctataagacaatcataggcataccttgcttttgtgctagatttcgattgaaccagatctgctgactagttaggccctggttttgttagggcctgtttgtttaccccccaaattatataatctgggataaaaaaatcctaagaggcaaacaaacagtcccgccttatttggcccagatttataaatctaaaccccctgggatttttgaaaatccctaaaccaagtggggggagggccctt

SEQ ID NO: 66921 - protein, 116 aa, Zea mays
  misc_feature: Ceres CLONE 1540463
  misc_feature (2)..(116): Pfam Name: Rer1 Pfam Description: Rer1 family
MEPSPFGASGSAERWRAEAARAFQHYLDRSAPHTAGRWAGTLVAAAVYALRVYYVRGFYVVTYGLGIYLINLLIGFLSPMVEPELFAGPGLPTSGSYEFKPFIRRLPEFKFWDPIL

SEQ ID NO: 66922 - DNA, 632 bp, Zea mays
  misc_feature: Ceres CLONE 1540464
  misc_feature: SWISSPROT Homolog: EC 3.2.1.23 Beta-galactosidase
gctcttaactagtggatcccccgggctgcaggaattcgtctcacccctagaaaaatatgtttctctttttccttagcaaagaaggtgccttttatgttccttctgtgttgtatcgccattctttgggttccccttcccctatatagcttcacgccttcacctttacgttctttgttgtatcgaggagttacaaatgatgacttctcgctctgcaaatatgtatagatacgcaactcgacgctgtaacacattttgattctctactcctgaagaaaagcagcgaacgacaaagaataaaataaaaacacgctaaatggaaataaaaataaaaacaaaatgaaatgggaaaaacctggcgttacccaacttaatcgccttgcatgcacttccccctttcgcctgctggtgtaatagcgaagaggcccgcaccgatcgcccttcccaactgttgcgcagcctgaatggcgaatggaaattgtaagcgttaatattttgtaaaaattcgcgttaaattcttgttaaatcagctcatttttttaaccaataggccgaaatcggcaaaatcccttataaatcaaaagaatagaccaaaatagggttgagtggtgttccaatttggaacaagagccaaa

SEQ ID NO: 66923 - DNA, 801 bp, Zea mays
  misc_feature: Ceres CLONE 1540465
  misc_feature: Encodes the peptide sequence at SEQ ID NO. 66924
cagaatataacgaaccccgtctcccccccctcattcctacgtccaccccccctcctaaaactgacctccccgcggtggcggccgctctagaactagtggatcccccgggctgcagggattcgtctcacccctagaaaaaacctttccaccgtcaccatggccaccgccactacgtccgcctatcattgcaacgccgtcctccaccttcccagacctccgcagttccgccggctcctgccccctctcccctccctcgtcacccgcagagccgcgagcgtcgggctgggggtcgcccgtctcggttccagggcgagggcaagggcaagttccgtaccgccaccgccaccattttttgaaaccgtgtatgacgacgatgaggaggaggaggagcgtgcgtggtcggatgctgaagcgggattcagtgaccacccataggaatgaccatgaatggtcgggcggtatctcccccccccccgcggggagggcaccttgggcgcggaacccctgcgcagggacctttagcgggagggggcccgagaagatggccttatattacccgcgaagctgtttcccgtagaaaaacttcccgagcccatttccaccctccacggaaccaggcatagaagctatttccacatcccacaagttacctcgttcctcttcccaacggaggacccacatcccccattgcccaaatttcttggaacacacagtccaaagagaaacgcgctttcctgtaggaccaacacaccggaacatctccgtcccatgaagaaattcaggggcaaacgcctttctcat

SEQ ID NO: 66924 - protein, 92 aa, Zea mays
  misc_feature: Ceres CLONE 1540465
MATATTSAYHCNAVLHLPRPPQFRRLLPPLPSLVTRRAASVGLGVARLGSRARARASSVPPPPPFFETVYDDDEEEEERAWSDAEAGFSDHP

SEQ ID NO: 66925 - DNA, 605 bp, Zea mays
  misc_feature: Ceres CLONE 1540472
  misc_feature: Encodes the peptide sequence at SEQ ID NO. 66926
gctctagaactagtggatcccccgggctgcaggaattcgtctcacccctagaaaaagcgcgcaactcggcgtggcgtggcccggctctggcgagcagttgaagaaaccccaacgccaagcaccttccccaccggagcttcgctgacctgctgtcaatgtttctcctcgccgtgcttcatcgtgatggtctggtgaggttgcctttggtgcaatctatgctcaggtaaagaagaaggcgtcgaggcaaatctccaggagttccaggacttcgacgagttcaaggattaggctagcgacctcccccagtcagctgcctgtggtgggtttatttacgttggctatgtttctgttctgtgtactttgattatattatgtaaatgactctagtctttcatattattacttatgtttattgttattccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgc

SEQ ID NO: 66926 - protein, 76 aa, Zea mays
  misc_feature: Ceres CLONE 1540472
  misc_feature: SWISSPROT Homolog: EC 3.2.1.23 Beta-galactosidase
MTLVFHIITYVYCYSKKKKKNETLEVPNSPYSESYYARSLAVVLQRRDWENPGVTQLNRLAAHPPFASWRNSEEAR

SEQ ID NO: 66927 - DNA, 599 bp, Zea mays
  misc_feature: Ceres CLONE 1540474
  misc_feature (372)..(372): n is a, c, t, g, unknown, or other
ggccgctctataactagtggatcccccggggctgcagggaattcgtctcacccctagaaaaaataggggccatcagatccaagaagagggaagagcaccaaggaccttcggcgcccgttcaggatccacatcttcccgagcgagttcttggttgacctcttcccccttcggaccacctccaaggttatgtgaagccaaagacagtgacctaagcagatcaaaactaccaaggatgcatctataactgttagttatgctgtttgtatcttggttatacaatacagtagtataaaaaaacgaattggtgctcgttaaatagtacatgatgcatctagtcagctcaattcctgttttggattttgggtggttganttgatcataactcctttgttcgaatgtggacctcatcattatttcccaaaaaaaaaaaaaaaaacgagacgctcgaggtacccaatcgccctatagtgagtcgtattacgcgcgctcactggccgtcgttttacaacgtcgtgactgggaaaaccctggcgtaccccacttaatcggcctggcagacatccccctttcgccagcttgggtaataacgaaaaaggccc

SEQ ID NO: 66928 - DNA, 734 bp, Zea mays
  misc_feature: Ceres CLONE 1540475
  misc_feature: Encodes the peptide sequence at SEQ ID NO. 66929
  misc_feature (25)..(25): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
agaaggcgccaaacccatcccacanacccccccccncncncccccaataccatatactggaactccaccgcggtggcggccgctctagaactagtggatcccccgggctgcaggaattcgtctcacccctagaaaaaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcaggaggagcggctgatttttgattctctctgtccctccctccctcgcttcgctcgcgcggggtgcgtgcacgtaccatgagaagatgatgcccgccaggcccaaaggtacattcggcgacgccaccacggagagctcccctcctcctcctccccctccggctccggcttctgcagcggtgaaagaggacgagtgggaggtgcggcccggcgggatgctggtgcagaagcggaaccccgacgccgacgcccccgccggggcgcccgtccccaccatccccgtcaaggtcaagttcaacggcgtgtaccacgagatcctaaatcaactccccaggccctccttccgtgagcctgacgaaaaatgctgttcggccacggaaccgggcttgcg

SEQ ID NO: 66929 - protein, 101 aa, Zea mays
  misc_feature: Ceres CLONE 1540475
MMPARPKGTFGDATTESSPPPPPPPAPASAAVKEDEWEVRPGGMLVQKRNPDADAPAGAPVPTIPVKVKFNGVYHEILNQLPRPSFREPDEKCCSATEPGL

SEQ ID NO: 66930 - DNA, 680 bp, Zea mays
  misc_feature: Ceres CLONE 1540478
  misc_feature: Encodes the peptide sequence at SEQ ID NO. 66931
  misc_feature (387)..(387): n is a, c, t, g, unknown, or other
agtggatcccccgggctgcaggagttcgtctcacccctagaaaaaactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccggtcccccaccccccgatccncgtaccccgggaggagctcaagccggcgtacatgggcatctcctccccgcctaaagcggggcccccggttcgaattcctcgtccaaaacgtgcccgggagctaccggggggggggttctggccccttccaaaagggggatgttgttggagacctcgccccctcccccggggaaaggggggtccccccttccccacggataaaattccccccccaacaatctcgctaaaaaccgggggtccctcttctttcggggcggggaaccggggaaatacactggggaattctcctcccc

SEQ ID NO: 66931 - protein, 168 aa, Zea mays
  misc_feature: Ceres CLONE 1540478
  misc_feature (71)..(71): Xaa is any aa, unknown, or other
MRALPLLRSRFRSLTTAYAVKQDTALWTPAPVSAISAATDDGSVSLIAVDLSDATDLVDSYTNPVPHPPIXVPREELKPAYMGISSPPKAGPPVRIPRPKRARELPGGGFWPLPKGGCCWRPRPLPRGKGGPPFPTDKIPPPTISLKTGGPSSFGAGNRGNTLGNSPP

SEQ ID NO: 66932 - DNA, 634 bp, Zea mays
  misc_feature: Ceres CLONE 1540483
  misc_feature: Translation starting site: 115
  misc_feature: SWISSPROT Homolog: EC 3.2.1.23 Beta-galactosidase
ggccgctctagtctagtggatcccccgggctgcaggaattcgtctcacccctagaaaaatcctcatacctggttggcgaagccgacgccgcagccgagcaagatcctgccgacgatgagcatggcgaggttctgggcggcgccgttgaagatcacccccacgatgaagaagacgccggcgaccagcatggtgaggcgccggccgaggcgccgcgtcgtgtacgaggcgaagaaggtggccgtcagccccgcgaggtacagcgacgacgtgaacagctgcagcggctggttatcgtacttgcagtagttactctccttgtcctccagtttcttccgcagcaccgccgggaagaacttgcccaggaagtcgtccatcgacgtcacaccacctataatatatatacacacaaacaatgattttaattgtgtccaagatgtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttc

SEQ ID NO: 66933 - DNA, 856 bp, Zea mays
  misc_feature: Ceres CLONE 1540486
  misc_feature: Encodes the peptide sequence at SEQ ID NO. 66934
ggcaccgccgatagcaccaatcctaaccacaaccactaatacaaatttcaataaactggagctcaccgcggtggcggccgctctagactagtggatcccccgggctgcagggattcgtctcacccctagaaaaaagcatccaagaagctcaaagcaagcagatctaagctccaggcagcgtcgcgacagagtgagtgagtagcacgacaacaacaatggcttccctgaaggccgcgaagcccagcggagttgcggcgcatggcaaggagccggcgcccaagctcagcgagacggcgacgaagccgtcagccgcgaatagcggcggcgttaagaaggctgagcagaagcccccgggaaaacccaaaaggaaggttgaagagcaacccaacaggctggcgggcggcccaaaaaatgaacgtaacggtaacgttgtggaagggtaattggaagccttcccttgcactggagtggaatcccccccccccctggttaaatgaaatctaaggcccctttccttttccttgggcaaccttcccaatggggacacccgggccgtggtggcctttcccccccttcattgtgttctgaagggatgccccccggaaggaaaacccgcccccaattctaacaacaccgtcgtttgggcaaccttggtttgtcaaaaattcctaaacacccccgcataggggaggtcaccatggaaaaatttcccctcttttaggaaacaacgttccttggaaaaaaattacttacacccccccagggagaatgggggcgcccccccttttaaaacgggggcggggagaggccttttacaaccaaatcgggggagtgaaacccaacatcggttcggggc

SEQ ID NO: 66934 - protein, 75 aa, Zea mays
  misc_feature: Ceres CLONE 1540486
MASLKAAKPSGVAAHGKEPAPKLSETATKPSAANSGGVKKAEQKPPGKPKRKVEEQPNRLAGGPKNERNGNVVEG

SEQ ID NO: 66935 - DNA, 606 bp, Zea mays
  misc_feature: Ceres CLONE 1540492
  misc_feature: Encodes the peptide sequence at SEQ ID NO. 66936
  misc_feature (297)..(297): n is a, c, t, g, unknown, or other
  misc_feature (313)..(313): n is a, c, t, g, unknown, or other
  misc_feature (323)..(323): n is a, c, t, g, unknown, or other
  misc_feature (324)..(324): n is a, c, t, g, unknown, or other
  misc_feature (371)..(371): n is a, c, t, g, unknown, or other
  misc_feature (391)..(391): n is a, c, t, g, unknown, or other
  misc_feature (399)..(399): n is a, c, t, g, unknown, or other
cgtcttacagtggatccccgggctgcggattcgtctcacccctagaaaatctccgccgcttgctctaatcctctcccggcacgcgacacgtgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgangaaagaactggagggnaagcacgccnnagagagctgaagtattatttctccagttttacaatgatccttctatngcagctacttctggaaatcngaaccttnatgtgatttgtgctgctgggagcaatcgaactctggagttagaagtgtacccttccggtgatttctaagtttgaccggcggaaatttaacggactcaatcgggctttttaaaaaattcccagtttggggctaaaaaaaaaaaaaaaacagaacctccggggccccttttcccccttatgggggccgttttcccccgcccccctgggg

SEQ ID NO: 66936 - protein, 75 aa, Zea mays
  misc_feature: Ceres CLONE 1540492
  misc_feature (8)..(70): Pfam Name: DSS1_SEM1 Pfam Description: DSS1/SEM1 family
  misc_feature (64)..(64): Xaa is any aa, unknown, or other
  misc_feature (73)..(73): Xaa is any aa, unknown, or other
MAATPADAKTEAAKMDLLEDDDEFEEFEIDQEWDEKEEGNEAVQQWEDDWDDDDVNDDFSLQLXKELEGKHAXES

SEQ ID NO: 66937 - DNA, 698 bp, Zea mays
  misc_feature: Ceres CLONE 1540495
  misc_feature: Encodes the peptide sequence at SEQ ID NO. 66938
tctgaactagtggatcccccgggctgcaggaattcgtctcacccctagaaaaagcacatttgcagccccgctctctcgatcgaatcccaaggaacgaagacgacgacgatggcgtcgtctgcctggttgctccaagcttccacggccttcgctccacgcttctccctcccgtcccgaccccagcccccgctacacctgcgtctccgcggcccccccaaccgtcgccgtggcgtctcactcactgcttcctccgccgcgtccccagaagtcgagaaggagtcctcgccctcgccctcgccctccccggaggaatctctgtctgctgtcgcggacggtgtgaaggtgctcaaggtggccagcccaatacgagggaagtacctccccccgcaatttctctcggcgctgcccagaatcaggagggccaaccttggacccggctacaacttttttaaagacaccggttgggcccccacctctccaccacagaggtgaggagggtatttttttacaccgcaaacgggcatgtatggaaaaagcggccaaatttttcccaagtccgttaatctcccaacccctctttaccaccggcgggcaaacaccctccttgtatacacaataactggagagatccccattgcgggctccaaaaccactcgccaaagcggggtggtagatcgcgaaacacaatagacacgcct

SEQ ID NO: 66938 - protein, 127 aa, Zea mays
  misc_feature: Ceres CLONE 1540495
MASSAWLLQASTAFAPRFSLPSRPQPPLHLRLRGPPNRRRGVSLTASSAASPEVEKESSPSPSPSPEESLSAVADGVKVLKVASPIRGKYLPPQFLSALPRIRRANLGPGYNFFKDTGWAPTSPPQR

SEQ ID NO: 66939 - DNA, 726 bp, Zea mays
  misc_feature: Ceres CLONE 1540496
  misc_feature: Encodes the peptide sequence at SEQ ID NO. 66940
  misc_feature (410)..(410): n is a, c, t, g, unknown, or other
ccccgcggtggcggccgctctagaactagtggatcccccgggctgcaggaattcgtctcacccctagaaaaaatcgctcgctgagcttccgttgttgcacagcacatcgatcgacgacgatatcgggaagcaatatggggttggccttgtcgcggctggaggagattaggacgcagtaccgcatggcagcggaagacggcgaggctgacagtccggcaccggcgccagtgccgccgaccggtgctgctgctgcttccggcggcggcactgaaaagaagaagcaggcggacgactcgtcgtcgtcgtcaaagacgacagaatgggttcctcataagttctctgagatcgtcggtcaaagacgacctggtgaggatatgttccgagggatctaccttccacgatccccaccncagccgaaaaacaaagagtactgggtagatgggaggaaatgccaactgcttcatgctgttccctaaaaggattcagcattcccttgggttcggaacaaaaggtacttggaggttggccccagcctccccccagaaagagaaaaaaaggggttcccaccaccagggaggcccaaactggggggggtgggggtacccttaaaggaccttgttctctggctgggaaactcccgcgccaaaacttggaaaatttccccccccccctccccggggaatatccccctaagtgtgggcccccttttggaaccccaaaacccaa

SEQ ID NO: 66940 - protein, 113 aa, Zea mays
  misc_feature: Ceres CLONE 1540496
MGLALSRLEEIRTQYRMAAEDGEADSPAPAPVPPTGAAAASGGGTEKKKQADDSSSSSKTTEWVPHKFSEIVGQRRPGEDMFRGIYLPRSPPQPKNKEYWVDGRKCQLLHAVP

SEQ ID NO: 66941 - DNA, 702 bp, Zea mays
  misc_feature: Ceres CLONE 1540497
  misc_feature: Translation starting site: 111
tccccgcggtggcggccgctctagaactagtggatcccccgggctgcaggaattcgtctcacccctagaaaaaaccgaagcatcacccaatcagatccgatttcgtagagatgaagccggcagtagaggcggaggctgacgagcgagcggcggaggagatggcacctaagaaggcagcggctgccaagaaagcggccgaggaagttgaggtggaggaggtggtggacggggacgaggcggtcgatggggagggcgacggtgacgaggacgacgatggggaaggcggtgacgaggaggatgatgatgaggacgtggatggtgcacgataaccatccaccacgttgttcgtctttttttgagacggcaagctgaccggccgaccgggtctttgttggtcgcccccccctaccggccaggcaaggggccatggacaccccccttcaacccctctgaaggaaggggtcccccaagtttcatgacccagggtttatgaccaatgaagcccgaaactggctcgagccctctcacgggccggccagggccccccgtaaacggcgggctcgccccgcacccaacccccgaggtggtcccccctcgggaacacttgagctgccacccccggcaggccgttttaacgccccccaaacatccaccccccaggccccccccccctaaaaacaccacatctccccagctgcccgc

SEQ ID NO: 66942 - DNA, 676 bp, Zea mays
  misc_feature: Ceres CLONE 1540499
  misc_feature: Encodes the peptide sequence at SEQ ID NO. 66943
ggcggccgctctattactagtggatcccccgggctgcaggaattcgtctcacccctagaaaaaacttcagcgcaagccatcttcccgccacaggctcaaaagcaatcaagcgactcctcccacagtcccacttccactcccacccacccacaagcacggccgcaggcagcagcaccatgtggtcggcagcaacagcggcggcggcgcgcgcggtgtccgtgtccccagtcccggcgccctctctcctcagcggccggcgcggcgggtcgcggggcggccgggggtcggtgtcggtgcgcagcacggtgtgggacttcgtgggcggcgacctggtgcggccggacctgggcaagtggctggaccacctgtagaagcacaaggcgctggccatctccccgccgcacgatggcggctactagggtcgctacctgaaacgcctccgctaccagggctactacttcctagaactctccgcggcggggctcggcgacccggaaatcacgctcaccaaaggtccaccccgtctgtcccccctaacctcggcaaggcagcccggtggcggccgaggctactattccccccggagaggggactacccggcttcaggcctgttgacaacccggaaaccccaaaaggccttcatcccaaatgggactaattcgaaaacccaaagggt

SEQ ID NO: 66943 - protein, 64 aa, Zea mays
  misc_feature: Ceres CLONE 1540499
MWSAATAAAARAVSVSPVPAPSLLSGRRGGSRGGRGSVSVRSTVWDFVGGDLVRPDLGKWLDHL

SEQ ID NO: 66944 - DNA, 807 bp, Zea mays
  misc_feature: Ceres CLONE 1540500
  misc_feature: Encodes the peptide sequence at SEQ ID NO. 66945
  misc_feature (803)..(803): n is a, c, t, g, unknown, or other
aatcaacctaaaccgacaaatcactcgcacttcctcccaaccataatttaaaaaaaccggggctccccgcggtggcggccgctctttactagtggatcccccgggctgcaggtattcgtctcacccctagaaaaatctctccctcgccccctcactgctctcgctttcgctcgccatccgccgtcccgctccgcacaccggccctgcccgatgccttcgaccgccgcggccgcggcggcgcctttccaccgcatcgcatgcgcgcgtcagcacctccctcaaacccgtctcttcttcctcccatcccgcgcgctgctcacatccgaccgcctcaccgtcccggctccgctgcgcgtccacccgctgaggctgcctctgacggtgccactggcggcaaactacgatgccgccagttggattaacaccccccacctccaagcggcctgaatgctggtgtaccccacccccccgcatccgcttcaaaaaaaaattagggtcccccctgcttgcgtcacctaaacagacccccctcgcggttcgttcttaaagaaatgaccatcggtcagatccttgggctccttttgcctcatactccccaagataatcccaaacaattggcattggcctacccattcccacccggggagcattgtaccaaccccgggctcgccttttatactaattcgtaaaaatccctatttccgtccccagaaaacaccctgccctcccgcgcttatttcccacacacttgcgacaaccttggattcctaccccccagtattataaccctggctttcctcccnctcg

SEQ ID NO: 66945 - protein, 78 aa, Zea mays
  misc_feature: Ceres CLONE 1540500
MPSTAAAAAAPFHRIACARQHLPQTRLFFLPSRALLTSDRLTVPAPLRVHPLRLPLTVPLAANYDAASWINTPHLQAA

SEQ ID NO: 66946 - DNA, 685 bp, Zea mays
  misc_feature: Ceres CLONE 1540506
  misc_feature: Encodes the peptide sequence at SEQ ID NO. 66947
  misc_feature (356)..(356): n is a, c, t, g, unknown, or other
gcggtggcggccgctcttgactagtggatccccgggctgcaggaattcgtctcccccctagaaaaccagcctgtcctccctgcctcgtacgtcctctgcgcggtaccgggggggcgggggagtcctctttgtccgcacatcgccctccgctccgattcgccgaatcggcgctgggcgggcgagacgtgggatctcgacggaggagactccgaccatcgctccatggaggccgcggactctgaatccgtcatctccaccttcacctgtccgcactgtcagcggggaggtccattcttcaacattgcatttgcacagcgcgcactgcgctcggaaccttcagaagtgcgaacattgcngagatatggttgcccaggagcttatggatgaacactaccacccaaaccatgctccgatgaattgctcacttttgcaaacccacagtagaacgcgagctatgggatctttcttaccggcatacacatgcccacaaaggatgcctcgcgtgccaatactgtcagtttggacttgctgcagttgatctttttggaccttcggatctgtgtggaaaatcgaacgaatttgtccaaattgccgggaggttttccaaatttccgaaatggtttggaactgaaccccgttccttaccattttgaaggcggatcaaaacttttagggtacggggtct

SEQ ID NO: 66947 - protein, 58 aa, Zea mays
  misc_feature: Ceres CLONE 1540506
MVAQELMDEHYHPNHAPMNCSLLQTHSRTRAMGSFLPAYTCPQRMPRVPILSVWTCCS

SEQ ID NO: 66948 - DNA, 886 bp, Zea mays
  misc_feature: Ceres CLONE 1540511
tcgaattacatatgcttcccttcccattccttttctacccttaccaaatatcaaaaaccaaacccagtctacggcggcggttaactcttttactagtggatcccccgggctgcaggagttcgtctcacccctagaaaaaaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagctacacgccggcagggcacccttgtcagcccagcgtcaccgctcacgacttccacttccacggactggcccggccccggcaaaataaaccctcccatcatggccgccgtaaacctaaagctccgtgaaaccaatttccccgggcgataacagagcttgtgcatccccctccccacccacaatttcaacctacaaaggtggggactacgttaatgaccacctcccacaacaccaccacagtgatgctttcagaacctcccttccttatataaacccaatggtaaaccccttcagccgcccccgcttacttatcataatatttcccggccctccccatatttccgctttattacatactaagaaaaaccttgcagccgtccacgcgtcaacacacccataatggactacacctcgtaacggggaacaagccttccacactaaacaacggcacatcacccctccggataaaatcatacccacctccccattggaatttttttactccgcaaccatcacccgcactttttctttcgcaactccctgggttattgtattcgaacttgctcagccatacctctccc

SEQ ID NO: 66949 - DNA, 838 bp, Zea mays
  misc_feature: Ceres CLONE 1540512
cgaccgccctcggccgcccattccccccggaaaaacgcccgcgccgccccacgtttatacacacgccgcgcggaggccgcttttttaccgtggatcccccgggctgcatttttcgtctcacccctagaaaaaaacggactcacagctcgcagcacctgcaggacattgagaaccagccagctaacccaccaaccaaccggcggagccaaagccaagaaggaaggcaacgtgcccatccagccaggatgtgcaactcccacatcaagtacgcgggggtggcccagatcgactgccgcccggcgattccgcccgctagcaaaccccgtggcggcgtactgcgccggaaatctcccgtccgcacataaattatcccccccaaagcgcacctcaatgacggcccgactaataccgcaatggccatgggacgccccccacaccccgcgcggggccatagaaaaaatatgtaccccccccccccatattccacctttgcatgcctcccgacgaaggccgtttacctcacgccccccagagtgttttccccccgcggcataaatcattcccctttgttaccccgcccccccatgaaagcactatggtgaccctttgttctctcctgaaacagggaagaagctaactacagcgaaactggaacacgcaaacaaagacaaaaaaaggggaaatcctgcggcgcgccgggtacttcacacggtcaactatcccaccccgcatgtgttttcaaccataatacttcaaaaacaacgagaaaaggccacgccgccacaagtaggacacatcccgacgtcttcaatatcaaccgccggaagggatcgggcgg

SEQ ID NO: 66950 - DNA, 650 bp, Zea mays
  misc_feature: Ceres CLONE 1540513
  misc_feature: Encodes the peptide sequence at SEQ ID NO. 66951
ggcggccgctctagtccaaaggatcccccgggctgcaggaattgcctcacccctagaaaaacgccgcacacgcacgcgcgaacgcgctcccacccttttccgccgccaccgccgccgaaaccccggcccgactcggcgtcctccgccaacctcctcctgggcagcgccggcgggggatatggcatcggaggacgtggtgggcaagagcaggggcgacacggccgtcaccaccatcgtcaacctggcggaggaggccaagctcgcgcgcgagggggtcaaggcgcccggacaccatatcctcactatctgcaagtcgctcggcaccggcggcgtagcatgttttttgtctcgtactgctgctgctccactttaacgattgaaaatattgcttcacgttcaaaatccgcacagcatcaagtacaatggcactgttcacggtctccaggatatctggagaacagagggcctccgtggacttttctagggcaatggtaccaattgtgcaaggattgttccaaattctgccgtgaagttttttagctacaagcatgcgtcgaagggaattctgtgggcctaccgtcaacagactggagaagaggatgctcagcttactccgctcttgcgccttggagctggagcatgtgctggta

SEQ ID NO: 66951 - protein, 64 aa, Zea mays
  misc_feature: Ceres CLONE 1540513
MASEDVVGKSRGDTAVTTIVNLAEEAKLAREGVKAPGHHILTICKSLGTGGVACFLSRTAAAPL

SEQ ID NO: 66952 - DNA, 683 bp, Zea mays
  misc_feature: Ceres CLONE 1540514
  misc_feature: Encodes the peptide sequence at SEQ ID NO. 66953
  misc_feature (403)..(403): n is a, c, t, g, unknown, or other
  misc_feature (489)..(489): n is a, c, t, g, unknown, or other
  misc_feature (495)..(495): n is a, c, t, g, unknown, or other
  misc_feature (496)..(496): n is a, c, t, g, unknown, or other
tccccgcggtggcggccgctctagaactagtggatcccccgggctgcaggaattcgtctcacccctagaaaaagctcgtgccagcaggccattcttctcgccttactccctcacagaacccagtaaaatattgccagtcccgccgtcgagatggccccacgccgcctgctcgtcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaagtccacaagcggttcaggatcttctccnagagtctccagctcgtccgctccaccaatcggaaaggcctctcctacccgctcggcatcaacccgcttcgcggacatgagctgggnagagtnncgtgcgaaccgggctcggcgcagcccagaactgctccggcacgcttaccggcaaccaccggatgcgcgccgcccgccttgcccttgcggaaacaaaagactgaagggaggatgggattgttgagcccagtgaaaaacccgggcacctgtggaacatgcttgaccttcagcccaacggggggccttga

SEQ ID NO: 66953 - protein, 177 aa, Zea mays
  misc_feature: Ceres CLONE 1540514
  misc_feature (59)..(112): Pfam Name: Inhibitor_I29 Pfam Description: Cathepsin propeptide inhibitor domain (I29)
  misc_feature: SWISSPROT Homolog: EC 3.4.22.16 Cathepsin H
  misc_feature (85)..(85): Xaa is any aa, unknown, or other
  misc_feature (116)..(116): Xaa is any aa, unknown, or other
MAPRRLLVLAVVALAATAAAANSGFADSNPIRPVTDRAASALESTVFAALGRTRDALRFARFAVRYGKSYESAAEVHKRFRIFSXSLQLVRSTNRKGLSYPLGINPLRGHELGRVXCEPGSAQPRTAPARLPATTGCAPPALPLRKQKTEGRMGLLSPVKNPGTCGTCLTFSPTGGL

SEQ ID NO: 66954 - DNA, 898 bp, Zea mays
  misc_feature: Ceres CLONE 1540516
  misc_feature (898)..(898): n is a, c, t, g, unknown, or other
ttacagtggcacatcccaacctccttacccccccctatcgcttaacccacaacactataactccccgcggtggcggccgctctattaatagtggatcccccgggctgcaggaattcgtctcacccctagaaaaacccccgctgcattccatcccgaccccgtctgccactggtcacaccctctccatcgcttcctgccaccgaccacaccctctcgatcgccattcgccaccggccaaatggaggccatccggaaccaggcctcaaagttccgggagcaggtggctcgccaccagcaggcggttatgaagcactcccccgcccgtacagctccacaatgtccgtcccctaaacgaggcctaggcgccccatccactcccagctccaagaactcataaattaacataacaacgcccctaaattagcttccaaaaacaaatacccccacccccgccctccaagggttatacatttaccatccggcaccaacacgcacgtcctaactccccgagatacaaactaataatatccaccctatgggctacccatacatcctcggataactatacaccgaaccaatattcctccccggcgcgtagaaaaaatagcccgttctttacaaataccgccgaacaacaattcattgttttacacaattgctaacaccaccgttcacctctctctcctgacaattgggattataccaccacgccccctacagcacacctgaacaacagcccaccgccgcgtacaataataattcctcagtataccaacacacatatttgagcagcgctccgccgcttctgatacccatcatttcaactatccaaccgccatataagaattcaaaccacccatacttaatatccacccggtaaaccacgcaccaatccccn

SEQ ID NO: 66955 - DNA, 693 bp, Zea mays
  misc_feature: Ceres CLONE 1540517
  misc_feature: Encodes the peptide sequence at SEQ ID NO. 66956
tggcggccgctctagactagtggatcccccgggctgcaggaattcgtctcacccctagaaaaatctccctcttcctcctccgcctcctcttcctctcttttgcttttgtgttgctgttaggttcttggatagtgtgcatcggcaccagcagcagcagtagtaattcatactagtgggcggtgtgatagcagcagtgagatcgaggagaggatggaggtgttcatccacgaggactacgtgaacaagcgcaacgagctgaggagggagcagaggcgccgggaactgcagaggcctgcaggtggagagcaacctcgacgcgttcccggggaagccgctgcaagcccggaagagccccgaagacccccggctcattgccttgaacgcccaccggccccccccccgtcccagttttagaaacccccgactttcgagggagccacccttgcaattccccgggccccaaacgggccggggaaagggtttccttggttgggccccttggaaaaatatcccccccctcttagaaaatggctttaaaggccgttacttatttgggtaaggccaaccggggaaggggcccccaatccccgtgtggggaaaaccgggcccaaaaagtggtgattttttccccccaacaaaaaataaaccgcgggaaaaaacctctcttgtgggtgcaaaaaacacccctttctt

SEQ ID NO: 66956 - protein, 67 aa, Zea mays
  misc_feature: Ceres CLONE 1540517
MEVFIHEDYVNKRNELRREQRRRELQRPAGGEQPRRVPGEAAASPEEPRRPPAHCLERPPAPPPSQF

SEQ ID NO: 66957 - DNA, 897 bp, Zea mays
  misc_feature: Ceres CLONE 1540518
  misc_feature: Encodes the peptide sequence at SEQ ID NO. 66958
  misc_feature (472)..(472): n is a, c, t, g, unknown, or other
ggcagacccccacccaccacccccccccccctagtccccccccccacaccccaaaatcaaactccccgcggtggcggccgctctatactagtggatcccccgggctgcaggaattcgtctcacccctagaaaaaaaagcgaggcgatgctgcagtctccgcctccattccggcctggtgtccaccctttgtcgcttcttctctgcgctgcgaccatcgtcaccaccagccaccatcaccatccctcctctcggcctcgcggtcgcagcggtcagagcctccgagatggagctccgcctctgcctccgtctccacgcgcgcctcccacctgccacggcgccaccgcctttccaggccgccgcggtgctccccgcctcccgcccccttccgacggatggtagctacggggtttgctctttagggggaaaacaaagacttttcaagtccgggaaatctggcgctttttaaacaanccagtgcgcaaacaagggccttgggcttcttaaaaggaaaaaggagaagcgccccgggtgaaatcccctctttttccccggtaggggcgccgggaaaaaaaaaaaaaaatggggggggcggcaaataattgccccacaaagacacgggtatcctaaccctctttacctaagggagacttaccaaaatttgggcatttgtgaacaggtgtctaaaaaacacgctttcctctctcccctctgaaagtgaaaattccacaaaacaaccctttttgggcgcacgggggggtggaattccccgaaactaacaccgggggtaagttatatttcggaagcggctctcttttttagaaaaaccttgtagaaaagagacccttttataacctttttcccaccccctccaggagggaataataacaacccacccg

SEQ ID NO: 66958 - protein, 60 aa, Zea mays
  misc_feature: Ceres CLONE 1540518
MELRLCLRLHARLPPATAPPPFQAAAVLPASRPLPTDGSYGVCSLGGKQRLFKSGKSGAF

SEQ ID NO: 66959 - DNA, 677 bp, Zea mays
  misc_feature: Ceres CLONE 1540529
  misc_feature: SWISSPROT Homolog: EC 3.2.1.23 Beta-galactosidase
  misc_feature (677)..(677): n is a, c, t, g, unknown, or other
ggagctccccgcggtggcggccgctctagaactagtggatcccccgggctgcaggaattcgtctcacccctagaaaaactggactgtgttctcaccttttctcaaactggttggtgcttttggctcggtgtggggccgcagtggtgtggggggttgaagcatcaagcagcgatttgtgttatgggaggaaactgttcccgctgtattgttcattttattccccttctctttctcaccgcctgattttcttcccctttgttccctccttgctgtgattcttgtagagttctgcacttgtatggttctatgttgttgggccattagttttttttccctttctgtttttgactacctcgatttgccatatagatttttttaccatttaagcgcagctagtcaacctgtagcattgtttgcaatcggcatctgagttgagctctgcctcccctgagattggaaaatgccagacgaatactacaaatataaaccttggtgtaactgcgcgccgctcgaggtacccaattcgccctatagtgagtcgcattacgcgcgctcactggccgtcgttttacaacgtcgtgacggggaaaaccctggcgttacccaacttaatcgccttggagacatccccatttcgccagctggggtaaaacctaagaggcccgcacctatcgccn

SEQ ID NO: 66960 - DNA, 552 bp, Zea mays
  misc_feature: Ceres CLONE 1540539
  misc_feature (355)..(355): n is a, c, t, g, unknown, or other
ggagctccccgcggtggcggccgctctagaactagtggatcccccgggctgcaggaattcgtctcacccctagaaaaaacaacaacctgtgcgctttcaaccttgagcatgggaccaaggaactcgtccaaactcgttaccagtcggtccgaaggccaaggggcgcaatgactaccaccgttggcctgagcgagacccaggtctttatgggttttatcccccttcccccttaaaaggtaaaatccccccaaacggtaatggtggatgatcccgttcccgtttttcccccccccaaagaatggggcccccttttgaactggtggggccctcccctttggaagggccattttttccnccccaatttaagggccgtaaaaaacccccgtttttcccaaaaattttgggtttttccccttttgaaatgagagggttcttttttttttatttaccaaaaaccccctttttttttttttggcaaaaaaaccaatgtttttaaaccacttttttgagctcttttttttttaagaggggggttgtcccccccctaaaaac

SEQ ID NO: 66961 - DNA, 702 bp, Zea mays
  misc_feature: Ceres CLONE 1540541
  misc_feature: Encodes the peptide sequence at SEQ ID NO. 66962
ccgcggtggcggccgctctagaactagtggatcccccgggctgcaggaattcgtctcacccctagaaaaaagggcattctcgagcatagcttttctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtattgactccatagcagcggatctgaaggagaacaagatgaccatcataggcgagatggatgcagtagcgattgtccagacgttaaagacgattgaaaagatcgaccttgtgtctgcttgaacccgccatattatcaatgcaaggatgaataagccccaccataaaaatgtcggaaaatagcaagaaaaaaaatagaccgcaccaggggatcccactcccccccccctattagagtcatagagtaaatgctcctaaacagggccatccgcttcccaaaccaaactttaaaacggggcaaacctttgaagaatttccctcaaccccaaatcccctgtgggatgaaagagcactccttttaccgccctttcgtgatcccaaatatataaaaaaaaaaccatgctctttggttccccacccccccccccacacctttttttcaacccccccgccactttga

SEQ ID NO: 66962 - protein, 71 aa, Zea mays
  misc_feature: Ceres CLONE 1540541
  misc_feature (8)..(68): Pfam Name: HMA Pfam Description: Heavy-metal-associated domain
MAQQQKVVVRVPTMTDDKIKQKAIEAVADIYGIDSIAADLKENKMTIIGEMDAVAIVQTLKTIEKIDLVSA

SEQ ID NO: 66963 - DNA, 665 bp, Zea mays
  misc_feature: Ceres CLONE 1540549
  misc_feature: Translation starting site: 169
  misc_feature: SWISSPROT Homolog: EC 3.2.1.23 Beta-galactosidase
  misc_feature (313)..(313): n is a, c, t, g, unknown, or other
aagctggagctccccgcggtggcggccgctctagaactagtggatcccccgggctgcaggaattcgtctcacccctagaaaaaatctcaagtcttcacactcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtnggaggcgccaccgcccaccggccaccgctgcggatatctaggtgttcggatgcacgtgagcgcgcactggttccagtttgtaccatgatgtaaattacttaccgtaccagggttcaatcggcaaggaagaattgttgtgttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaaagttgcgca

SEQ ID NO: 66964 - DNA, 697 bp, Zea mays
  misc_feature: Ceres CLONE 1540550
  misc_feature (363)..(363): n is a, c, t, g, unknown, or other
  misc_feature (428)..(428): n is a, c, t, g, unknown, or other
gctggagctccccgcggtggcggccgctctagaactagtggatcccccgggctgcaggaattcgtctcacccctagaaaaaccccgccccaccaaacactcccgcagacccacagccccgcccgtccccgtccgtccacagccagctccgcctcccatccagcgcccgtccacagccgccgcagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgnttcttcttcggtttgggttctagtctagcagtgtactagtactagtcgttaggttggtagccaangagaggtcttttttcacacctcccttgcgcaagtgagtcctgtccctgagtggatctacccaccactgccatctggttttacctggggctgttgggtgtccgcacagttccttcctttggtccttgggtttgcaaaaaaggggggaaaaaaaaaaaaaaaaacggagaccctcgggggcccccaattccccctaaaaggggggccgtaattcccccgccccccggggccgcgcgtttttaaacctccggggacgggggaaaaacctggg

SEQ ID NO: 66965 - DNA, 664 bp, Zea mays
  misc_feature: Ceres CLONE 1540554
  misc_feature: Translation starting site: 159
  misc_feature: SWISSPROT Homolog: EC 3.2.1.23 Beta-galactosidase
gctggagctccccgcggtggcggccgctctagaactagtggatcccccgggctgcaggaattcgtctcacccctagaaaaaggaccagaacccgatcgggccattggggacggggcggagaacgcgagtactcaggctctaatatttttacaaaatcgatggaaagttctaaatctcctcagtcatcaaaaaacagtcggattgtggtgccttctgatagtaatcgcccccgatttgacaatgacggtttttcttcagaaactgcatcaaatcaaatggtcgtgttcaactctgaagcagcagatgaactgggagaaaaccgtctgcagaagtcagtgataacaaagggaatatcaccatctattggagcattcactgtccaatgtgctaaatgttttaaatggaggcttattccaacaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattt

SEQ ID NO: 66966 - DNA, 677 bp, Zea mays
  misc_feature: Ceres CLONE 1540557
  misc_feature: Encodes the peptide sequence at SEQ ID NO. 66967
ctccccgcggtggcggccgctctagaactagtggatcccccgggctgcaggaattcgtctcacccctagaaaaaatgccctcgactgcagcctgcaccacacggcccctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctactgcgccgccaggaagctcaggcgccacgccttccagctctacaaccgtaggaccgacgccatagctgcttacgtctacgtctgccagcagcaggccggtgccgccaccttacagaccgacgccgccatccatgacgccgccaggccggaccgtcgttctgtgacgtgcacggagccctggtgggctcctccgggatactccccctaatttatgggtcgagggcctgggagggcggaagcctcctgagtgccacatgctgcttgctttgaaccctccccgtcccgtctggggcacccgggggaagggaagggggggggcttgggccccc

SEQ ID NO: 66967 - protein, 87 aa, Zea mays
  misc_feature: Ceres CLONE 1540557
MVFPAILPKVAVRLLFTFYCAARKLRRHAFQLYNRRTDAIAAYVYVCQQQAGAATLQTDAAIHDAARPDRRSVTCTEPWWAPPGYSP

SEQ ID NO: 66968 - DNA, 630 bp, Zea mays
  misc_feature: Ceres CLONE 1540560
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaatgtgtgtcttttgtttcacattgcgttgcttatgccagtacgagatgatgacttggcgttgtacactaggatgaaccatgtttgtgccatagtggtggtttttgtttcctgctggttacattgttgatatccattcatttggttttctccgaaactaactcacctcaccagacgctctaggtacccaattccccctatcgtgagtcgtattacgctctctccgtggccgtcattgtacagcggactgactggaaaaacccagccgttacccaccttaatcctcttgcatcacgtccccctttcgcccgctggcatgatgccaaagaggcacgctccgatcagcccttcccaacagttgcgcaccctgactggcaaatggaaattggaagcgtgatatttgtgtacaattcgcgtaaaatttttgttaaatcagctcatcttcttgaccagtaggccgaagtcggctatctctcttgtaaatcaaaagaatagaccgagctcgggttggactgttgttccacttttggacaagagtccactattaac

SEQ ID NO: 66969 - DNA, 626 bp, Zea mays
  misc_feature: Ceres CLONE 1540561
  misc_feature: Encodes the peptide sequence at SEQ ID NO. 66970
ccgcggtggcggccgctctagaactagtggatcccccgggctgcaggaattcgtctcacccctagaaaaaacctacagcgggaagtggtgctgcgtgagctgtctcctgccactagatccggcgcacccaacgccagatgacagatcagggcgcgccggccgtctccattgcccgggggatcctgcgatgatatctggacctagagggaggagcgagggagctcgcgggtacagaatgcgggacggggggacgaaggaaggaatgagctccggccggagcagacgtcccctcttggccctcggtcagatgagatccaccagcaaggtgcaactggccaaccgacggcggagcaggagccccttcctgacgtcctactcactctcacgcaacttaatcaccttcatccccgtgacactacttcaaagagttctaatcatggatgtaacgacccttcctaaactgcccacacgtccatgacgcccgagaatatatccaggaaaggtgccgctctgctgcggaacggctgccgctcacattgtttgctacacttgtgcagagtgactctccgagaagctactgggtagcccatgacgaagctcgagcttgtcaacagttatgaggagac

SEQ ID NO: 66970 - protein, 56 aa, Zea mays
  misc_feature: Ceres CLONE 1540561
MRSTSKVQLANRRRSRSPFLTSYSLSRNLITFIPVTLLQRVLIMDVTTLPKLPTRP

SEQ ID NO: 66971 - DNA, 663 bp, Zea mays
  misc_feature: Ceres CLONE 1540562
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaaaaaaacatgacaaggccattcctggatctgacatcggcttccaattgacggtcagtgctggcacagctgctgcagggtccgcgagtaggacggctctaatctctccatcacgtgttattatctggtgtttccataatgcgatttgatttcaatttggcgttagatgttgtacacgtgtatttaactgcttgagttgtacgtaatttgtatacttgtaactttgtttaataatatggctattactcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaaga

SEQ ID NO: 66972 - DNA, 651 bp, Zea mays
  misc_feature: Ceres CLONE 1540563
  misc_feature: SWISSPROT Homolog: EC 3.2.1.23 Beta-galactosidase
  misc_feature (651)..(651): n is a, c, t, g, unknown, or other
ctggagctccccgcggtggcggccgctctagaactagtggatcccccgggctgcaggaattcgtctcacccctagaaaaaagccgcaccgcgctcacttccgcaccctcttcccgccgcgccgccgcccctctctccctctcgtcaggttggtctgaattctgaagtcatgggtgcaattcgcttcgcggtgatctcttaagctcatcacatatataaaagcaacctcagttggctatgtaagacatggcgtgccaaactatcagtgaccactgccagctttgcaatacgttgttgtatggtcaacctgcaaacttggtgtactgctactcgtactataaataacatagggttttaaccttggttgtgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcn

SEQ ID NO: 66973 - DNA, 664 bp, Zea mays
  misc_feature: Ceres CLONE 1540564
  misc_feature: Encodes the peptide sequence at SEQ ID NO. 66974
  misc_feature (547)..(547): n is a, c, t, g, unknown, or other
ggagctccccgcggtggcggccgctctagaactagtggatcccccgggctgcaggaattcgtctcacccctagaaaaaatcactgtgtgggtgactactgtcgcctcttcgccattctccgtcgacgcaccgtgggcggcgactagctgagtcgtaagaggacaaggaagctgctagatgtccgcgaccactgtctcggtgcccttctggcgggcggctggggatgacctacatcggctactcccacatctgcgctgcgctggtccggaactgcctcacggagcccttccagtctgaagccgcatcccgcgagaaggttcatttctccatttccaagtggacggatggcaagcacgagaagccaactgtccgcacagaatcggatgactaacggctggcgccatggcgacatattccttccaacacatgatttgaagcgtctttgcaagtttctgggacttgttatttagttggcttgatttgtcatcaatgctgaagaataaatactttttgcgacaatggtctttttatcatgtcgtgtagccantcgttgctgatcggcaaaatcccttactagatcgctcgaggtacccgattcgcccgttgagtgagtgggtattactcggcgactacatggccgctcttttttacaacgtggacgact

SEQ ID NO: 66974 - protein, 55 aa, Zea mays
  misc_feature: Ceres CLONE 1540564
  misc_feature (1)..(42): Pfam Name: ATP-synt_Eps Pfam Description: Mitochondrial ATP synthase epsilon chain
MTYIGYSHICAALVRNCLTEPFQSEAASREKVHFSISKWTDGKHEKPTVRTESDD

SEQ ID NO: 66975 - DNA, 826 bp, Zea mays
  misc_feature: Ceres CLONE 1540567-R
  misc_feature: Pfam Name: Ammonium_transp Pfam Description: Ammonium Transporter Family
cgaattgggtacctcgagcgtctcgtttttttttttttttttcattttaaacttggaataatattattgatataaaaggcacgaccgtcaaagccgctagattggatgatgagcagtgaccacaggacagaatcgtccacttgttgtttcaaccctcatagtcatagaagccacctatcttgaccagcagcccgccacaccttccgatggatatccgatcataagattaattccactacgaaaataacccaaagataaaccctctcctagcccctgcccaccaccatgtgcacacaaaccccaactacgtaacgtaacacatgcgtgcttcgtcgccatcctcttctataatttacacgatttctcgcgactcccaagtagccaagtatttgcccaaacactgcgtaccggcagatacgatccacctcgaacgtgatacgcgacaacacactgaaaaaggcaagcacgtaacttcagctcggtttcaatttgctcctgattttttttttacacctggctgctggtcgccgccgccgccgccggctcgacacggttctgcgcggacttgagcatgaacccaccaaccccggccttgtcgccaggttcctcgtcgtggtagacgtaggcgaagccgccgtgccggggcagggtcatgccggacatctcgtcgtcggccgagatgcgcagcatggccagcttcttgagcgcgtaaaaaagcggcccatagtgcagctcacccaccggcgatcaccaggatctggatgatctgcgccggggaggagcttcccggccgccgccattgaacagcccgttagggcctcccggg

SEQ ID NO: 66976 - DNA, 674 bp, Zea mays
  misc_feature: Ceres CLONE 1540571
  misc_feature (299)..(299): n is a, c, t, g, unknown, or other
  misc_feature (424)..(424): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (480)..(480): n is a, c, t, g, unknown, or other
  misc_feature (502)..(502): n is a, c, t, g, unknown, or other
  misc_feature (503)..(503): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (585)..(585): n is a, c, t, g, unknown, or other
  misc_feature (633)..(633): n is a, c, t, g, unknown, or other
  misc_feature (647)..(647): n is a, c, t, g, unknown, or other
tggagctccccgcgcggggcggccgctctagaaatagtggatcccccgggctgcaggaatttcgtctcacccctagaaaaaacacgttgatcacgacttgcatgtctactactactattcgatgaaaaaactctctcgcggcacgtcgtccttgtgtctgtggtgtgtgtgaaagagagaggagagccggcctgtccttttggctgtttggtttatttttgagttcatgcggtctttatttatttccatgtacccagtacccacctttgtaccatgcatgttccttatgatacacttcnaccctcttttttgttgcaaaaaaaaaaaaaacgagacgctcgaggtcccattcgccctaatagtgagtcgtattacgcgcgctcaactggcccgtcgttttttacaactcgtgactgggaaaaanacctcggggttacccaaacttaaatcccccttgcagcaatccccccttttnnntcnccccagtcgctatagcagagcnncgcacgatcgcccttccacagttgcgcagctggatgcgaatggaaaattgtagcgtttatattttgtnnnaattcgcgtttnaatttttgttaaatccagctcatttttttaaaccaaataggccgaatncggcaaaatccctnataaatcaaaagataacccgagattgg

SEQ ID NO: 66977 - DNA, 657 bp, Zea mays
  misc_feature: Ceres CLONE 1540582
  misc_feature: Encodes the peptide sequence at SEQ ID NO. 66978
ctggagctccccgcggtggcggccgctctagaatagtggatcccccgggctgcaggaattcgtctcacccctagaaaaaaagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggatgagcagggacagttccccaagcgttgggccatcgtcttcctctgcttctccgcatttctactctgcaacatggaccgcgtaaatatgagcattgctattctgcctatgtccgcagagtttggttggaacccacagactgttggtctcatccagtcatctttcttctggggctacctcctaactcatatagctggaaggatatg

SEQ ID NO: 66978 - protein, 44 aa, Zea mays
  misc_feature: Ceres CLONE 1540582
MDRVNMSIAILPMSAEFGWNPQTVGLIQSSFFWGYLLTHIAGRI

SEQ ID NO: 66979 - DNA, 669 bp, Zea mays
  misc_feature: Ceres CLONE 1540586
  misc_feature: Translation starting site: 147
ggcggccgctctagaactagtggatcccccgggctgcaggaattcgtctcacccctagaaaaaagcgaggggcaacggttttctcggagaacggaatgtagcctcttcctcgtcgccggctacgtcaccctctgcggctatcatggatgccggtcagggtggtatataccgccacgccttcctcccagccctccccagggcaagaagcaaatactggacacccatctcctcctagctgttcactcttaagtgctggaagatcttttgctgggactcaaaatagtgcatgcctgcacaatgatgaagcttggatagtgaatgtgacgcatgcatggttgtgatcttgagcaggattacttatgtgatactatcgaagcagcttaatgctccatttgcagaatcacatgttgtgtacttcggagaaggagacatagaaggtgctgataaattacacttgtttcccaggcaaccgggaagccttccccggattgacattttaagaatttggtcccaaagttcccctccatttttcccccccctttagaaatccaaaaataaaaaaaaaggggggcgaaacctccgggggttaaaaaacccaccccctttttatccccccaaacagaaaaacactttcttttttccccccgttaggaaactcccccggggtgg

SEQ ID NO: 66980 - DNA, 597 bp, Zea mays
  misc_feature: Ceres CLONE 1540591
  misc_feature: Encodes the peptide sequence at SEQ ID NO. 66981
  misc_feature (300)..(300): n is a, c, t, g, unknown, or other
  misc_feature (301)..(301): n is a, c, t, g, unknown, or other
ggagctcaccgcggtggcggccgctctagaactagtggatcccccgggctgcaggaattcgtctcacccctagaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctnngcgtcggaagggctaggggtctaaggagcaaacccttcggggttataaccattgggcccccgggtttttcgagaaaccacacaaagggggggggggggggggggttttttttataaaaaatcccgaggggggggggggggggcccttaaaaaaaaaaaaaatgggggggcccccctggttgggttttttctcccccccaaaaaaaaatatttctttggcgggggactttttttttttttttttttaaaaaaaaaaaaaaaaacccccccctctttttttttttttttttttttttt

SEQ ID NO: 66981 - protein, 51 aa, Zea mays; identical to SEQ ID NO: 2355
  misc_feature: Ceres CLONE 1540591
  misc_feature (9)..(51): Pfam Name: Ribosomal_L39 Pfam Description: Ribosomal L39 protein

SEQ ID NO: 66982 - DNA, 642 bp, Zea mays
  misc_feature: Ceres CLONE 1540595
  misc_feature (246)..(246): n is a, c, t, g, unknown, or other
gtggcggccgctctagaactagtggatcccccgggctgcaggaattcgtctcacccctagaaaaaaccgcggcgtgcgcggaccgtgcgtccgtgccctccggctccggcgcaccgctccgctcattccatctccatccaccgcgccccaaatcgcacggccccgcctccccattcgcgccgatcgaatcccaatcggcggccatgagcgtggtcggcttcgacgtcggcaacgacaccctggtgngcggcggcggcgcggcagcggggcattgatgtgctcctcaacgccgagtccaagcgcgagtcacccgccgccgtcgccttctcccacaacgcgcgcctcatcggctgccacgccgcgtccgcctcgtccgcccacgcccccttctccagcgtcaaacgcctcctcctgggcgccacggggaggaacccggactcctccctcctccgcgacctcccccgcctccctttctccgtctcccacgcctccggtggcggcgccgtcgtccacgttgaccacatcggccgccgcatcgcgctctctccgacccatctcctctccatgctgctcgcctacctcaagcagctcgcggaggccgacctcggaggcgcccccgtcgccgactgcgtgatctccgtg

SEQ ID NO: 66983 - DNA, 696 bp, Zea mays
  misc_feature: Ceres CLONE 1540599
ctggagctccccgcggtggcggccgctctagaactagtggatcccccgggctgcaggaattcgtctcacccctagaaaaacctcgagctctactcgcataccactgcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatctcaggtcagtgaagctcacaccaattactacttgaactctaccactattggttgcctggaactaggtgtgaaatttggtctaaaatagggttgtcagatttcagacttagtgcaaattcagagtctgaatttgtatgttttgggtgcagcttttgagctctttgctgctctatccatagagctatagcttatggccactataacaaagttataaatctatttctaggagaaaaaaaaaaaaaaaacgagacgcttcgaggtacccaatcccccttaatagggagtcctataccccccccctccctggcccgcctttttacaccgtcctggccgggaaaaaccctgggcgttaccaaatttaatcccccttggaaaaaatccccctttttccccagttgggggaaaaaacgaaaaag

SEQ ID NO: 66984 - DNA, 656 bp, Zea mays
  misc_feature: Ceres CLONE 1540602
  misc_feature: Encodes the peptide sequence at SEQ ID NO. 66985
  misc_feature (505)..(505): n is a, c, t, g, unknown, or other
  misc_feature (632)..(632): n is a, c, t, g, unknown, or other
ctccccgcggtggcggccgctctagaactagtggatcccccgggctgcaggaattcgtctcacccctagaaaaaaggagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcatagggcgacgntggtgatgagcctgctccgcatctgccccgagttcccttcacctttcctggggcgccgcccgcctgggcgcccgcaccacccacggccaacccgttctacaccccgcacgaggtccaccgccaggcnggaggcggccggcgcccaagctca

SEQ ID NO: 66985 - protein, 95 aa, Zea mays
  misc_feature: Ceres CLONE 1540602
  misc_feature: SWISSPROT Homolog: EC 6.2.1.12 4-coumarate--CoA ligase
MGSVDAAIAVPVPAAEEKAVEEKAMVFRSKLPDIEIDSSMALHTYCFGKMGEVAERACLIDGLTGASYTYAEVESLSRRAASGLRAMGVGIGRRW

SEQ ID NO: 66986 - DNA, 639 bp, Zea mays
  misc_feature: Ceres CLONE 1540607
  misc_feature: SWISSPROT Homolog: EC 3.2.1.23 Beta-galactosidase
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
  misc_feature (639)..(639): n is a, c, t, g, unknown, or other
tccccgcggtggcggccgctctagaactagtggatcccccgggctgcaggaattcgtctcacccctagaaaaactaataagcctaccgaacgtacacgaacgtcccgcgcgctgcacgagtgatgaagccaggggagaaataaaataaagccgctgtattgccaggagcagcatgcattatttatcgatctatatatatactgtactgtagtactctattatatatgtatatatgtgtggcctgcagtgcgagttgcttcgatccacctacttgttcacacagtttaatggttttggtgcctgttatgannnanannnnnnnnnannnannaaaaaaaaaaaaaaaaaaaaaaaaaaaaaaaaaggaaaaaaaaaaaaaaaaccgagacgctcgaggtacccaattccccctatagtgagtcgtattacgcgcgctcactggccgtcgttttacaacgtcgtgactggaaaaaccctggcgttacccaacttaatcgccttgcagcacatccccctttcgccagctggcgtaatagcgaagaggcccgcaccgatcgcccttcccaacagttgcccagcctgaatggcgaatggaaatgtaaccgttaatattttgttaaaattcgcgttaaattttgn

SEQ ID NO: 66987 - DNA, 649 bp, Zea mays
  misc_feature: Ceres CLONE 1540610
  misc_feature: Encodes the peptide sequence at SEQ ID NO. 66988
aagctggagctccccgcggtggcggccgctctagactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccgggagctgcatgtgagtcacaagagtgaaacccccatctccctcgaggagaaccgggactgtc

SEQ ID NO: 66988 - protein, 104 aa, Zea mays
  misc_feature: Ceres CLONE 1540610
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPGAACESQE

SEQ ID NO: 66989 - DNA, 651 bp, Zea mays
  misc_feature: Ceres CLONE 1540612
ccccgcggtggcggccgctctagaactagtggatcccccgggctgcaggaattcgtctcacccctagaaaaaagctgccaaaacaatgggcatgcttgtttcagtttttttgctgattttggctgccaaaagctgttgtatgctaaacgctcagtttttgattccacttttatgagaatcattttgatgaaaaaaaaaaaaaccagcaaaaagcaacatgaacaacaaaatcgagaagaaaaaaaaacaacaacaacatcaaacaggcgacaacaaaaaaaaagtccccctcctccgcggcacccacattccccctataaagagtgataaagccccagcacgcggccgcgcctattacaagttcgtgtcggaaaaaacccgggctgcaccaaacttaaaatccttgaagaacttccccttttggccgattgtgctataactaaagaggccatcccctatgtcccttcccacatgttccccaccctaagaggaaaatggaaatctgaaccttaaaaattttgtaaaaatccccgtcaattttttgttaaaccagtccattttttaatccaaagggcccaaacgcgcaaaatcccttaatattcaaaataataaacccagaaaggcttgaatgttactccctttggaaacaag

SEQ ID NO: 66990 - DNA, 656 bp, Zea mays
  misc_feature: Ceres CLONE 1540613
  misc_feature: Encodes the peptide sequence at SEQ ID NO. 66991
ctccccgcggtggcggccgctctagaactagtggatcccccgggctgcaggaattcgtctcacccctagaaaaaacgtcacccccttccgtcctcccccgagacaatccccacgcaaccgcgcaccggagcggcggagcctgacgagtctacacaagcggtggggggagcaaaatctgcgccagttcgcctcgcctacttatacactccgatcgcccccggtagttactcgacttcgctccctttccctcctcccagctccggccccggctccggttctcacgcagtaagcaaagatggcaccaccatccatgtgtcttgcggcaaagggggtgcttcccttctcggcacttatttcaagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagag

SEQ ID NO: 66991 - protein, 120 aa, Zea mays
  misc_feature: Ceres CLONE 1540613
MAPPSMCLAAKGVLPFSALISSGVTQRPVSVTASLEHKTSDARRKFLKLALGNIGVGLPTLLGVKKALADEQGISSSRMSYSRFLEYLDKGRVKKVDLFENGTIAIVEAISPELGNRVQR

SEQ ID NO: 66992 - DNA, 674 bp, Zea mays
  misc_feature: Ceres CLONE 1540618
  misc_feature: Encodes the peptide sequence at SEQ ID NO. 66993
  misc_feature (513)..(513): n is a, c, t, g, unknown, or other
  misc_feature (514)..(514): n is a, c, t, g, unknown, or other
  misc_feature (517)..(517): n is a, c, t, g, unknown, or other
  misc_feature (518)..(518): n is a, c, t, g, unknown, or other
ctccccgcggtggcggccgctctagaactagtggatcccccgggctgcaggaattcgtctcacccctagaaaaaacggcactgtctccgtcctcctccgttccgttccgaaccgcaagctcccaaccccttccgcgaatggacctcacctccgccgtccgcccgcggcgcgcccgcgccgccgccatcgcgcgcacacctcgccgcggccgccgcccccatcccggcgaagcagccccctggaaccttcctgctgcctcagctacgtcccgccagatccacgccagcggcccggcggcgtttgcccctgccgacctcaagcttctgctggacgggcacgacctgcccacgccggactggctcttccgccccatggacgacagcccccttttccgcaaccagatttcccggaccggatccaccgtgttcgtggccccggacttcaacgaccgcaaagaaggccagcgtgaggccaccatgcggcggatcacgtacctgaatccgcgcgctgccnnccnnggggggggccccccccagaaaaaagggccctccccccactccccccaaaaaattagcgctcctcactgggggtttcgcccatctatgacccactcctctcgccatcaaagattgggcgtcccacttccttccttctgagggcagttgccattcaaa

SEQ ID NO: 66993 - protein, 172 aa, Zea mays
  misc_feature: Ceres CLONE 1540618
  misc_feature: SWISSPROT Homolog: EC 1.3.3.6 Acyl-CoA oxidase
  misc_feature (126)..(126): Xaa is any aa, unknown, or other
  misc_feature (127)..(127): Xaa is any aa, unknown, or other
MDLTSAVRPRRARAAAIARTPRRGRRPHPGEAAPWNLPAASATSRQIHASGPAAFAPADLKLLLDGHDLPTPDWLFRPMDDSPLFRNQISRTGSTVFVAPDFNDRKEGQREATMRRITYLNPRAAXXGGGPPQKKGPSPHSPQKISAPHWGFRPSMTHSSRHQRLGVPLPSF

SEQ ID NO: 66994 - DNA, 685 bp, Zea mays
  misc_feature: Ceres CLONE 1540620
  misc_feature: Encodes the peptide sequence at SEQ ID NO. 66995
  misc_feature (562)..(562): n is a, c, t, g, unknown, or other
  misc_feature (636)..(636): n is a, c, t, g, unknown, or other
  misc_feature (650)..(650): n is a, c, t, g, unknown, or other
  misc_feature (664)..(664): n is a, c, t, g, unknown, or other
tggagctccccgcggtggcggccgctcctagaactagtggaacccccgggctgcaggaattcgtctcacccctagaaaatttttctctctcgcttttgttaggtgttcatggaatttcatttctatggatcaccattgcagttgtaatgtgttcttgctggaaataaggaataaggtagatggccggttgcacttgtcgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaaccgagatagggttgagtngttgttccagtttggaacaagagtccacttattaaagaacgtgggactccaacgtcaaagggcgaaaaaccgtnctatcagggcgatnggcccactacgtgnaaccatcacccctaatcaagt

SEQ ID NO: 66995 - protein, 54 aa, Zea mays
  misc_feature: Ceres CLONE 1540620
ELPAVAAAPRTSGTPGLQEFVSPLENFSLSLLLGVHGISFLWITIAVVMCSCWK

SEQ ID NO: 66996 - DNA, 704 bp, Zea mays
  misc_feature: Ceres CLONE 1540628
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (450)..(450): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
tcccgcggtggcggccgctctagactagtggatcccccgggctgcaggaattcgtctcacccctagaaaaaggtttttcggcatcggctcctatcagtcagaagtgttttataattcggtagtttattttaaagtttcagtttgtgtgtgtttgttttgtgaacaggagatacagacagttattgtctgtttcatttcggtcgatatatttgatgtgtattttcatgatgctatttgttgtatgcaaatcatttaccctggntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnncnnnnnnnnnnnantnnccccnnnnngnnnnnaanaaaaggnnnnnaccannnnnnnttttaaacccannnaccccagaaaaacccccgggggaacccaacattaagcccctttcgaaacaaccccccttttgcccggggtgggtttataagaaaaagaggccccccccaaaaccccctttcccaatttttcccccccccctaaagtggaattgggaaatttttaaccgtcttttttttttttttaaaatcccccccccaaaaatttttctaaaaaaccctcccttttt

SEQ ID NO: 66997 - DNA, 647 bp, Zea mays
  misc_feature: Ceres CLONE 1540630
  misc_feature: Encodes the peptide sequence at SEQ ID NO. 66998
  misc_feature (556)..(556): n is a, c, t, g, unknown, or other
tggagctccccgcggtggcggccgctctagaactagtggatcccccgggctgcaggaattcgtctcacccctagaaaaaaataataacaggactggtcatccgggaatggtgcttaagggaggtttgcttaaattcagagataatcagatttgttacggatccaacaatggagacaacaaaacttggcatggaaacccggtatggctgctgtgtggcaatcaacaaggccctatcatcatcccatcttctgcatgaagcaagtctttctgaactcgttgggaagttgaatgacgcggtgaaacggggcccttacctttctgataggaagcgtgtggaggcacggccggtggttgatactgcagagaggttttaaggtgccctcgagtattcacccaaagtaaatgatcagtctcacagcgtagctagtaggtaactgggcgtgccctgcgtctcatgcggttggcttatgggtaacagacatagatatgatgtacctggacgatggggaggacagtgtgtacctaaacttacaaagcaaagatgttgtttcttctnaaaaaaaaaaaaaaacgagacgctcgaggtacccaattcgccctatagtgagtcgtattacgcgcgctcactgggcgtcgtttttacacgt

SEQ ID NO: 66998 - protein, 68 aa, Zea mays
  misc_feature: Ceres CLONE 1540630
METTKLGMETRYGCCVAINKALSSSHLLHEASLSELVGKLNDAVKRGPYLSDRKRVEARPVVDTAERF

SEQ ID NO: 66999 - DNA, 552 bp, Zea mays
  misc_feature: Ceres CLONE 1540636
  misc_feature (50)..(50): n is a, c, t, g, unknown, or other
  misc_feature (159)..(159): n is a, c, t, g, unknown, or other
  misc_feature (241)..(241): n is a, c, t, g, unknown, or other
  misc_feature (255)..(255): n is a, c, t, g, unknown, or other
  misc_feature (256)..(256): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (471)..(471): n is a, c, t, g, unknown, or other
  misc_feature (476)..(476): n is a, c, t, g, unknown, or other
  misc_feature (481)..(481): n is a, c, t, g, unknown, or other
  misc_feature (482)..(482): n is a, c, t, g, unknown, or other
  misc_feature (491)..(491): n is a, c, t, g, unknown, or other
  misc_feature (501)..(501): n is a, c, t, g, unknown, or other
  misc_feature (506)..(506): n is a, c, t, g, unknown, or other
  misc_feature (507)..(507): n is a, c, t, g, unknown, or other
  misc_feature (515)..(515): n is a, c, t, g, unknown, or other
  misc_feature (516)..(516): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (536)..(536): n is a, c, t, g, unknown, or other
  misc_feature (542)..(542): n is a, c, t, g, unknown, or other
aagctggactccccgcggtggcggccgctctagaactagtggatcccccngggctggcaggaattcgtctcacccctagaaaaaaacctcgtgttcgttcggagcgcacacacacacaaccagatctcccccaaatccacccgtcggcacctccgcttncagatgcagatctttgtgaaaaccctgaccggcaagactatcaccctcgaggtggagtcgtctgacaccatttgacacgttnagggccagatccanngacaggagggcatcccccagaacagcagcggttcatcttccctggcaaaagcttgaggacggggccaccctgctgactacacatccgaagggaaacccctccccctgggctcccccccggggggggatgccattttttttggaaaaccccgggcgggggagaaaatttacccccccggggggggggggggnnnntcccccccccccctcctccanaaaanaaaannaaccaaacnccccaagccncccgnncacgcagnnccccccccccccnnnaacgncctcantccgtctgcc

SEQ ID NO: 67000 - DNA, 697 bp, Zea mays
  misc_feature: Ceres CLONE 1540639
  misc_feature: Encodes the peptide sequence at SEQ ID NO. 67001
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (394)..(394): n is a, c, t, g, unknown, or other
ctccccgcggtggcggccgctctagaactagtggatcccccgggctgcaggaattcgtctcacccctagaaaaaggtagcggcgagacgagccgtttaaataggtgtcaagtggaagtgcagtgatgtatgcagctgaggcatcctaacgaacgaacgatttgaacaatttacgtttgtgggtgttcgaatttgtaatattcatccgtagtggacaagtggtaggaagtgccgcaatctgactatgttttcaaatttataatcgctgtcgattagtgttggtgctggttttgcccatcaacggatcaactaaacttattggttatctgaacgacgaattgatatgttaactcgggaacttcgttatatttaaaaaantnnnntgnnncctncanaaaagtggccccccacaccccaaaacttgtaattaaagaacttaacgctttgatggcgcgggaaaaaaaaaaaaaaccccgggacccccgggggccccaatttcccccctatggggagcggttttaccccccccctccggggccggcgtttttaccaccctccggacggggggaaaaaccctggggtttcccccaattaatatgcgctttggagaaatttccccctctttccccctgtggggggaaataaccaaaaaaaggcccccacacccaattccccctttcccaaaaattttggccccc

SEQ ID NO: 67001 - protein, 40 aa, Zea mays
  misc_feature: Ceres CLONE 1540639
PRGGGRSRTSGSPGLQEFVSPLEKGSGETSRLNRCQVEVQ

SEQ ID NO: 67002 - DNA, 653 bp, Zea mays
  misc_feature: Ceres CLONE 1540644
  misc_feature (300)..(300): n is a, c, t, g, unknown, or other
  misc_feature (305)..(305): n is a, c, t, g, unknown, or other
  misc_feature (445)..(445): n is a, c, t, g, unknown, or other
  misc_feature (446)..(446): n is a, c, t, g, unknown, or other
ctcaccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctcctcggctccctcctccccttgctccatatgatccgtgccacccatccagctacccgcgtggactgccttccctgggtcggcccaagaagggatcggaaggatggcggcgtcngtttncagggccatccgccgtcagaagccgggctcctaatgcaccatggacagggaagccacctcctccccccgcccgatcggtcgcagcgcccaagcccccccacgcctaagcccgccggcgtcctcccgccccgactctcggnncggggacgggggcccagctttggccccccccctaaaagggccctcctttttaaacccccccccccattccaacaacccaaaaaagaagggggtgttccccctttcccccaggggccaaaaccgagggccccaagaccccttaaaggaaaccccgggggcccgaaagggcccccaaccccggcgaaaaaaggcacaccccccgccgcc

SEQ ID NO: 67003 - DNA, 692 bp, Zea mays
  misc_feature: Ceres CLONE 1540649
  misc_feature (200)..(200): n is a, c, t, g, unknown, or other
tggagctcaccgcggtgggggccgctctagaatagtggaacccccgggctgcaggaattcgtctcacccctagaaaaaggaccccaggtcaagtcgggactacccgcctgagtttaagcatataaataaagcggaggagaagaaacttacgaggattcccctagtaacggcgagcgaaccgggagcagcccaccttgagnatcgggcggcctccccgcccgaattgtagtctggaaaaggcgtcctcagcgacggaccgggcccaagttctctggaaagggacccctgggagggtgaaaaccccgtccggcccggaccctgtcgcaccacgaggcgccgtcaacgagtcgggttgtttgggaatgcagcccaaatcgggcggtaaactccgtccaaggctaaatacaggcgagagaccgatagcgaacaagtaccgcgaggggaaagatgaaaaaaaaaaaaaaaaacgagacgctcgaagtaccccattcgccctatagtgagtcgtattacgcgcgctcacttggccgtcttttaaccacgtcttgactggggaaaaccctggcgttacccaactaaatccccttggaaacattcccccctttccccaatttggctaaaaaaccaaaaagccccccccccaattccccttttcccaaaatttccccaaccccaaaagggcaaaaaggaaa

SEQ ID NO: 67004 - DNA, 647 bp, Zea mays
  misc_feature: Ceres CLONE 1540653
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (408)..(408): n is a, c, t, g, unknown, or other
  misc_feature (409)..(409): n is a, c, t, g, unknown, or other
  misc_feature (415)..(415): n is a, c, t, g, unknown, or other
  misc_feature (430)..(430): n is a, c, t, g, unknown, or other
  misc_feature (437)..(437): n is a, c, t, g, unknown, or other
  misc_feature (444)..(444): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggactccccgcggtggcggccgctctagactagtggatcccccgggctgcaggaattcgtctcacccctagaaaaaccgatcctcccagctgcatctgcattgcattgcatgcacaggtcgcgcccaccatcagtagcggtcgccgccatgcagagactcgtgcgcgtcctcgtggtgctggggcgtggcccgcccgcggcgtcggcgcaaggccccgacggnncggcgncaaaggaagcccaangcccaangccgggnaaaccccccgggggggcccggcgccccacggaagggggttccaagcaaacattcacgggggcttgcttgggcaaaagggccggggaattttaaaaaccctttcatccggggtggctcaaagtcccaagggggcgtgggcgttccccaaaaattcaaaaaccccgggttcccccaaaacggggggggaaaacggggttcccccg

SEQ ID NO: 67005 - DNA, 651 bp, Zea mays
  misc_feature: Ceres CLONE 1540657
  misc_feature: Translation starting site: 247
  misc_feature: SWISSPROT Homolog: EC 3.2.1.23 Beta-galactosidase
  misc_feature (343)..(343): n is a, c, t, g, unknown, or other
gcggtggcggccgctctatcctagtggatcccccgggctgcaggaattcgtctcacccctagaaaaatcttgggagagcgcgagcgaggtcttgtctcttctcggtgcgggtcgctgtgccatgtgatgtgatgtgacgctggatcgttttgggtccgaccaacgggagaagagcggcctgtggtcgccgtcgccgccgtgtgtgggctggatggcctgctttcttgtgctcctcctatatatcagatgtactccctccaaggagcagggtttcgctaccttttcgtactcgctacagctacagctagtacgtactatactaataaaagctgcagtttcttcngtttgggtctaaatgtgaagaaaaagaaaagagaagagagaaaaaaataaaaggaaacaaaaaaaaaaaaccgagaccctcgaggtacccaattccccctatagtgagtcgtattacgcgcgctcactggccgtcgttttacaacgtcgtgactgggaaaaccctggcgttccccaacttaatcgccttgcagcacatccccctttcgccagctgggttaatagcgaagaggcccgcaccgatcgcccttcccaacagttgcccaccctgatgggcaatgggaattgtaaccttaatattttgttaaa

SEQ ID NO: 67006 - DNA, 851 bp, Zea mays
  misc_feature: Ceres CLONE 1540660
  misc_feature (13)..(13): n is a, c, t, g, unknown, or other
  misc_feature (18)..(18): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttgttggtgttnaacanatancctcctgctcctcnnaaaaactaannnnnnacacagtggagctccccgcggtggcggccgctctagaactagtggatcccccgggctgcaggaattcgtctcacccctagaaaatttcgtccaccaaccagccaagtttcctgagtcagaaggatatcgacgaagcgagtgaggcggataggctggcaaacaggccaccactgccaacgggtgccagctctcgcgtggtgaggtctttccatcaatcttcgtcgtgttcttccaatggagagatctaagtgattgctggtgcaccgcaattgtgtacagaaccctacttacaccgttctgaagctctggggccttgggaaacttccacaacgcaacaaggttttcgcccctggagggcaagcccctttccccaccccctcccggtgggggggggggggaccgcttcaattttttgtaccttgttttttttcccccccgcctcccaaaaaccactcacttgtcgttaagcactgttgttccgggtgggcccccaggctcctcatcatctcccattcattgccggatcgcccctcttcctgctctaccaaccatcactaccgccatcacttttacacgttcaaagtgttcccccgttttccatttcccttctgtctcgattcgcgccgtatcccgtcccttcccgttccccctcggccccccccttttcctcctgtatctcccgcattttctcttccactattaacgcgttgtctcctacccgtaatcctttgccgactcttccgctgcctgccccccctgtgtgcgcagctcttctgtgcgaccttccttcgcctccctg

SEQ ID NO: 67007 - DNA, 757 bp, Zea mays
  misc_feature: Ceres CLONE 1540661
  misc_feature: SWISSPROT Homolog: EC 3.6.3.6 Proton-exporting ATPase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
nnnnnnnnnccccnaaactaaccgtcgggggggcgcggctggggagaggtccccctctcaatttggatctccccgcggtggcggccgctctagaactagtggatcccccgggctgcaggaattcgtctcacccctagaaaaagacgcccgccggggctctattgtcctgactggccccgtaccctgtctcttggacgagtcgactgacccttcctttctcgcacggggagagtagcgaggaggagcggcgaccgtgcggggtatgctggtgcctgccgtcgggctccccctctaggactagggtccgctgctgcgccaggcttcccccttgggtgggctccaggagatgaagaacgaatccgtctctctggataattgccccatcgaggaggtgttcgacccatctgatgtgcaccgcgtcgaggggctcgatctccagcgagggccacgtgtcgtctcgcagattctttggccccggccaggcctcgaggattaggaaggaacagaagagggaccctcttcgttccttggggtgtcatggtggacacccgattgccttggggtccctggtagatggtttagcaggcactgggcttttcggtactcgcccaaaagtggggtgggcaaagcccccccgggtaccggtccgcgatcttccgacaaggaaagcttccgtgcctccttggggttatttccgtaaacatcgatttccccctctctgttagggtagaaaaatttggcccgggccactcggccc

SEQ ID NO: 67008 - DNA, 540 bp, Zea mays
  misc_feature: Ceres CLONE 1540664
  misc_feature: Encodes the peptide sequence at SEQ ID NO. 67009
  misc_feature (178)..(178): n is a, c, t, g, unknown, or other
  misc_feature (189)..(189): n is a, c, t, g, unknown, or other
  misc_feature (209)..(209): n is a, c, t, g, unknown, or other
  misc_feature (210)..(210): n is a, c, t, g, unknown, or other
  misc_feature (233)..(233): n is a, c, t, g, unknown, or other
  misc_feature (267)..(267): n is a, c, t, g, unknown, or other
  misc_feature (275)..(275): n is a, c, t, g, unknown, or other
  misc_feature (287)..(287): n is a, c, t, g, unknown, or other
  misc_feature (294)..(294): n is a, c, t, g, unknown, or other
tggagctccccgcggtggcggccgctctagaactagtggatcccccgggctgcaggaattcgtctcacccctagaaaaagaaggggacctcacaaacatggtccgggccgttgtttgatccagcagctctcgggcagtcgaggcggaagaagcaaactaccctagatgctaaggctgnctgcttactcnaaagcagctcccaaaagaannagggagggatacggagcctgatnacaaaatgtcgttttcatggcctacagaataaanttttcttngtttttggggtnccccccnctgggggttggaaaagggacaatgccctcctgaggggaaaccccccgattgggaccattgcgggggaaccgttccaaaccggttaaaaagtttttaaaaaagtgcccccccccgggagggggttttttgggggtttgaaaaaaaccccccattttttgtgggcccccctttttgggggggagatttaatttttttcccccccccccctgggggtttttttttgggggggacaatcctttttctttt

SEQ ID NO: 67009 - protein, 38 aa, Zea mays
  misc_feature: Ceres CLONE 1540664
GAPRGGGRSRTSGSPGLQEFVSPLEKEGDLTNMVRAVV

SEQ ID NO: 67010 - DNA, 627 bp, Zea mays
  misc_feature: Ceres CLONE 1540667
  misc_feature: Encodes the peptide sequence at SEQ ID NO. 67011
  misc_feature (284)..(284): n is a, c, t, g, unknown, or other
  misc_feature (285)..(285): n is a, c, t, g, unknown, or other
  misc_feature (303)..(303): n is a, c, t, g, unknown, or other
  misc_feature (531)..(531): n is a, c, t, g, unknown, or other
  misc_feature (532)..(532): n is a, c, t, g, unknown, or other
agctcaccgcggtggcggccgctctagaactagtggatcccccgggctgcaggaattcgtctcacccctagaaaaaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgnnctgtgatgctttttattnaaagaatttcttgaatgaaatggggtgaaccttttaaaaaaaaaaaaattgggcaaataacctgtgggtttgttaccccccaaaaaaattcccttttgcgccccattttttttttttctcccaaaaaaaaaaaaaaacccccctttttttttctttaaaaaaaaaaaaaaaggggggggggggggcccccccccacaaaaaaaaaaaaaaaaaaaaaaaaaaaaaaanngggggcgcccccccctccgggggggaagaaaaacaccacaaaaattttcccccccccccttatatcaaaggggggggggggggggcggtcttttt

SEQ ID NO: 67011 - protein, 35 aa, Zea mays; identical to SEQ ID NO: 65824
  misc_feature: Ceres CLONE 1540667
  misc_feature (1)..(35): Pfam Name: Ribosomal_L39 Pfam Description: Ribosomal L39 protein

SEQ ID NO: 67012 - DNA, 663 bp, Zea mays
  misc_feature: Ceres CLONE 1540669
  misc_feature: Encodes the peptide sequence at SEQ ID NO. 67013
ggatcccccgggctgcaggaattcgtctcacccctagaaaactagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaagaacctgaggtattctaggaagggcaacaaaaagagtggtgaggctgaagctgaggagtaggaaggaaagcatggctttgtttcctctgtttttagctcaattccacctttaggacctgggggttttgctaaagatggaacttaagtgggtgcccccccctgaatggcaagggacctttttgcttccgaaaggttatttttttgaaagttcatgcctacctttttaaaagtacggaattacccttgggcccaaaaaaaaaaaaaaaaaaaacgaaaaccctccagaggtacccacattcccccccatagagggagagtgtatttacgccggccgctcccctgggccgggtgttttttacaaaccctcttggacctgggagaaaaacccgggcggttttccccacttatatacgccctttggaggaaacaatcccccctttttc

SEQ ID NO: 67013 - protein, 60 aa, Zea mays
  misc_feature: Ceres CLONE 1540669
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLKNLRYSRKGNKKSGEAEAEE

SEQ ID NO: 67014 - DNA, 663 bp, Zea mays
  misc_feature: Ceres CLONE 1540670
  misc_feature (424)..(424): n is a, c, t, g, unknown, or other
tggagctccccgcggtggcggccgctctagaactagtggatcccccgggctgcaggaattcgtctcacccctagaaaaattccccacccatatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgtgtaaactggctcgtcttggatactgcacttcagtaggccatctatcgtggtttctagctatatccagagttttgtgctangacaatcagtcagtcgttttgtgaagcctattatgatggaagcccttatttgctggctaaaaccgactaccctgtaacgtaaaaaacaaaaaaaaaacgagacccctccaggtacccaaatcccccttaaagggggccggatatacgcgcgctcccgggccggttgttttacaaggtgggggatgggaaaaaacccgggcggttccccaacttaaaaccccttggggagaaaatttccc

SEQ ID NO: 67015 - DNA, 523 bp, Zea mays
  misc_feature: Ceres CLONE 1540680
  misc_feature (48)..(48): n is a, c, t, g, unknown, or other
  misc_feature (57)..(57): n is a, c, t, g, unknown, or other
  misc_feature (58)..(58): n is a, c, t, g, unknown, or other
  misc_feature (246)..(246): n is a, c, t, g, unknown, or other
  misc_feature (302)..(302): n is a, c, t, g, unknown, or other
ggagctcaccgcggtggcggccgcttctagaaactagtggatcccccngggctgcannggaattcgtctcacccctagaaaaagcgaccccaggtcagtcgggactacccgctgagtttaagcatataaataagcggaggagaagaaaaaccttacgagggattccccttagtacgggcgagcgaaccgggagcagcccagcttgagaatcggggcggcctcgccgcccggattttgtagtctggnagaggcgtcctcagcgacggaccgggccccaagtcctcttgaaaaggacccctggnaagggtgaaaagccccgtcccggccccgaaccctgtcccacccctcaaaaaaaaaaaaaaaaaaacccgggacccctccaggggtcccccaaattttccccccttaataggggggcccttatttccccccggcccccctggggccgggtgtttttttacaaccccctttgtctttggggaaaaaccctctggggtttttccccaccttttatccccccttc

SEQ ID NO: 67016 - DNA, 597 bp, Zea mays
  misc_feature: Ceres CLONE 1540686
  misc_feature: Translation starting site: 454
  misc_feature: SWISSPROT Homolog: EC 2.7.1.90 Diphosphate--fructose-6-phosphate 1-phosphotransferase
ccccgcggtggcggccgctctataactagtggatcccccgggctgcaggaattcgtctcacccctagaaaaagctttccccctcctcgcctcgggggtgcgtgaatttcgactagggtctcgcgcgaccgagagggaggggagaggagatccccggtagggtttccgcgcactgatcccccttcgcctcggcggctggcctccctgtcccgggagatgcaaacgacccggctcctgcactcccttccgctctgctccgtcctccgctccatcttctcggtcgtcaacagcccctgctcctcccctgcgcgctcctccgatgagatctgcctgctcttctccgatctgttcagccagccctcggcgtcgcttgtgacgctctccgagtccgctgcgaccattccgctcaagatcggcgttgtgctctccggtgcaccggcgccgggcggcctccatgtcatctgccgtatctttgactatctaccggatcgtgctcatggcagcaccttgtatcgcatttaaggcaggccccgctgggatcctgcagtgcaagtatgtaccattcacttcagactttcgtgtatccctacagaaatcc

SEQ ID NO: 67017 - DNA, 522 bp, Zea mays
  misc_feature: Ceres CLONE 1540690
  misc_feature (220)..(220): n is a, c, t, g, unknown, or other
  misc_feature (231)..(231): n is a, c, t, g, unknown, or other
tggagctccaccgcggtggcggccgctctagaactagtggatcccccgggctgcaggaattcgtctcacccctagaaaaaggttttgacagggcgtcggtgacacaagcgctcaagttgttcaacgggaatgaggagcaagctgctgcgttcttgtttggtggttagactggtgggagcagccgttcctggctttgtgttcgctcaaccctttccagggnttgagtacttngaatatttgatacggaaagtgattaaaagttatttgggatactggtttgtccagtgaaagacttacttttagaggtttaagtttcccctgtttctaaaacaactttgttttctgtactgaaacttgactgataacccccaattgaaacgaacctggaaaatttttttaaaaaaaaaaaaaaacaaaacccccgagggccccatttcccctaaaggggggcgctatataccccgccccctggggccctgttttttaaacgccgggaaggggaaaaaccctggggttttccca

SEQ ID NO: 67018 - DNA, 639 bp, Zea mays
  misc_feature: Ceres CLONE 1540694
  misc_feature: Translation starting site: 328
  misc_feature: SWISSPROT Homolog: EC 2.1.1.104 Caffeoyl-CoA O-methyltransferase
  misc_feature (263)..(263): n is a, c, t, g, unknown, or other
  misc_feature (352)..(352): n is a, c, t, g, unknown, or other
cggccgctctagaactagtggatcccccgggctgcaggaattcgtctcacccctagaaaatccagcaatacccgagtacccgacgcgctagctagttctattgccgcaccccagatctccaggagggactcgttcgttcagctaactacactgcacgcaatggccaccacggcgaccgaggcggcgccggcgcaggagcagcaagccaacggcaacggcgagcagaaacgcggcactccgaggtcgagcacaagagcctgctncagagcgacgacctctaccagtacatcctggacacgagcgtgtacccgcagggagccgaagagcatgaatgagctccgcgagatcaccngccagcacccatggaacctgatgacaacctccgccgacgagggggagttcctgaaaatggccatcaaagctctccggcccccaaaaaaacaatggaaatgggggtttcaaccgggttaccccctccccccccaggggctgcccctcccggaaaagggggcaactttgggcctgggactttaccccggaaaaaataaaaccgggcccccccccttttaaaaaagcccgggccccccacaaatatcactccccggaggggccccgccccccccccccaaaaaaaaattc

SEQ ID NO: 67019 - DNA, 649 bp, Zea mays
  misc_feature: Ceres CLONE 1540697
ctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacg

SEQ ID NO: 67020 - DNA, 672 bp, Zea mays
  misc_feature: Ceres CLONE 1540698
  misc_feature: Encodes the peptide sequence at SEQ ID NO. 67021
  misc_feature (78)..(78): n is a, c, t, g, unknown, or other
  misc_feature (664)..(664): n is a, c, t, g, unknown, or other
tggagctcaccgcggtggcggccgctctagaactagtggatcccccgggctgcaggaattcgtctcacccctagaaancatatgataggattgtgctgtgtgtgagattgctttgcaatactggtgatgatgtcaggaagatttggttgcagtcatgcagacagagctttgcgaaaatgcttgctgagaagcagttcagggagagagagagagagacaggatcgatcgagagacggtcatgtccttttggctgtttggtttattcatatcacaacttttgagtgtatacaagattatttctgtgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagntgttgttc

SEQ ID NO: 67021 - protein, 100 aa, Zea mays
  misc_feature: Ceres CLONE 1540698
  misc_feature: SWISSPROT Homolog: EC 3.2.1.23 Beta-galactosidase
MSFWLFGLFISQLLSVYKIISVKKKKKNETLEVPNSPYSESYYARSLAVVLQRRDWENPGVTQLNRLAAHPPFASWRNSEEARTDRPSQQLRSLNGEWKL

SEQ ID NO: 67022 - DNA, 722 bp, Zea mays
  misc_feature: Ceres CLONE 1540701
  misc_feature (613)..(613): n is a, c, t, g, unknown, or other
tggagctcaccgcggtggcggccgctctagaactagtggatcccccgggctgcaggaattcgtctcacccctagaaaaatgtttggtttaggtattcctatgtagacgacctgattatgattcagggtggtttatcgtagcagtaatctgaagtttggtgtggtgtttgatctgtgtgagtcttgtgttacgtcgatcatgaacaaatttatatggtccttattagttggtcaaggtgaagttcttctctttatgtatcgtcatgaacaaagttatgtggtctttattagtaggtcaaggagaagttcttctctttatgtatctatatcagcttagctgtgatatgcgtgtgagtcgtaaatttcgatatatgaaagtctgttcttgcaccaaaaacaccccccacaccagacgctcgaggtacccatttcgccctatagtgagtcgtattacgcgcgctccctggccgttgttttacaacgtcgtgaattgggaaaacccttggcgtttccccaatttaatccgccttgccgcactttcccccttttccccaacctggggttaataccgaaaaaggcccccccccaaatgccccttttccaaaaattttgcncacctcttaattggtaattggaaatttgcaagcctttaaattttttttttaaaatttccccgtaaaaattttttttttacatccccctcttttttttttacccaaacgg

SEQ ID NO: 67023 - DNA, 634 bp, Zea mays
  misc_feature: Ceres CLONE 1540703
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (407)..(407): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttggggcttcccggcgggtggcggccggctctagaactagtggaatccccccgggctgcagggaattcgtctcacccctagaaaactcactttctctcctcgttcccaatttcaagctgcccaacccttgcgcccggtagtggtggccgtgaagatagaggttaccctgagagcagtgatgggcgcacgattcagtacacccggagcaccccgcggggaacccgatcctgccggaggtccaagaaatgcnatccaaaccccttaccccaaatttaattgtcccttcccccctcgaggaaagaaaattccttccaaatggggaaaattttcccaacccccggggggccccaaaaaaaacccccagttttttaagagggggggaaatttttttttaggggggaggagtccccccccccccccccccggggaaattattcctttttagagccccccccctccctctttgggggaaaaatc

SEQ ID NO: 67024 - DNA, 629 bp, Zea mays
  misc_feature: Ceres CLONE 1540706
  misc_feature: Encodes the peptide sequence at SEQ ID NO. 67025
ggagctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcgagggtcacgtgcgacaacgccaactccaccgtcgtcgaggtgcccctcccgggcgtgggcctcgtcggcgccatcccgccgggcacgctcggccggctcacaaacctccgcgtgctctcgctccgctccaaccgcgtcctcgggaccgtccccgacgacgtgctccc

SEQ ID NO: 67025 - protein, 117 aa, Zea mays
  misc_feature: Ceres CLONE 1540706
MAGPSVPAAALAALLAVAALTCCAVAEPPPSERSALLAFLTATPHERRLGWNASTPACGWVEGHVRQRQLHRRRGAPPGRGPRRRHPAGHARPAHKPPRALAPLQPRPRDRPRRRAP

SEQ ID NO: 67026 - DNA, 669 bp, Zea mays
  misc_feature: Ceres CLONE 1540707
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaagccgagctcagtagcgagagcttgtaacctgagcgggggcattaaggtggtgcggatgctttgcgatggctttctgtgcctgggctcgctttgtgcctttggccggcctgcccgtcccaagtttggtggtggctggcggaggctttagcggaagctttggtctctgcagacctgaagtggcaggaatggcgtgaggctggcttcacagagcagcgatcactgcccgcttccaacggtgggaggataacaggccgctgcacttcgagcccaattcaggcccagagcctcactaagcagaccaccatcttttgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaat

SEQ ID NO: 67027 - DNA, 672 bp, Zea mays
  misc_feature: Ceres CLONE 1540708
  misc_feature: SWISSPROT Homolog: EC 3.2.1.23 Beta-galactosidase
ggagcattctgtacttatgatcttctatactaagggatcccccgggctggaggaattcgtctcacccctagaaaaaactctctagggaagactgctttagattaaaagatgataatgtgacagaaataccatgcactgttcggcatctatctgttcatgttcaaagtatgcaaaagcataagcaaattatctgcaagctatatcatttacgcactattatctgcatcgatcagctaatggatggcccaagtgatatttttgatggcatgctacggaaccaaagaaaactgcgtgtattgtctctgtcattttacagcagcagcaagttgccagaatctattggtgagctgaagcacctccggtatttgaacctcatcaggacgttagtttctgaattgcctacatcttacttcgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaaa

SEQ ID NO: 67028 - DNA, 646 bp, Zea mays
  misc_feature: Ceres CLONE 1540711
  misc_feature (377)..(377): n is a, c, t, g, unknown, or other
  misc_feature (386)..(386): n is a, c, t, g, unknown, or other
  misc_feature (429)..(429): n is a, c, t, g, unknown, or other
  misc_feature (504)..(504): n is a, c, t, g, unknown, or other
ccccgcggtggcggccgctctagaactagtggatcccccgggctgcaggaattcgtctcacccctagaaaaatgcgatgaattccttattattattttttttgctgtgcagccaggaatggatcctggcatccgcctggatgtatccaggcggtgattggtgatgtgcttgtggtatggctgtgtatttggtgatgatgtatctggaatgcatgggtggtttcacataaaagtatactctttcctgccagtgtagttcctcttgtctcatatgcacgctttgtttatatattgtaatgtatgagtgcgtgctgtagaacaaggttggattatctgtggtatgaatttcctcgattccatgagaaacgcttttctaanatggaagantctggcgcggccgtgcgcggcgaaggagatcgtgttgctgacncctaacccttggggacagcggaggtcactctgtcttctgccccctccccctgaaaaagaagggagggaaacccanggggaaagggtttttacaagaaaaacacagtggttttaccccccaaaaaccccccctccccctcccctcccccggttttcagaagattataccccccccggttcccagggggggttttccccccaccaaaaccgataaagga

SEQ ID NO: 67029 - DNA, 701 bp, Zea mays
  misc_feature: Ceres CLONE 1540713
  misc_feature: Encodes the peptide sequence at SEQ ID NO. 67030
  misc_feature (689)..(689): n is a, c, t, g, unknown, or other
tggagctcaccgcggtggcggccgctctagactagtggatcccccgggctgcaggaattcgtctcacccctagaaaaataaatagtgaacgccattgtattgtagaatacttattaagtggagactgcccttgtgtatggggtatatcgtttcattggaactgtcagaagtctccactgtgttgtacccgtctgtaatgtgtatactatgtttgtttacttgtatgatgtatgtacactatctcctctacatggagttgtcccctatacatggatttttttgtagattagttacattatgaacattttcgacaaaaaaaaaaaaaaaaacgagacgctcgaggtacccatttcgccctatagtgagtcgtattacgcgcgctcactggccgtcgttttacaacgtcgtgactgggaaaaaccctggcgttacccaatttaatcgccttgcagcacatccccttttcgccagctggcgtaatagcaaagaggcccgcaccgatcgcccttcccaacagttgcgcagcctgaatggcgaatggaaattgtaagcgttaatattttgtaaaaattcgcgttaaatttttgttaaatcagctcatttttttaaccaataggccgaaatcggcaaaatcccttataaatcaaaagaatagaccgagatagggtttgaagtgttgttccagtttnggaacaagagtc

SEQ ID NO: 67030 - protein, 54 aa, Zea mays
  misc_feature: Ceres CLONE 1540713
MGYIVSLELSEVSTVLYPSVMCILCLFTCMMYVHYLLYMELSPIHGFFCRLVTL

SEQ ID NO: 67031 - DNA, 683 bp, Zea mays
  misc_feature: Ceres CLONE 1540715
  misc_feature: SWISSPROT Homolog: EC 3.2.1.23 Beta-galactosidase
  misc_feature (311)..(311): n is a, c, t, g, unknown, or other
ggagccgtccaacatcgtcatagccgctctagaactagtggatcccccgggctgcaggaattcgtctcacccctagaaaaactcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaatttgtttgggatcgttttacaacgtcntgactggaaaaaccctggcgttacccaacttaatcgccttgcagcaaatgacacctttcaccaactgcgggacgctcgaggaccccaattccccttatactaacccatattacccccgcccgatggccgacttttaacaacgccgggacgggaaaaaccctggctttacccaacttaatggccttgcagcacatccccttttcacaagcggggaaaatagcaaaaaggcccgcaactatccccattcccaaagtttgcgccccctgaatgcccaagggaaaattgaaacctccaatattttggaaaaattcccccaaaaatttttggtaaaaacaacccttttttttgaacaaatgggcccaaaatcggaaa

SEQ ID NO: 67032 - DNA, 638 bp, Zea mays
  misc_feature: Ceres CLONE 1540716
  misc_feature: Encodes the peptide sequence at SEQ ID NO. 67033
  misc_feature (450)..(450): n is a, c, t, g, unknown, or other
ggagctccccgcggtggcggccgctctagaactagtggatcccccgggctgcaggaattcgtctcacccctagaaaaaccctagaaaaaataacaagagaagcatatccatatgaagacactgctcagcttctttccagtgtgatatctcactatggagccagtcgagtaatgtggggaagtgacttcccctatgttgttcctgaatgtggttacaaaggaggaagggaggcgatttctcatgtcgccagcaagataccagtttcccagtcagatttggaatggatcttgggaaaaacagtgagccaattattccaaggtgcatgggttactccatgatcactgtagtgtattccagagcaactatatcaacaggaatatatgtcctattttccagtgtttacatgtattctctctgtttcaaataatgtttttatctagatacatatantctaggtgtgtagcaaaatctttaacttcagttcttgattacgcgacctaccccataacttcaaaaaaaaaaaaaaaaacgagacgctcgaggtacccaattcgccctatagtgagtcgtattacgcgcgctcactggccgtcgttttacaacgtcgtgactgggaaaaccctggcgttacccaactt

SEQ ID NO: 67033 - protein, 55 aa, Zea mays
  misc_feature: Ceres CLONE 1540716
MWGSDFPYVVPECGYKGGREAISHVASKIPVSQSDLEWILGKTVSQLFQGAWVTP

SEQ ID NO: 67034 - DNA, 675 bp, Zea mays
  misc_feature: Ceres CLONE 1540723
  misc_feature: Encodes the peptide sequence at SEQ ID NO. 67035
gcggtggcggccgctctagaactagtggatcccccgggctgcaggaattcgtctcacccctagaaaaatgtggtgcaaaaactttggtaagaaggaatactgaaggaccctccaactagcatgaagtgtgggcaccttgcttttgccttctttttgtggaaacctgtgcctagccataatgctgggttaagtgttaggagcatctctggaatgcttcgcgtagtatcttttgattcttctttccttcgtgttacatgtgaaatgcctgatgaactcaaataatgaccggtgatacaaaagcatgtgatgaatttactcgagggttttgatcatgtaattgtaaacatggcatgtcgtctgcacacttaatgctgaagcttgattatgtcgtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgtttaaattcgcgttaaatttttgttaaatcag

SEQ ID NO: 67035 - protein, 92 aa, Zea mays
  misc_feature: Ceres CLONE 1540723
  misc_feature: SWISSPROT Homolog: EC 3.2.1.23 Beta-galactosidase
MSSAHLMLKLDYVVKKKKKNETLEVPNSPYSESYYARSLAVVLQRRDWENPGVTQLNRLAAHPPFASWRNSEEARTDRPSQQLRSLNGEWKL

SEQ ID NO: 67036 - DNA, 666 bp, Zea mays
  misc_feature: Ceres CLONE 1540728
  misc_feature: Encodes the peptide sequence at SEQ ID NO. 67037
gctggagctccccgcggtggcggccgctctagaactagtggatcccccgggctgcaggaattcgtctcacccctagaaaaagaatatgataggatagacaggcgacagctgcacttcagcggttcacccagcgcgccgctctcgtgcgacaattgggcgtcccgcgtccgccgtcgccctgcccagcccttcgccggtcctttcccaggccttcgacgcgtccttcgccgtcgaagagtccccagcagcaccatgcccttttctcggcccgccgttggtttcttagttagactggttggggtccggccaagctgctgtcctccttcccgtgcatttgcagctgtcagagctcaaaagattcagcttcccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaac

SEQ ID NO: 67037 - protein, 117 aa, Zea mays
  misc_feature: Ceres CLONE 1540728
  misc_feature: SWISSPROT Homolog: EC 3.2.1.23 Beta-galactosidase
MPFSRPAVGFLVRLVGVRPSCCPPSRAFAAVRAQKIQLPKKKKKNETLEVPNSPYSESYYARSLAVVLQRRDWENPGVTQLNRLAAHPPFASWRNSEEARTDRPSQQLRSLNGEWKL

SEQ ID NO: 67038 - DNA, 681 bp, Zea mays
  misc_feature: Ceres CLONE 1540732
  misc_feature (311)..(311): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
ggcggccgctctagaatagtggatcccccgggctgcaggaattcgtctcacccctagaaaaacgtatatgggtgtgcaaggtccagaccgaccagctgtatgtcttcatcgttgccttcgtttctgcgtcgtcatcacatgcatgtttatgcaagaagacgcgccgacgttgtcaactggatcagtactgatgcctactttcattgtcgtagctgctcatgtaaagaaataagacgatgcgttgactgcttaatgcgaagagtatttctctttccttaatattaaagccggtccaaacccgcctctttctnaaaaaaaaaaaaaaaaaaaaaaggaggaaaaannnnnnnaccgaaccgctcgaagtaccccattccccctataaggaggcccattacccgcgctcactggccgtcgttttacaacgcctgactgggaaaaacctggcgttaacaacttaattgcctttgagcaaatccccctttccccagctgggggaaaaaaccaaaaagcccccacccaatttccctttcccaaaatgttggcaaaccccgaaatgggaaaaggaaaaattttaagccttttaaattttgttttaaaaattccgggttaaaattttttttaaaaaaccctcccatttttttaaaacaaaaagagcacaaaaagggggaaaaatccctt

SEQ ID NO: 67039 - DNA, 627 bp, Zea mays
  misc_feature: Ceres CLONE 1540736
  misc_feature: Encodes the peptide sequence at SEQ ID NO. 67040
  misc_feature (627)..(627): n is a, c, t, g, unknown, or other
tggagctccccgcggtggcggccgctctagaactagtggatcccccgggctgcaggaattcgtctcacccctagaaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcttaccgcttgaagaaaacaaaaaaaaaacacgagacgctcgaggtacccaattcgccctatagtgagtcgtattacgcgcgctcactggccgtcgttttacaacgtcgtgactgggaaaaccctggcgttacccaan

SEQ ID NO: 67040 - protein, 65 aa, Zea mays; identical to SEQ ID NO: 66489
  misc_feature: Ceres CLONE 1540736

SEQ ID NO: 67041 - DNA, 646 bp, Zea mays
  misc_feature: Ceres CLONE 1540741
  misc_feature: Encodes the peptide sequence at SEQ ID NO. 67042
tggagctccccgcggtggcggccgctctagaactagtggatcccccgggctgcaggaattcgtctcacccctagaaaaagaaaaaaaaaacgcgcacaccaaacgcgcacgcggcgttcgttcctcggccgctctccctacccacgtccttctccccccacagatctccgcgggccgtgaggttccttgattcgccttctccggggctgccggatctccgcggcggctggggatgggcaactgctgcgtaacaccgaacggagccgccgacgccggcggcggcaagaagcccaaggagccgaagcagaagaagggcaagaagccgaaccccttctcgatcgagtacaaccgctcgacgccggcgagcgcgccgaggctggtggtgctgcgggagcccacggggcgggacatcgcggagcggtacgagcttggagcggagctcgggcgcggcgagttccgggtcacctatctctgcacggaccgcgcctcaggggaggcgctagcctgccagtccttctccaaaaagaaactccgcacccccgtccacctcaaggaactgcgcccgggaggggggagattctgcgccacctcccccaagaaccccaaaatcgtcacgcttagggatacccttcgaaggacgaaaatg

SEQ ID NO: 67042 - protein, 138 aa, Zea mays
  misc_feature: Ceres CLONE 1540741
  misc_feature: SWISSPROT Homolog: EC 2.7.11.1 Non-specific serine/threonine protein kinase
MGNCCVTPNGAADAGGGKKPKEPKQKKGKKPNPFSIEYNRSTPASAPRLVVLREPTGRDIAERYELGAELGRGEFRVTYLCTDRASGEALACQSFSKKKLRTPVHLKELRPGGGRFCATSPKNPKIVTLRDTLRRTKM

SEQ ID NO: 67043 - DNA, 656 bp, Zea mays
  misc_feature: Ceres CLONE 1540742
  misc_feature: Translation starting site: 139
  misc_feature (509)..(509): n is a, c, t, g, unknown, or other
ctccccgcggtggcggccgctctagaactagtggatcccccgggctgcaggaattcgtctcacccctagaaaaagattcgctccctttccctcctcccaggtcaggccccggctccggttctcacgcagtaagcaaagatggcaccaccatccatgtgtcttgcggcaaagggggtgcttcccttctcggcacttatttcaagtggtgttacacaaaggccagtgtcagtgaccgcttccttggagcacaaaaccagcgatgctagaaggaagttcctaagacttccgcttggcaatatcggagttggactgcccaccttgttgggtgtcaagaaagctctcgctgatgagcaaggaatctcctcctcgagatgtggtagtgagggttccttgagtatcttaaaaagggtagagtgaagaagttggatttatttaaaaatgggacaattgctatcgtgcaggccctttcctctgagctctgcaaagggatgcataaagtccgtggtccncttcctggtccaaagccggaccttccttagaagttgagggaaaagaaacctccatttttcttccccccgcaaccaacaagaactccgggtccccttttgtttaaacttataggaattttgggcatttccccctttttcctttccggg

SEQ ID NO: 67044 - DNA, 650 bp, Zea mays
  misc_feature: Ceres CLONE 1540744
  misc_feature: Encodes the peptide sequence at SEQ ID NO. 67045
aagctggagctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaacaaaaggaaggtgaagagcagcaaaccggcggcggcggccaaaaagtgacgtacagtacgtgtggagtgtaatggagcttccatgcatgcatgagtggatccatgccatgttatgaatctagtcctccctttcttgtatctcccaagggacccggcctgggcggcccctcatggtggatgaagcccgatgaatactacaaataagaacgttgtggacaaaaaaaaaaaaaaaacgggaccctcgaggggacccaatttccccaaaaagggggccttaataaccccgcgccccatggggcccttttttttaaaacccgcggagatgggaaaaaaccccgggggttcc

SEQ ID NO: 67045 - protein, 51 aa, Zea mays; identical to SEQ ID NO: 19222
  misc_feature: Ceres CLONE 1540744

SEQ ID NO: 67046 - DNA, 643 bp, Zea mays
  misc_feature: Ceres CLONE 1540745
  misc_feature: Encodes the peptide sequence at SEQ ID NO. 67047
ggagctccccgcggtggcggccgctctagaactagtggatcccccgggctgcaggaattcgtctcacccctagaaaaaacccacccacgccaccgtgtggtccgagtccgaccctgtgactgtgagtactactatcccagcatgtgctcaggacctcgaaagccgtccacccctcctctcccggaggcgatggcagcggctctcctgctcgagctggcggcggcgaacgacgtggtggcgttcaggcacgccgcagatgacgacatagccccggccttggacgccgtgggacactggtacggcccgatctacgcgtgcgcgggcgccggccgcccccacctcgaggcgcgcacgccggccatggtcgccgcgctctaccggagcacggcggtgctagcgtacatgctgtcctcctcgctgcagaggcagggcgcgcatccccaacggacggggccacgtcgctccacgtagctacgccagggggggccccggcctctggaacggcctcatcatatcctgctctcccggagaacatacccgggaccgcggcgcctatcgggacctcggcccggggaccttgctactccacggggaaaggcccgcgcaaacccagagaagaacctccggggcccctcaaggcccc

SEQ ID NO: 67047 - protein, 109 aa, Zea mays
  misc_feature: Ceres CLONE 1540745
MCSGPRKPSTPPLPEAMAAALLLELAAANDVVAFRHAADDDIAPALDAVGHWYGPIYACAGAGRPHLEARTPAMVAALYRSTAVLAYMLSSSLQRQGAHPQRTGPRRST

SEQ ID NO: 67048 - DNA, 784 bp, Zea mays
  misc_feature: Ceres CLONE 1540747-R
  misc_feature (1)..(1): n is a, c, t, g, unknown, or other
  misc_feature (430)..(430): n is a, c, t, g, unknown, or other
  misc_feature (442)..(442): n is a, c, t, g, unknown, or other
nccgaattgggtacctcaagcgtctcgtttttttttttttttttaaaaataaacacttttaatttggaatatagaactgtttattacaaatgaagaattgtttcggatgaatgctctatcgtgcttaggtcaattcccttgaattacatgacagctatacgactactttttacaccactgtcgggcaaggcagggagtctgaatacatatgtctgaacacatatgtatggcctggaacatacaagtgcatgaggtgctgctgtcgcacgagtacacgggattctatttgttaggcacgatctactgctttatttctgcctatgcaagtataactggtatttatcagtcgaactccagaacagtttcagcaacacgagtttggtgcctcagaagaacttttcatagtcttgaggttgctggtcccaaaccntccataaaaccntatgtcactaagagaactgtatattggatcatccatcacagtaatgcccctctgaaacgttttaagtcctcccatccttgaaattcctgctttgtattgattggttaacatgaacctatcagcaccaaggtaaatctgaaattgcaagaactataccccatcttggaaaaccatggtagaggcatccggggtcacccggaagccgggttcatcaaaggctccccctggccaaaaatataccaaccccacctttttgaattttgacccctcacaaaacacgggtttaaatggggataggcccccccccaaaacaaaaaacctggaaacggaactttatttccc

SEQ ID NO: 67049 - DNA, 634 bp, Zea mays
  misc_feature: Ceres CLONE 1540752
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaattactctagggataacaggctgatcttccccaagagtccacatcgacgggaaggtttggcacctcgatgtcggctcttcgccacctggagctgtaggtgagtagaaaaaaaaaaataaaaaatggggaaaaagacaaaaaaagaagaaaaagtaagagaaaaagaagtagtgaaaaaaaaagaaggaaagaagagaaaacaaggagaaaagaacaaagaaagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatca

SEQ ID NO: 67050 - DNA, 648 bp, Zea mays
  misc_feature: Ceres CLONE 1540757
  misc_feature: Encodes the peptide sequence at SEQ ID NO. 67051
caccgcggtggcggccgctctagaactagtggatcccccgggctgcaggaattcgtctcacccctagaaaaaaccacacgacactccccgagcacacacgccgcaatagcaccacccccagacccaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaggagttcgggggaagatgccaaggtctgggaccgcgaagaggtcgtcatcatccccgaacactacatcttcaccagcgac

SEQ ID NO: 67051 - protein, 134 aa, Zea mays
  misc_feature: Ceres CLONE 1540757
  misc_feature: SWISSPROT Homolog: EC 4.2.1.33 3-isopropylmalate dehydratase
MASSISAAAKASAAFAQKKELAAPAPHRAGSSRRTKPCRVRAVASPARTPRAPSSTGSVKTAMTMTEKILARASERAALEPGENVWVDIDVLMTHDVCGPGTIGIFKKEFGGRCQGLGPRRGRHHPRTLHLHQR

SEQ ID NO: 67052 - DNA, 641 bp, Zea mays
  misc_feature: Ceres CLONE 1540758
  misc_feature: Encodes the peptide sequence at SEQ ID NO. 67053
  misc_feature (103)..(103): n is a, c, t, g, unknown, or other
  misc_feature (105)..(105): n is a, c, t, g, unknown, or other
  misc_feature (106)..(106): n is a, c, t, g, unknown, or other
  misc_feature (108)..(108): n is a, c, t, g, unknown, or other
  misc_feature (400)..(400): n is a, c, t, g, unknown, or other
ggctccccgcggtggcggccgctctagaactagtggatcccccgggctgcaggaattcgtctcacccctagaaaaaaaaaaaaaaaactccccgagcacacangnngntcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccgggcgggtacctcttcaaccgggccgccgcttacgcctccgccgccgcggcccagggggggcccgccaccccgccgccagccaccgggaagaccggcggnggcaagatcaccgaaaagttccccggggccggcgccctcggccaggtgtgccaggggataggggccgtcgtcaacttgggctacaattgaggggctcccgcccatcctcacggcgctcgaggggcgtggaaaacaaaatccgccctcggcctcgaagggcgccaaccaccttgggagaaaaactggtggcggcccccatcggtttggaaccggcacgaaaggggctcctccccgcgcccaa

SEQ ID NO: 67053 - protein, 98 aa, Zea mays
  misc_feature: Ceres CLONE 1540758
  misc_feature: SWISSPROT Homolog: EC 3.6.3.14 H(+)-transporting two-sector ATPase
MASRRVVSSLLRSASRLRAASPAAPRPRGAPHRPSPGGYLFNRAAAYASAAAAQGGPATPPPATGKTGGGKITEKFPGAGALGQVCQGIGAVVNLGYN

SEQ ID NO: 67054 - DNA, 535 bp, Zea mays
  misc_feature: Ceres CLONE 1540759
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (336)..(336): n is a, c, t, g, unknown, or other
  misc_feature (337)..(337): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (364)..(364): n is a, c, t, g, unknown, or other
  misc_feature (367)..(367): n is a, c, t, g, unknown, or other
  misc_feature (368)..(368): n is a, c, t, g, unknown, or other
  misc_feature (380)..(380): n is a, c, t, g, unknown, or other
  misc_feature (385)..(385): n is a, c, t, g, unknown, or other
  misc_feature (390)..(390): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (412)..(412): n is a, c, t, g, unknown, or other
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (428)..(428): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (441)..(441): n is a, c, t, g, unknown, or other
  misc_feature (445)..(445): n is a, c, t, g, unknown, or other
  misc_feature (446)..(446): n is a, c, t, g, unknown, or other
  misc_feature (462)..(462): n is a, c, t, g, unknown, or other
  misc_feature (470)..(470): n is a, c, t, g, unknown, or other
  misc_feature (474)..(474): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (486)..(486): n is a, c, t, g, unknown, or other
  misc_feature (498)..(498): n is a, c, t, g, unknown, or other
  misc_feature (506)..(506): n is a, c, t, g, unknown, or other
  misc_feature (507)..(507): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (526)..(526): n is a, c, t, g, unknown, or other
  misc_feature (528)..(528): n is a, c, t, g, unknown, or other
ggagctccccgcggtggcggccgctctagaactagtggatcccccgggctgcaggaattcgtctcacccctagaaaaacttcagccgcacgcttcttgttgccaaagaattccctcccctagccgccgccgccgctcgtctccctgagaggtgccgggaccgaggaactggccgagttctaggtagagatcggttttgcttgtctcagcacggggtctgctgcgtctggtggtggtgaaggggagaaattcgtcgagcatctgtttcccggatcaagggcctggccaaaccccggggaatccaggggggtttttccccacccctttttnnnnnntnnttttttttnnnntnnnnnnntnnnntnttnntttttttttaanaattnttctnttnnnttannntnnnnnnantntaaaanannnnatttntttaaannntttnatannaaattttttttttttntttttttntttnattnnnnntttntttttttttttntttttatnnctatttcnnnntaaaatantnataaatt

SEQ ID NO: 67055 - DNA, 643 bp, Zea mays
  misc_feature: Ceres CLONE 1540771
  misc_feature: Translation starting site: 249
  misc_feature (152)..(152): n is a, c, t, g, unknown, or other
  misc_feature (155)..(155): n is a, c, t, g, unknown, or other
ctccccgcggtggcggccgctctagaactagtggatcccccgggctgcaggaattcgtctcacccctagaaaaagccgcgcacagttcactcgcgcacctctcgccccctcgctctacgacgactagtggggccgccgggcgctggcgccgnccnccttttaacgccaggtgccgaggtcttcgttgatctcttcgccggcgacgagcacccaccagctggaaaaaaaatctatagccaaacataataatggctatgattgatgaacctctctacccgattgctgtactgattgatgaactgaaaaatgaagatattcagttgcgcctttactccatcaaaaagctttctacaattgcccgggcattgggtgaagaaagaacaaggaaagagctgatcccattccttagtgaaaaacaacgatgatgaagatgaagtgcttcttgcaatggcagaggagttggggcgtttttattccctatgtttggaggaagtagagccttccccttggttttgcttcccccccctggaaaacattttggttcctggggaaagaaacctggctccaaaaacaagggcttgttaatccctttggtgccaatggggcccccggttaaaggaaaatttttttgtgggcccgggtt

SEQ ID NO: 67056 - DNA, 647 bp, Zea mays
  misc_feature: Ceres CLONE 1540773
  misc_feature: Encodes the peptide sequence at SEQ ID NO. 67057
ctccccgcggtggcggccgctctagaactagtggatcccccgggctgcaggaattcgtctcacccctagaaaaaaatcggttgaatcggggagcagaggcatcgcccccacgcccaatcatccgcccccaaatccccagaagcacccacccctccgcgcgcgagatcccacgcgcgtccctcccacagtcccaccaccccccggggacgcggactccctcctccgtcctccccccccccccgcggtcccagcccagcggtggccctgcgacgaccgatggacgcggcggcgaagaagatgacgcggagcatctcgcggcagctctcgtcgggggcggcgcggctgtggcgccagctgtcgctggacccgcacaccccgcgccgcggcggcccgggcccggtcccagcggcgggggccgggcagacgcggttcgcgatcgccaggcagtcgtcgctcgacccgacgccgcgcggcggggcggacgggtcgtcggcgcaccagcagctcgcggtgccggagaacctggacgcccccatgcgcctgctcttcgccgcgtgccagggggatgcccgccggggtcgaggaactgctcaggaccggggtggacgtcgacagcatcgacctcgacggaagtacggcgctgccct

SEQ ID NO: 67057 - protein, 123 aa, Zea mays
  misc_feature: Ceres CLONE 1540773
MDAAAKKMTRSISRQLSSGAARLWRQLSLDPHTPRRGGPGPVPAAGAGQTRFAIARQSSLDPTPRGGADGSSAHQQLAVPENLDAPMRLLFAACQGDARRGRGTAQDRGGRRQHRPRRKYGAA

SEQ ID NO: 67058 - DNA, 650 bp, Zea mays
  misc_feature: Ceres CLONE 1540775
  misc_feature: Encodes the peptide sequence at SEQ ID NO. 67059
ggagctccccgcggtggcggccgctctagaactagtggatcccccgggctgcaggaattcgtctcacccctagaaaaatgtctcgcgggtcctgccgtctcgtcgccactactgactactgaggagaggagcatggccctgactaacgtcttcgtcgtcctcctgagtaccgcattggctgtgctccccttctcccctgccgatgccggcgtggtgggcgtgagctacggccgattagggaacgacctgccgggcacggcttcggtggtaaagctgctgaagaagagcggcatcacctcggtgaggctctacgacgccaactcagaggtgctcaaggccctggccaacaccgggatcacggtgatggtaatgctacccaacgacaagctcgccgcggcggccgcggacccgtcgagcgcgcaacagtgagtggggaggaacgtggcggcgtactaccccgccacacagatccacgccgtcgccgtcgggaacgaggtgttcgaggaggcaagatactgagcgggcagctcgtcccggccatgtcccacgtgcacgacgcgctggtgaatcttggactggacggggccgtgaagtctcgacgccgatcgcgttcacgcgctccagagtcgtgggcgccgtccgcgggcagt

SEQ ID NO: 67059 - protein, 98 aa, Zea mays
  misc_feature: Ceres CLONE 1540775
  misc_feature: SWISSPROT Homolog: EC 3.2.1.73 Licheninase
MALTNVFVVLLSTALAVLPFSPADAGVVGVSYGRLGNDLPGTASVVKLLKKSGITSVRLYDANSEVLKALANTGITVMVMLPNDKLAAAAADPSSAQQ

SEQ ID NO: 67060 - DNA, 638 bp, Zea mays
  misc_feature: Ceres CLONE 1540781
  misc_feature: Encodes the peptide sequence at SEQ ID NO. 67061
tccccgcggtggcggccgctctagaactagtggatcccccgggctgcaggaattcgtctcacccctagaaaaagtctcctcctcgctcaggcaggggaacccaacggaactcctcctccccagcagacagcagagagtacataggagacgagaagatcccatccactaccgcccggtcgcggtcctccgccctccgccctccccgccgctcgttcggtgcaggtcgccctcgcgtggatcggaatgggcgcctgcgtgtccaaggccgcctgctgctgccgccagccgcacaacggggttaccaacgagaggactgatactgtgacggaggacgaggaggcatacgacctgcctgcgttccaggagttcaccttcgagcagttgcggctagctacatcggggtttgcggtggagaacatcgtgtccgagcaaggtgagaaggcgcccaatgtggtatacaaggagaagctcgatgcccagcgccgcattgctgtcaagcgctttaaccgctctgcctggcccgaccccgcgcagttcctgggagaagctagatcagttggcctgctccgaagcaaaaggttggcaaatttgcttgcttgttgctgtgaaggtgatgagagattgcttgctgcagaatc

SEQ ID NO: 67061 - protein, 131 aa, Zea mays
  misc_feature: Ceres CLONE 1540781
  misc_feature: SWISSPROT Homolog: EC 2.7.11.1 Non-specific serine/threonine protein kinase
MGACVSKAACCCRQPHNGVTNERTDTVTEDEEAYDLPAFQEFTFEQLRLATSGFAVENIVSEQGEKAPNVVYKEKLDAQRRIAVKRFNRSAWPDPAQFLGEARSVGLLRSKRLANLLACCCEGDERLLAAE

SEQ ID NO: 67062 - DNA, 651 bp, Zea mays
  misc_feature: Ceres CLONE 1540783
  misc_feature: Encodes the peptide sequence at SEQ ID NO. 67063
  misc_feature (395)..(395): n is a, c, t, g, unknown, or other
ctccccgcggtggcggccgctctagaactagtggatcccccgggctgcaggaattcgtctcacccctagaaaaaaagaagagcacgcccactcctctccggctcctcttcttatccaccacaccacaggcaccggaaccggtaccgcctcctccctccctcctgctatcgtgcggcaccccagccacagcacagtaatggcgggcaactgcgccatcgtggacagcgacccgctgaactggggcgcggcagccgccgagctggcggggagccaccttgactatgtgaagcgcatggtggcgcacgcccggcagccggtggtgaagatcgagggctccacgctccgcgtcagccaggtggccgccgtcgcgtcggcgagggacgcgtccggcgtcnccttcaatctcgacgaggatgcccgcccccgcgtcaaggccagcaacgagtggatcctccactgcatcgcccacgaaggcgacatctaacgcgtcaccaccggcttcggcggcacctcccaacgccgaacaaaggacggggccccgctgcgggtcgagctggtcaagcatctcaacgcccgaaatcttcggaaccggaaagagaagggcacacactggccttcggaagtcacccgggcagattttgctggtgaaaa

SEQ ID NO: 67063 - protein, 95 aa, Zea mays
  misc_feature: Ceres CLONE 1540783
  misc_feature: SWISSPROT Homolog: EC 4.3.1.5 Phenylalanine ammonia-lyase
  misc_feature (67)..(67): Xaa is any aa, unknown, or other
MAGNCAIVDSDPLNWGAAAAELAGSHLDYVKRMVAHARQPVVKIEGSTLRVSQVAAVASARDASGVXFNLDEDARPRVKASNEWILHCIAHEGDI

SEQ ID NO: 67064 - DNA, 649 bp, Zea mays
  misc_feature: Ceres CLONE 1540786
  misc_feature: Encodes the peptide sequence at SEQ ID NO. 67065
ctccccgcggtggcggccgctctagaactagtggatcccccgggctgcaggaattcgtctcacccctagaaaaactgctccgtggccgcctttcagagaaaacagagggaggaaagaaaaaactcacccccctctctcttcccaccacctctctcacgtgtgtgaggtggcgagcccaaggaggagcgggaggccacaagtccgatccgcccgtatctaatccgctcgagcgcagcggctcgttcctcgcggggacgcacggttggcatttcgagtgctgagacatcggcttcattgaatcctagagcacggttgagccatggctggctcccttgctgactcagtcttcttccgtggcacaggggcgtctccagcagcatccacgaagaacttggctggtgaagtaccggatagtttgagcgtccgtggtattgtcacaaagcctaatgccaatctgaaacattgggaagggaaggctcaagcacaaacccttcccaaggttaatgggcaccaagggttaacctcaaaaaatgcaagcctcagaacacagaggaaggcgatacccctaacactgcctcccaagaacatttctaacaaccaaacttggccagaattggaagccatgcctttctttgcgggctgggccact

SEQ ID NO: 67065 - protein, 110 aa, Zea mays
  misc_feature: Ceres CLONE 1540786
MAGSLADSVFFRGTGASPAASTKNLAGEVPDSLSVRGIVTKPNANLKHWEGKAQAQTLPKVNGHQGLTSKNASLRTQRKAIPLTLPPKNISNNQTWPELEAMPFFAGWAT

SEQ ID NO: 67066 - DNA, 620 bp, Zea mays
  misc_feature: Ceres CLONE 1540787
tggagctccccgcggtggcggccgctctagaactagtggatcccccgggctgcaggaattcgtctcacccctagaaaaattagagatcctcctcctcgtgtatttgtctctgtctcttcctctgggtatgagaggtccctcccatgctctacttctacagaactgacatgtcctccacagtctactcactgtcctccatcctgctcggcggaaatcgggtgttgcccccccacctcgtacaccggttaccgtgatacatcgaccctcagaatctgggagtcggccttgtcggcggctgatgcctcgtgctgcctacgtatctgtccctcgcaaaactcttagcaagctactcccctgtctgtcgctaggtcgtcctagctctccgcgctgatgctcctagaacgcgccgccgacgtcgtgcatggcttccgtgccggagacggagacatgaccgactcatgagactacttgccgatgccgaacagatcgagtccccccagtctgcgtgatggcacaacagtctccgaggatcccagcttgccggaagctccctgaagacgaaggacatgccgtcaggttcagaaaagccctgcttagccgacagcgacgacgattgccat

SEQ ID NO: 67067 - DNA, 620 bp, Zea mays
  misc_feature: Ceres CLONE 1540789
  misc_feature: Encodes the peptide sequence at SEQ ID NO. 67068
  misc_feature (455)..(455): n is a, c, t, g, unknown, or other
  misc_feature (500)..(500): n is a, c, t, g, unknown, or other
ggagctccccgcggtggcggccgctctagaactagtggatcccccgggctgcaggaattcgtctcacccctagaaaaaaaaccctcgcaccctaaaacagcggcgcacaagatgtccgacgaccccaccaacggcggcggcggtgatcgcgtggaggacgtcgtccgcgccgagggtgaaacacaacctcgtgatgatggcttgtcgaaatccaaggatagggacaaagatagagaaaaggacaaggacagagatcgtcgccgagaccgtgacagagatcgagggagagacagggaccgtgatagggatagggacagggacagggatcgggacagagacaaggatcgccaaagtaggcatcaccgtgaaagacgggaacagcgagaccgtcctgatgatcacagagtccgtgattctgaaagaagaagagaacgcgacaaagatgggcatcgtangcatcgttctcggtctcgttcagggggtagagatcgtagatctangtcacgttcaagaagcaagcgagttagtggattcgacgcccccccccgcaagcaatgggttcaaacattccagttattcaaaccccagtcagttaccaggctcttcgctccccaacgtgg

SEQ ID NO: 67068 - protein, 169 aa, Zea mays
  misc_feature: Ceres CLONE 1540789
  misc_feature (115)..(115): Xaa is any aa, unknown, or other
  misc_feature (130)..(130): Xaa is any aa, unknown, or other
MSDDPTNGGGGDRVEDVVRAEGETQPRDDGLSKSKDRDKDREKDKDRDRRRDRDRDRGRDRDRDRDRDRDRDRDRDKDRQSRHHRERREQRDRPDDHRVRDSERRRERDKDGHRXHRSRSRSGGRDRRSXSRSRSKRVSGFDAPPRKQWVQTFQLFKPQSVTRLFAPQR

SEQ ID NO: 67069 - DNA, 639 bp, Zea mays
  misc_feature: Ceres CLONE 1540792
  misc_feature: Encodes the peptide sequence at SEQ ID NO. 67070
  misc_feature (571)..(571): n is a, c, t, g, unknown, or other
gcggtggcggccgctctagaactagtggatcccccgggctgcaggaattcgtctcacccctagaaaaattccattccatctcatcgcaacgttacgcaagcatcctccacctcctgccttgcctgcctgcctgcgtcgtagtttgcacaccgcaaccgtgttcttctctctctctctctctctccctctcgtccctgagaaagcgccgccgctctacgttcccctcgcttgcgctcggtccggcaaaggcccgtccttccatggccatcgcctcccgtgcaacgaagcgcgcgctgtccaccttcgccgccgccaagctcccggaggaggcggtcgcggccgcggccgccggcgaggcgatcgccgcccgctcccaccaggcggtgccgctgccaccggcgcccgcgtcgtccgtgaggccgctgcagttcgaggacaccggccgcctgttcgcgggggagccgacgtcggcgctgctgcgcacgctcgccgcgctgcaggcgctgtccgtgggccgctcgtgaccgcccgcgcgggggccgtgtgggggggcccgggggggggggcgggncccccccttgggcccccgcccgggccagggccccggggtgaccgcccacttctggcgcggggaaaacc

SEQ ID NO: 67070 - protein, 87 aa, Zea mays
  misc_feature: Ceres CLONE 1540792
MAIASRATKRALSTFAAAKLPEEAVAAAAAGEAIAARSHQAVPLPPAPASSVRPLQFEDTGRLFAGEPTSALLRTLAALQALSVGRS

SEQ ID NO: 67071 - DNA, 628 bp, Zea mays
  misc_feature: Ceres CLONE 1540794
  misc_feature: Encodes the peptide sequence at SEQ ID NO. 67072
  misc_feature (448)..(448): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (573)..(573): n is a, c, t, g, unknown, or other
  misc_feature (581)..(581): n is a, c, t, g, unknown, or other
  misc_feature (594)..(594): n is a, c, t, g, unknown, or other
  misc_feature (620)..(620): n is a, c, t, g, unknown, or other
  misc_feature (621)..(621): n is a, c, t, g, unknown, or other
  misc_feature (624)..(624): n is a, c, t, g, unknown, or other
  misc_feature (625)..(625): n is a, c, t, g, unknown, or other
  misc_feature (627)..(627): n is a, c, t, g, unknown, or other
ccccgcggtggcggccgctctagaactagtggatcccccgggctgcaggaattcgtctcacccctagaaaaatactcaagacgctcacaactctgggtaggtaagcaggggggcgaaatggatccgcttcgtcgccggacgcattgaaccatgcgtgccgcttcggtcctttcttcccatctaggaccctactctgattgtttttcacgacaccatctatgttcttctgctcaaggcagcatgcgaaggtttatccttagctttacacgacgatctggaagagtaggcaagcaagatggagtccaattgttgagcccgtcggaaatgcctcaaagggactggttcctctcagacttcatctgcggtgccgctactgcagcgtagcaaattgcaatgtgccttggaaacgagatcggatatggggaaagcaagtaggatcacgttcggncaatttttttcccggaataggaaaaggaaaggggcccaatggggaaaccttggggaggcccattttgtccccccccccatatatggggggcccaaagnnnnnnnnaaccacaaaaaaacagaagngattagtntgcgggggggggngagtgtaatacgtaatgaatggtgtnntgnnana

SEQ ID NO: 67072 - protein, 77 aa, Zea mays
  misc_feature: Ceres CLONE 1540794
  misc_feature: SWISSPROT Homolog: EC 3.2.1.21 Beta-glucosidase
MRAASVLSSHLGPYSDCFSRHHLCSSAQGSMRRFILSFTRRSGRVGKQDGVQLLSPSEMPQRDWFLSDFICGAATAA

SEQ ID NO: 67073 - DNA, 667 bp, Zea mays
  misc_feature: Ceres CLONE 1540800
  misc_feature: Encodes the peptide sequence at SEQ ID NO. 67074
  misc_feature (43)..(43): n is a, c, t, g, unknown, or other
  misc_feature (52)..(52): n is a, c, t, g, unknown, or other
  misc_feature (70)..(70): n is a, c, t, g, unknown, or other
  misc_feature (72)..(72): n is a, c, t, g, unknown, or other
  misc_feature (80)..(80): n is a, c, t, g, unknown, or other
ctccaccgcggtggcggccgctctagaactagtggatcccccngggctgcanggaattcgtctcaccccntngaaaaaanaaaaaaaaaaaaaaaaaaaaaaaaaaaaaaaacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtccctgcgcgtacgagctctccaagggacccggccgtgagcatccgcatcctgaaacaatcggtgtcccccgggcggccgcccttggttgggccgggcacttttcctcggccattggggggtgccaaaaccgggccacccttttcctggaaaaaactggggggggggcctaacaaaaaggccaaagaa

SEQ ID NO: 67074 - protein, 114 aa, Zea mays
  misc_feature: Ceres CLONE 1540800
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSLRVRALQGTRP

SEQ ID NO: 67075 - DNA, 668 bp, Zea mays
  misc_feature: Ceres CLONE 1540804
  misc_feature: Encodes the peptide sequence at SEQ ID NO. 67076
  misc_feature (177)..(177): n is a, c, t, g, unknown, or other
  misc_feature (457)..(457): n is a, c, t, g, unknown, or other
  misc_feature (587)..(587): n is a, c, t, g, unknown, or other
  misc_feature (597)..(597): n is a, c, t, g, unknown, or other
ctggagctccccgcggtggcggccgctctagaactagtggatcccccgggctgcaggaattcgtctcacccctagaaaaaacacagcaaagcctcaaaacctgatcatcagagaaacgaaaaggaagaggtgagcgtgggagaaaaaacaaaagaaaggaaaagagatatagccctngagaagaatgtcccttacaactgatgaactcaaggccaaggccgaggtatactacggtgacgagatctgccagctgtgtacccagctcctggcttcaaggggaagcaggcctccccaatggcctgcttccattgaaggacctaatcgagtgcggctatgtccaggaaactggattcgtgtggctgaagcaaagcaacagggttgaccacatcttccatagtctaggaaggctggtctcttacggcacggagatcaccggctatgccgagaagggcaggantcaggaagtcaaagggataaagaccagggagctcatgctgtgggtcccggtgggagagattgctcttgatgatgatccagcgactggggaagcttgtctgcaagagcattgctgggattaccaaaacctnccctgcatcngcttttcatatcccggagaaagagaacaatgtgaaggcgaactgtgctgcactgaaagccggtggtcctct

SEQ ID NO: 67076 - protein, 156 aa, Zea mays
  misc_feature: Ceres CLONE 1540804
  misc_feature (8)..(128): Pfam Name: DUF538 Pfam Description: Protein of unknown function, DUF538
  misc_feature (86)..(86): Xaa is any aa, unknown, or other
  misc_feature (133)..(133): Xaa is any aa, unknown, or other
MNSRPRPRYTTVTRSASCVPSSWLQGEAGLPNGLLPLKDLIECGYVQETGFVWLKQSNRVDHIFHSLGRLVSYGTEITGYAEKGRXQEVKGIKTRELMLWVPVGEIALDDDPATGEACLQEHCWDYQNLPCIXFSYPGEREQCEGELCCTESRWSS

SEQ ID NO: 67077 - DNA, 586 bp, Zea mays
  misc_feature: Ceres CLONE 1540806
  misc_feature: Encodes the peptide sequence at SEQ ID NO. 67078
  misc_feature (586)..(586): n is a, c, t, g, unknown, or other
ggatcccccgggctgcaggaattcgtctcacccctagaaaaaactgctgcggcagtaatggccgcctggttccacttccaccacggtgtgcactagcgctacaccgaggccaccttttcttggttccttcaacacgcctactccggcctccggatcgggcaccacgtctgccccctgctcccggaatctttgccaagcggcgccgctactgtccggcaaggcgaccccgtctctcggccggcgttgatctggcgggcggagtggcggcgcgatgggcatctcggcgaggtggctcaagtcgttagttgggttgaggaaggtggggcggcagcagcagcagcggcgaaaggatgatgcagatgttggtcgaatgaaaaccgatgtcgccgaccagtttcattttcagattcagcactctcaagatgacaatagcattgctgcacaagaaattccagaggtttcttatggaaatgatccacctgaagatgattctaatgtaccttcatgcttcgagcctgctcgtagttcagctcatatgccattttgtcaaactgaagaagcccagatagagatctgggctgctacn

SEQ ID NO: 67078 - protein, 105 aa, Zea mays
  misc_feature: Ceres CLONE 1540806
MGISARWLKSLVGLRKVGRQQQQRRKDDADVGRMKTDVADQFHFQIQHSQDDNSIAAQEIPEVSYGNDPPEDDSNVPSCFEPARSSAHMPFCQTEEAQIEIWAAT

SEQ ID NO: 67079 - DNA, 635 bp, Zea mays
  misc_feature: Ceres CLONE 1540807
  misc_feature: Encodes the peptide sequence at SEQ ID NO. 67080
  misc_feature (517)..(517): n is a, c, t, g, unknown, or other
  misc_feature (576)..(576): n is a, c, t, g, unknown, or other
ctccccgcggtggcggccgctctagaactagtggatcccccgggctgcaggaattcgtctcacccctagaaaaacgcacataaatcaattctctccctccgaacaaaaaacttcctcccgcgaagttctgcggtggccttttaatcttgctccgtgagagctacaaggagcatctttggcgaaagcatcggtgggaggaagccggagatgaacagggcaaggaatgttttaggacaagagaatctgcggccagagatgaagcagctagcaaaatccagcatagataagctgagtgaacgcaaggccgccgtggacagagaaagagccggcgcctagtccgagctgtcgagggcgcgcgccatggcgaaggaactggagcgccaaatagagcaggccaaggcccgggcgtcgtccaagaggtcagaccctcacactatgcggccggcgaccagggcaagcaagacgggacacggtgcgccgcgctcgcatggggagcggcgcgaccctgccgagtacncggaggtgtcgcgggaactgggaccgtgccaggctagatctgctcaagctgcggctggnaggtcagtccgcgggggaagccaaagccaaagccgagagcgacatcgtgtcgtcggcaa

SEQ ID NO: 67080 - protein, 42 aa, Zea mays
  misc_feature: Ceres CLONE 1540807
MNRARNVLGQENLRPEMKQLAKSSIDKLSERKAAVDRERAGA

SEQ ID NO: 67081 - DNA, 629 bp, Zea mays
  misc_feature: Ceres CLONE 1540809
  misc_feature: Encodes the peptide sequence at SEQ ID NO. 67082
  misc_feature (204)..(204): n is a, c, t, g, unknown, or other
  misc_feature (324)..(324): n is a, c, t, g, unknown, or other
  misc_feature (591)..(591): n is a, c, t, g, unknown, or other
ctccccgcggtggcggccgctctagaactagtggatcccccgggctgcaggaattcgtctcacccctagaaaactctctctctcctctacctccttttcctctaacctttagctttcctccctccctctcctctctcccccctcctctaacaagaactactcccagccattcagatcctaagttgctgaccttgctgctgcttngtggagatagatttgttggttctaagttcgaagtaccatgagtccaccgagtgtgatggggcagtttggggacacaacctacaccaaggtttttgttgggggactcgctggggaaacccnaaaggaacccatgaggaagtcctccgaagcattttgggaaaacccgggaggcgggtgccttccctggaaagaaacctgggcaaatcccaggggctccggatttgtttccctttccggaatcccgaaccccggcataaaaagctttcgttttatcccccccccccggtttttttggggaggggggggcaaaacgggaaccctggcctcccccgggggggttaaaaaaaattagggcgccccccctccccccccgtgggggggggcccnaaacccctttagggagaaaaaaaacccccccccgcccc

SEQ ID NO: 67082 - protein, 104 aa, Zea mays
  misc_feature: Ceres CLONE 1540809
  misc_feature (28)..(28): Xaa is any aa, unknown, or other
MSPPSVMGQFGDTTYTKVFVGGLAGETXKEPMRKSSEAFWENPGGGCLPWKETWANPRGSGFVSLSGIPNPGIKSFRFIPPPRFFWGGGGKTGTLASPGGVKKN

SEQ ID NO: 67083 - DNA, 683 bp, Zea mays
  misc_feature: Ceres CLONE 1540811
  misc_feature (302)..(302): n is a, c, t, g, unknown, or other
ctccccgcggtggcggccgctctagaactagtggatcccccgggctgcaggaattcgtctcacccctagaaaaactattcctcctcagcataccccttcttccttcgtccccattgatccccttcccccctccactcgtctcccaaatcgccagcgagcgccatgccgccgcctcccctgccctcgccgcccctgaccggctgacccgacctccccactgttctttcccttccacctgggcgccacagcgtttcccttcccgtcaccacgaaatcccggagggacgaggaggggattcgtcncctgatcgatcggccgatccacgccgcccggcctcccaatccttgggtgccgccatgccccccccgaggggggggaggggggaaaccgcaagggcgccccccccgggaacaagcgcggaagtcccccccggcgcccccgatagcgcccctcgttggtccctccgggaaacgggcggcgggcagccccggggggaaccccccccccgtccccgtgaacacacggcctccccggggcaaaagggccttttgccggagagtcgcaccctttctcccggagagggaggcccggccggagttttgggaacaaacccggggggggggggggagcgctcacccgcccctccgcggggggcgggtgccggctccccccgcaagggtgcc

SEQ ID NO: 67084 - DNA, 630 bp, Zea mays
  misc_feature: Ceres CLONE 1540812
  misc_feature: Encodes the peptide sequence at SEQ ID NO. 67085
ctccccgcggtggcggccgctctagaactagtggatcccccgggctgcaggaattcgtctcacccctagaaaaaagctgatccctccccttccccgacatcaaccggcgcggcgcgaccatccccagccactattattattaccatcatcatcacctacccgctgccttcatcctcctcctcgccccttcccaccgccgattcctcgcgtcttcccgtcgtctccgactcgcctccagttcccgatttgcccaacgccagcgacgccgtcgcatggagatctccttcgaggcgtgggagggcgtgcagcggcacggccaggacctcgcggaccgcctcgcgcagggcttcacgggcctgctccaggcgccgccgcagttcccgtggcctccggcgccgcacaagcggatgcccttcgacatcgacctccccgtcgtccccttcggcgccggcgtgccgaataggacctccccttcccggccgccgccgccgccgtctcctcggtcatcgacatcggcggcaggctgggccaggccggcgccgagcttggggcgtccgtaggcgggggcgtgcatcacgccgtgcgccatctgccccgtgccgttccgcaacggccagatccggcgcccgc

SEQ ID NO: 67085 - protein, 95 aa, Zea mays
  misc_feature: Ceres CLONE 1540812
MEISFEAWEGVQRHGQDLADRLAQGFTGLLQAPPQFPWPPAPHKRMPFDIDLPVVPFGAGVPNRTSPSRPPPPPSPRSSTSAAGWARPAPSLGRP

SEQ ID NO: 67086 - DNA, 649 bp, Zea mays
  misc_feature: Ceres CLONE 1540817
  misc_feature: SWISSPROT Homolog: EC 3.2.1.23 Beta-galactosidase
tccccgcggtggcggccgctctagaactagtggatcccccgggctgcaggaattcgtctcacccctagaaaaaaattcgtgcccactatacgtacgtacaaaaaagattagtacactagcgtttactgtaggtctgttcttggagttggccgtcgccggcacggctgcaggaactgcggctcacggccggctggtaatggtactagtagcatggtttttgctctgcagtccgcatgaatctcaaggcgcacgcaggcttaattttcttagcacaaatttgcgaaactgagttgtaaatgaggttatttattcctacgattaagtaggatacaagacgaataattattatgtgagttctttttacggtggttggtgatgccttttctcttaaaaaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaaagagccccgcacgatcgcccttcccacagttgcgcagccctgatggcgaatggaaattgtaagcgttaatattttgttaaa

SEQ ID NO: 67087 - DNA, 820 bp, Zea mays
  misc_feature: Ceres CLONE 1540827
  misc_feature (38)..(38): n is a, c, t, g, unknown, or other
  misc_feature (39)..(39): n is a, c, t, g, unknown, or other
ttcccctcatccctcccttctcttctacttccccacannaaacattaaaaaaaaaaaagctggaactcaccgcggtggcggccgctctagaactagtggatcccccgggctgcaggaattcgtctcacccctagaaaacgtgtccggtgcgggctgcgagtgacgtgggctaaataaagtgtgcgtcgggtggtaatggtggtggggcccggtgtcagtgcgcgcggtgccccatgcctgccgcggctgcagcttgttgtgtcttgtgttggttgagttcctgttctttctgtctatctattctcacgcatggcagtttgggtatggtatgggtcgccttctttgattacgttctgattgtgtccttgtgcgatgatctgctcttctctatatcaccatagagcccagtttttcatcaccctaaaaaacaaaaaaaaataactaagaccctttgagggtctccccccccccccccgtttttggtgaggtccgtatttaccgccgcgtcttcactggggcccttccttttttaccacccgttcgttgaaccttggtaaaaaaaccccctgggcggttatgccctaaacctttaattcgcgcttttggtagccataaatcccctcctttttcccctaggcgtgtgcccttattatccggaaaaaggttcccctaaccccatattcggcccttttccacaacacgatttgcgcccatcctgcaatggtgcgaaatgggaaaattgttaagcttatctatattcctgtccaaaattttcgcgccttcaaattttttattaaatacgggcttattttgttttccc

SEQ ID NO: 67088 - DNA, 630 bp, Zea mays
  misc_feature: Ceres CLONE 1540832
  misc_feature (135)..(135): n is a, c, t, g, unknown, or other
tggagctccccgcggtggcggccgctctagaactagtggatcccccgggctgcaggaattcgtctcacccctagaaaattgttattataaatcattttacccgattggtggagtcgacggagaagcttgagaacncattaattgtgtagatcgaaatcttcattggcttccccgagggccgtgaacccttggtagttgcgacacagggcaaggaactggcgcccaagctaaaagaaaataaagacgaacccttcaggctccaaaatcgccctttttgggagggttgaacacagcccccaggagccctcttttaagtgaaccggagcgggaaaaccctggtggttacaaaattaaatcagttcggagcgtatcccattgtagcgggggggataattgaaaaaaggcccggccatgatcctcttccccacattctcgtatcttcgatgggaaaaggaaaatgcaacccctcatgtttggtgataaccgcggattactttttgtgaaaagccgctggttttttaaaccaataggccaaaaatcgcaaaacgcctctaaattccccaaaaatcgccccaaattgggtggggtgttgttccccgttggggaaaaaaggtctccaattttaaaaag

SEQ ID NO: 67089 - DNA, 817 bp, Zea mays
  misc_feature: Ceres CLONE 1540837
  misc_feature: Encodes the peptide sequence at SEQ ID NO. 67090
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (22)..(22): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (817)..(817): n is a, c, t, g, unknown, or other
nnnnnnnnnnggggcgcccctnacaaccccttnnnnnatttnnnnnnannaaactggggctccccgcggtggcggccgctctataactagtggatcccccgggctgcaggaattcgtctcacccctagaaaaagtggcgctgtcccctccctggcacccaccctcacaaagcatcagcctctccaatcagacgcgagccacccaccgcgcgacctcagggtgcctgtgcctgctcccgctgttccttcctcatggccaccgcctgccacctcgccgcgccgctcggcctcgccccgttgcccccgcggctgcgcctctgctggcgtcgtggccgtcttccggtgcgctcggtcgtcaggctccaagattccgagaggcgttgctgtcagggccacctcccggcggcgagggccccccggaaggaggtccccggagattgtggaagggctgcccaggaacgtgttgtgacaaccccccaggacaagtaccgccctgggccacccatgagtgttccgctgcccttcctttgcgcttctgggacgggagttaggtggcctatcaatgggcctcgcacgaagcatctcgccattcccccctggggggccctctcgcagattgtgtcggcaatttggctaaatacagggggcgggtttacgcatatccggtaaacccttcgtccttccccagcccaacaacggggggcggcgttccccactatccgccaacaacctcaacgagtcgcccgtcttaatagacggacgattcttccggcgggggcctgtcacgcgaccttcggaggccagaacgagcatctctn

SEQ ID NO: 67090 - protein, 138 aa, Zea mays
  misc_feature: Ceres CLONE 1540837
MATACHLAAPLGLAPLPPRLRLCWRRGRLPVRSVVRLQDSERRCCQGHLPAARAPRKEVPGDCGRAAQERVVTTPQDKYRPGPPMSVPLPFLCASGTGVRWPINGPRTKHLAIPPWGALSQIVSAIWLNTGGGFTHIR

SEQ ID NO: 67091 - DNA, 515 bp, Zea mays
  misc_feature: Ceres CLONE 1540839
  misc_feature: Encodes the peptide sequence at SEQ ID NO. 67092
  misc_feature (411)..(411): n is a, c, t, g, unknown, or other
  misc_feature (434)..(434): n is a, c, t, g, unknown, or other
  misc_feature (435)..(435): n is a, c, t, g, unknown, or other
  misc_feature (515)..(515): n is a, c, t, g, unknown, or other
tgggctccccgcggtggcggccgctctagaactagtggatcccccgggctgcaggaattcgtctcacccctagaaaatctctctcctctacctccttttcctctaacctttagctttcctccctccctctcctctctcccccctcctctaacaagaactactcccagccattcagatcctaagttgctgaccttgctgctgcttgttggagatagatttgttggttctaagttccaagtaccatgagtccaccgagtgtgatggggcagtttggggacacaacctacaccaaggtttttgttgggggactcgcgtgggaacccagaagggacgatgaggaagtcttcgagcagtttgggagatcctggagctgttgctcactgacaagacactggcagatccagggctacngatttgttaccttccgggatccnngacgcgcgatgagagcttgcgttgatcccgcaccggtgattgaatgggagggagggctactgttatcttgctccccttgn

SEQ ID NO: 67092 - protein, 90 aa, Zea mays
  misc_feature: Ceres CLONE 1540839
  misc_feature (57)..(57): Xaa is any aa, unknown, or other
  misc_feature (65)..(65): Xaa is any aa, unknown, or other
MSPPSVMGQFGDTTYTKVFVGGLAWEPRRDDEEVFEQFGRSWSCCSLTRHWQIQGYXFVTFRDPXRAMRACVDPAPVIEWEGGLLLSCSP

SEQ ID NO: 67093 - DNA, 664 bp, Zea mays
  misc_feature: Ceres CLONE 1540845
  misc_feature: Encodes the peptide sequence at SEQ ID NO. 67094
catagctggagctccccgcggtggcggccgctctagaactagtggatcccccgggctgcaggaattcgtctcacccctagaaaaatcaaactcttgccctccccccggcaccacactagcctagtgagaagtgcagcagcagcaccagcggcagaagtgttacttagttgctcctcctacctgtgctgctgcgcaggagcagagcctgaaaggacgacggccgtcggcgtaaggggagcgagcgagcgagcggccatgaagtacgtgctggtgaccggaggggtggtgagcgggctcggcaagggcgtgacggccagcagcatcggcgtcgtgctcaaggcctgcggcctccgcgtcaccaccatcaagatcgatccatacctcaacaccgatgctggaaccatgtcgccgttcgagcacggggaggttttcgttttggacgatggcggagaggtggacttggaccttgggaactacgaacgttttctggacatcaaaattgacccgcgacaacaattataccacgggaaaagatctttccaggctgtcatttaacaagggagaggagaggccgactaccctaggggaagaccttcccggttaggtggccccacatcaacggaggagaatacaggacctggatccaaacccgtccccggtgggc

SEQ ID NO: 67094 - protein, 99 aa, Zea mays
  misc_feature: Ceres CLONE 1540845
  misc_feature (1)..(100): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTTIKIDPYLNTDAGTMSPFEHGEVFVLDDGGEVDLDLGNYERFLDIKIDPRQQLYHGKRSFQAVI

SEQ ID NO: 67095 - DNA, 713 bp, Zea mays
  misc_feature: Ceres CLONE 1540846
  misc_feature: Encodes the peptide sequence at SEQ ID NO. 67096
cagagctggagctcaccgcggtggcggccgctctagaactagtggatcccccgggctgcaggaattcgtctcacccctagaaaaatgtttgggaatgcagcccaaatcgggcggtaaactccgtccaaggctaaatacaggcgagagaccgatagcgaacaagtaccgcgagggaaagatgaaaaggactttgaaaagagagtcaaagagtgcttgaaattgccgggagggaagcggatgggggctggcgacgcgcaccggccgtatgcggaacggctcctgctggtccgccgatcggctcggggcgtggaccgtccccacaaaccctaacactccaccgacgcccagatctgttccttctctcttccacgccgccgccgccgccctcgaattttcgaatcctcagcaacaatcggcctgccgccatgagggagatcctccacatccagggcggccagtgtggcaaccagatcggtgccaagttctgggaagtggtgtgcgcggagcacggcatcgacgccaccggccgctacggcggcgactccgacctgcagctcgagcgcgtcaacgtctactacaacgaggcctcgtgcggccgcttcgtgccccgcgccgtgctcatggacctagagcccggcaccatggactccgtgcgctccggtccctacggccacatcttcggccccgacaacttcgtcttcggccagtccggg

SEQ ID NO: 67096 - protein, 96 aa, Zea mays
  misc_feature: Ceres CLONE 1540846
MREILHIQGGQCGNQIGAKFWEVVCAEHGIDATGRYGGDSDLQLERVNVYYNEASCGRFVPRAVLMDLEPGTMDSVRSGPYGHIFGPDNFVFGQSG

SEQ ID NO: 67097 - DNA, 618 bp, Zea mays
  misc_feature: Ceres CLONE 1540851
  misc_feature: Translation starting site: 203
  misc_feature: SWISSPROT Homolog: EC 1.14.14.1 Unspecific monooxygenase
  misc_feature (582)..(582): n is a, c, t, g, unknown, or other
ctccccgcggtggcggccgctctagaactagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtgggtggggaaccctgttcaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcaggggcccatgttcgcgagcctgcccgtagacagccccacccgctcctcttcagcgtcggcaagtgcaccgtcaactcggcgccctaccgcccccntgtgcgtgctctgcgccgcaactcgtcgcccagatc

SEQ ID NO: 67098 - DNA, 668 bp, Zea mays
  misc_feature: Ceres CLONE 1540855
  misc_feature: Encodes the peptide sequence at SEQ ID NO. 67099
ggagctccccgcggtggcggccgctctagaactagtggatcccccgggctgcaggaattcgtctcacccctagaaaaaaggttggccgggggtgccatgaaattcgggcgggctgttgacacctaatttcgggggccatcaaaccacaccggggcccagaagttcatcctcccacgctcgcctctatctattctggattggcgcctgcataacagaccgccagacgagcaagccacagaggatcaagggcttcaacaggtggagactgctgagcaggagctcattgaaggagaagtacaggttgttgaagaggagccatacaacgaggagttcgacttgatctaggtggcgtctcctagttgactttatggcgccaaagatggaatttagttcgatttatatttatcttttattttgtaatacttccgctatgtaataagtactctaatgatattgtgacatttatctcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagcttgcgtaatagcgaggaggcccgcaccgatcgcccttccc

SEQ ID NO: 67099 - protein, 41 aa, Zea mays
  misc_feature: Ceres CLONE 1540855
GAPRGGGRSRTSGSPGLQEFVSPLEKRLAGGAMKFGRAVDT

SEQ ID NO: 67100 - DNA, 646 bp, Zea mays
  misc_feature: Ceres CLONE 1540869
  misc_feature: Encodes the peptide sequence at SEQ ID NO. 67101
  misc_feature (42)..(42): n is a, c, t, g, unknown, or other
  misc_feature (43)..(43): n is a, c, t, g, unknown, or other
  misc_feature (70)..(70): n is a, c, t, g, unknown, or other
ctccccgcggtggcggccgctctagaactagtggatcccccnngggctgcaggaattcgtctcacccctnagaaaaaaaaaaaaaaataatggagaagtcttcaaaagaactttaatgatccacaagaagggtgggaactatatgacacaatgttcgtctggaatgagttcctaactcgagggattcgtgacattctgaaaactacactctggactgttgcattagtctatggtttttttaagcaggacaaacttgcgatatgtgggaaggatattatgctgactctcattgctagacgctcgaggcattatgctggcaccaggtatctaaagaggggtgtgaatgaggagggcagagtagcaaatgatgttgagactgagcaaattgtttatgaagacatgcttggaccatggcaaataagctctgttgtgcagaacaggggttcgattccactattctggtcccaggagacatcaaagctgaatcttaagcctgatatcatattgcatggaaaggacaaaaattatgaggctaccaggcttcatttttaaaatcttaggaaaagatatggaaatcctatcatcatcttaaacttgattaagacacgtgagaagagaccacgtgaaatcatactccgtcggaatt

SEQ ID NO: 67101 - protein, 133 aa, Zea mays
  misc_feature: Ceres CLONE 1540869
  misc_feature (1)..(134): Pfam Name: Syja_N Pfam Description: SacI homology domain
  misc_feature: SWISSPROT Homolog: EC 3.1.3.36 Phosphoinositide 5-phosphatase
MFVWNEFLTRGIRDILKTTLWTVALVYGFFKQDKLAICGKDIMLTLIARRSRHYAGTRYLKRGVNEEGRVANDVETEQIVYEDMLGPWQISSVVQNRGSIPLFWSQETSKLNLKPDIILHGKDKNYEATRLHF

SEQ ID NO: 67102 - DNA, 832 bp, Zea mays
  misc_feature: Ceres CLONE 1540876
  misc_feature: Encodes the peptide sequence at SEQ ID NO. 67103
  misc_feature (11)..(11): n is a, c, t, g, unknown, or other
  misc_feature (13)..(13): n is a, c, t, g, unknown, or other
  misc_feature (30)..(30): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
cccccgggggntnttttgtattccttacancatatccttctnnnnnnnnnncaattggggctcaccgcggtggcggccgctctagaatagtggatcccccgggctgcaggaattcgtctcacccctagaaaaatcaacaagtgttctccagaaggctgaaggtgaatatcaaggacatcgctctttgctgatgcgtacccgtggtttgctctccacaatgcaacgacaagatgtttttgataggatcatcctgactattggtttcaccattttctccttggcggttctttacgttgtcccgagacgtattggcctgtttggctctgcaatggaaactgcgccgatgccatctgatcaggttctttattagctgaagacattgtccccaaaaacccaacatggtacctgcccccgccaaacgatctggggtggtgcgtggtcgcggttgcctatgtaatttattggggtggccccccctttgtccgttttttccatatatactgttttcgatccactaacaacatatccttctaagagtcatcatcattgaccatctagcttttaaccttatttagaaaaaacatcctaagtccggggatggttctccatagcggatctcagccccccatgcccccttgcctacgccactcccaatcctcaccccctacaaatttttctccctcttaccccccctttgccactaaacactcttctacaaattaccgtttctcccttccctatcccccccttcatttgtcgttccttgttaggggatgcgtcctctctcgtttcttgtggtccactacccggcttgctcgccccagctccgagg

SEQ ID NO: 67103 - protein, 59 aa, Zea mays
  misc_feature: Ceres CLONE 1540876
MRTRGLLSTMQRQDVFDRIILTIGFTIFSLAVLYVVPRRIGLFGSAMETAPMPSDQVLY

SEQ ID NO: 67104 - DNA, 646 bp, Zea mays
  misc_feature: Ceres CLONE 1540879
  misc_feature: Encodes the peptide sequence at SEQ ID NO. 67105
  misc_feature (512)..(512): n is a, c, t, g, unknown, or other
  misc_feature (579)..(579): n is a, c, t, g, unknown, or other
tggagctccccgcggtggcggccgctctagaatagtggatcccccgggctgcaggaattcgtctcacccctagaaaaagacgccgtctagatttcaaatccgcgtcaagccagggcagagctcagggctcggtctcccccttcgccgccagttgccgcagcctccaacccctcgagatccgccgcgtgtgagaccgccgaccatggaggccatggaggagctgtcagagctcgccgagtcgatgcgccaggcggcgtcgctcctcgccgacgacgacccctccgacgccgccgcgccgcgccggcccaccaccttcctcaacgccgtcgccctcggcaacgtcagctctggcaagtcggccgtgctaaacagcctcatcggtcacccggttttgccgacgggggaagacggggcgacgcgggcgccaatagtggttgaccctgcagaggatccggggctcagcagcaagtccatcgtgctgcagatcgacagcaagtcgcagcaggtttccngcaagtgccctcccggcattcactgcaggacagactcagcaagggggaacgtctggtggatcagggnaggggcccgtgcctgatgaaaattttacctcaagcttgccggacgaagtaccagctcccctcatttt

SEQ ID NO: 67105 - protein, 130 aa, Zea mays
  misc_feature: Ceres CLONE 1540879
  misc_feature: SWISSPROT Homolog: EC 3.6.5.5 Dynamin GTPase
  misc_feature (104)..(104): Xaa is any aa, unknown, or other
  misc_feature (126)..(126): Xaa is any aa, unknown, or other
MEAMEELSELAESMRQAASLLADDDPSDAAAPRRPTTFLNAVALGNVSSGKSAVLNSLIGHPVLPTGEDGATRAPIVVDPAEDPGLSSKSIVLQIDSKSQQVSXKCPPGIHCRTDSARGNVWWIRXGARA

SEQ ID NO: 67106 - DNA, 688 bp, Zea mays
  misc_feature: Ceres CLONE 1540880
  misc_feature: Encodes the peptide sequence at SEQ ID NO. 67107
ctccccgcggtggcggccgctctagaactagtggatcccccgggctgcaggaattcgtctcacccctagaaaaagagtttcgatctcttccatccgagtgtctcctcatcctcggccgccgccgccgccgcttccgtcgtctccgcccgccgtcgccgccgcttccgtcgtctccgcccgccgtggccatgccgtcgcacaagaccttccggatcaagaagaagctggccaagaagatgcgccagaaccgccccatcccctactggatccgcatgcgcaccgacaacaccatcaggtacaacgccaagcgcaggcactggcgtcgcaccaaactcggattctgagcggtggaagaaatgctggctaaagacgcctagagggtatagggctctgcaacctaggaagctcttgtttaattttttttgcttgtgttatttgtcattgtagaaccatgtttttgcctgatggtttaaagaaccgcctcttatgcttatggtgaatttagtttaacctttggcggcccccttaattcaggttgatcctctagcccaaaaaaaaaaataaaaaaacgaggcccccctcgagggtaccccaattttcccccctaatgaggggggttcgtaattaacggcccggcctccctgtgggcgggacttttttttacaacgcgttctgtgacccgggggaa

SEQ ID NO: 67107 - protein, 51 aa, Zea mays; identical to SEQ ID NO: 2355
  misc_feature: Ceres CLONE 1540880
  misc_feature (9)..(51): Pfam Name: Ribosomal_L39 Pfam Description: Ribosomal L39 protein

SEQ ID NO: 67108 - DNA, 633 bp, Zea mays
  misc_feature: Ceres CLONE 1540883
  misc_feature: Translation starting site: 128
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (418)..(418): n is a, c, t, g, unknown, or other
tggcggccgctctagaactagtggatcccccgggctgcaggaattcgtctcacccctagaaaaaagtacaacgcgcgactccatacaacaatacaaacaaagctgtaacgtactgtaaaagtaagatatggaggccgccggcggcggcggcgaggttcacaaggctagcaacgacaaggaggagcatttcgtgctcgtgcacggcgccggccacggcgcctggtgctggttcaagctggccgccgagcgaggtggcggcgatggacactgaccacagccctttcttctccgccccagagcgccctcttcgagctgatcatcaagtcattggggaatctctccattttttttacccccccccccgcgggggggcagaagggggggggccctnnntcccttcaccccttatgccccatgnccccactccatttaaagtctatccccttttcccttcgtcccccactgcaaattgtgcgctgccccgagcgcccccgcccagacgaagtcatccgcgcccgggcccccctcgcccgggcgggcccccccctcaatactgtcccccccctcccccagaggttgggctggtctgagtactattcttggcgccggccgggcctctttcttgttccgccc

SEQ ID NO: 67109 - DNA, 765 bp, Zea mays
  misc_feature: Ceres CLONE 1540890
  misc_feature: Encodes the peptide sequence at SEQ ID NO. 67110
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (380)..(380): n is a, c, t, g, unknown, or other
  misc_feature (762)..(762): n is a, c, t, g, unknown, or other
ggtgctgttnnnacnnnnaannacttagcaatatacccccaccaaaannnnnntnntggagctccccgcggtggcggccgctctagaactagtggatcccccgggctgcaggaattcgtctcacccctagaaaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcancaaacaggcggcggcggccaaaaagtgacgtacagtacgtgtggagtgtaatggagcttccatgcatgagtgaatccatgccaccacaccaaactagtcccttccttttcttgtatcttccatgtgacgcggcgtgtgcgtccccctcatgtgtggatgatgccagattaaatactaccaaataggacgtttgtttgtcaaaaaaaaaaaaaaaaaccaaggacggctcgaggttacccaattccgcccctataagtgaggtcgtatttaccgccgcgctcactgggccggcccgttttaacaacctccgttgaatggggaaaaaaccccctgggcgttttcaccaaactttaaatcccccctttggcagcgaaattttggnctt

SEQ ID NO: 67110 - protein, 63 aa, Zea mays
  misc_feature: Ceres CLONE 1540890
  misc_feature (55)..(55): Xaa is any aa, unknown, or other
MASLKAAKPSGVAAQGKEPAPKLSETATKPSAAKSGGVKKAEQKPRETKRKVKSXKQAAAAKK

SEQ ID NO: 67111 - DNA, 797 bp, Zea mays
  misc_feature: Ceres CLONE 1540891
  misc_feature (70)..(70): n is a, c, t, g, unknown, or other
ccccccccctcccccgattccttcttccgccggttttgtttccccccccgcctaatacccccccctattnaaattttttaaactcaacgtggtggcggccgctctagaactagtggatccccccgggctgcagggaatttcgtctcacccctagaaaatcctccctttcttacagccgccgccgccgcatcccagcctccaatcaccgttttccgtctcgttggcaatgggtaaggggcccggaatcgttggccccccccgggaagggtccccggggcaaacccccaagggggggaaaccgggacaaaaaaaaaaaacccccccggccccccccccccaaaaggaggaaaaataaaccccccttttttttcccccccgctttatgggttttataaaaaaaaacgggggccccacctccttcaaaaaaaaaagagcccccccccgcccctcaacaagggtttcccacccccttgggggccctcccagaaattaaaaaacctctggtggggagaaaaccccccccctcttttctgtgtaagtgggaaggaaaacaccccccccaaaaatgcgtgtgtgtctggcaacccgggttaggctcccagcagtggggcccccatccagccgtacttaaaaataaaaatgaaacccacccccccccccccagaagaaaaaagtttttttgtttatattaaaaaaaaaaaaaaacccgccctgccccgggggagttcacgttatccccccctcccgcttggggatattatcgtataatcgcactcccccgatgtttcgcccttata

SEQ ID NO: 67112 - DNA, 529 bp, Zea mays
  misc_feature: Ceres CLONE 1540896
  misc_feature: SWISSPROT Homolog: EC 4.1.1.39 Ribulose-bisphosphate carboxylase
gcggggcggccgctctagactgtggatccccgggctgcggattcgtctccccctagaaaaaaaagttagaggggacgcgaataactttggttttgttgatttattgcgcgatgattttattgaaaaagatcgtttctcgcggtatcctttttccactcgggactggggtatccccgggccagggggttatcccggggggcttctggggggattcctggttgggatacccccctctaaccaaaacctttggggaagatccccttatccaatttggggggggaaactttttgggacaccccctgggggaaaaaacccccgtggggaccccccacaaaaccgggggggttttttaaacccccgcggttcccaaacttctttaaaaagaggggggggcaatttttttttcttggggggggggggccccccttggttcaacccccttttttaaaaaggggggggggaaaaaacccccccccccccgcttgtggaacataggggggggggggcccgctcttttttttttggtgtc

SEQ ID NO: 67113 - DNA, 750 bp, Zea mays
  misc_feature: Ceres CLONE 1540898
  misc_feature: Encodes the peptide sequence at SEQ ID NO. 67114
  misc_feature (162)..(162): n is a, c, t, g, unknown, or other
  misc_feature (227)..(227): n is a, c, t, g, unknown, or other
  misc_feature (260)..(260): n is a, c, t, g, unknown, or other
cccccgggctgcaggaattcgtctcacccctagaaaaaatcctccttcgcctgctcgctagtcgctagccgctccccccaacaaacaaccctaatccgtgaccgtggacacgccgcaagctccatcgcgcgaatagattggggggattcaatacaggctacncggggattggtcgcgctcgagatctcagcaccctcgcgcctgaaatctttctattgttgtcgtgnttcaggtgatgagatcttggggagcgcgaatcnctcggtcctgagatgctggcggggtacggttggtggtggctgcagcgtcgttctctcctcccaccaggacctccctcgtgcggccgctgcaggccaaaccttcccccacccggtgacacgggggtttctcctcctccggttacccggcgccccctccctgcaaaccaggggaccgtcgaggctccctgcggctttccttcgcccccccatcaaccggggttcccctggagttacggtccgcactggccaccgggtcctggcccctggttgccaaaaaaggcaacagtttttcatttgcttccactgcgggctttagttcttaaggcgaaaatggagctcggggggttggccaaggctcccctacaaccggagaaaaagagcccttttctgggtgagaacacccggcccctccgtttttgccgcccctggggggctccctggggcattgcctgccgcccgcccaaagagtgtcctttccgaggcatagggg

SEQ ID NO: 67114 - protein, 53 aa, Zea mays
  misc_feature: Ceres CLONE 1540898
MELGGLAKAPLQPEKKSPFLGENTRPLRFCRPWGAPWGIACRPPKECPFRGIG

SEQ ID NO: 67115 - DNA, 646 bp, Zea mays
  misc_feature: Ceres CLONE 1540900
  misc_feature: Encodes the peptide sequence at SEQ ID NO. 67116
  misc_feature (391)..(391): n is a, c, t, g, unknown, or other
  misc_feature (394)..(394): n is a, c, t, g, unknown, or other
  misc_feature (419)..(419): n is a, c, t, g, unknown, or other
  misc_feature (420)..(420): n is a, c, t, g, unknown, or other
ctccccgcggtggcggccgctctagaactagtggatcccccgggctgcaggaattcgtctcacccctagaaaaaacacaccgtcttcctctgttttgccagggccaacgccattactagaagtctagaagagaggtggagaggcagagacgagaggcgtagggaattcggggggagagagagagaggcagggcggtgacgagcttggactggcgatcgcgggagcgatgacgacggcggccggcatgccggggtcgccggtgggctcggccgcggcggctggcggtcccgcggcgcccgaggtggcggccatggacgcggtgatcgggtggttccgcggcgagttcgcggccgcgaacgcgatgatcgacgcgctgtgcggccactgcgcnatnggcgggggggcggcgggggcgaatnngaccccgtcttcgcggggcttcaccgccggcggggcaagtggttccccgtcctcccattgcagaattctacccccgcacgggacgttcaacgccaagttgcgccgggttcggggctccccgggccgccccgggggccctgctgcttcccgggaggaggagggccgcgcccccgggggttccccgaccccctgggaaaaccccccccctttggagggggaaacccga

SEQ ID NO: 67116 - protein, 140 aa, Zea mays
  misc_feature: Ceres CLONE 1540900
  misc_feature (56)..(56): Xaa is any aa, unknown, or other
  misc_feature (65)..(65): Xaa is any aa, unknown, or other
MTTAAGMPGSPVGSAAAAGGPAAPEVAAMDAVIGWFRGEFAAANAMIDALCGHCAXGGGAAGANXTPSSRGFTAGGASGSPSSHCRILPPHGTFNAKLRRVRGSPGRPGGPAASREEEGRAPGGSPTPWENPPPLEGETR

SEQ ID NO: 67117 - DNA, 663 bp, Zea mays
  misc_feature: Ceres CLONE 1540901
  misc_feature: SWISSPROT Homolog: EC 4.1.1.31 Phosphoenolpyruvate carboxylase
  misc_feature (483)..(483): n is a, c, t, g, unknown, or other
agctcaccgcggtggcggccgctctagactagtggatcccccgggctgcaggaattcgtctcacccctagaaaaagaagcggataagggaccccaatttcaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctccccccttcactcttgttgtcaagtccaagtggaaaatcttggcatattatacatattgtaataataaacatcgtacaatctgcatgctngttttgtaataattaattaatatccccagcccattggatggacttgttttaccatgggtgttactttcagcaaaaaaaaaaaaaaataaacgagaccgctcgaaggtaacccaatttcgcccctaatagtgaagttgtaattaacgcgccgctcacctgggccgccgttttttccaaccg

SEQ ID NO: 67118 - DNA, 667 bp, Zea mays
  misc_feature: Ceres CLONE 1540903
  misc_feature: Encodes the peptide sequence at SEQ ID NO. 67119
ctccccgcggtggcggccgctctagaactagtggatcccccgggctgcaggaattcgtctcacccctagaaaaaggtctgttgctcgcgcttcgtccagcttccccggaagaggtagcacggcaagggcagaggatgagtgaccccaagtacgcctacccctaccccgcgcaaggttactaccaggggccgtaccagggcccgccggtgatggcgccgccgcagtacgccgcgccgccgcccagaagggagccgagcttcctggaaggctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattccctgcacccttcagctcgagatgatctgtatctcggtcgagttggtgtgtatctgtcatggtattgcttctaatttgctgctgaatcgagaacatattcgccgttgagttcaaaaaaaaaaaaaaaacgagacgctcgaggtacccaattcgccctatagtgagtcgtattacgcgcgctcactggccgtcgttttacaacgtcgtgactgggaaaaccccttgcgttaccccacttattcgccttgcaccacat

SEQ ID NO: 67119 - protein, 69 aa, Zea mays
  misc_feature: Ceres CLONE 1540903
MSDPKYAYPYPAQGYYQGPYQGPPVMAPPQYAAPPPRREPSFLEGCLAALCCCCLIDECCCDPSIIFVS

SEQ ID NO: 67120 - DNA, 640 bp, Zea mays
  misc_feature: Ceres CLONE 1540904
  misc_feature: Encodes the peptide sequence at SEQ ID NO. 67121
ctccccgcggtggcggccgctctagaactagtggatcccccgggctgcaggaattcgtctcacccctagaaaaaaccccaccaccacctcctctcctctgcccctaacccgtccgttccggctcatccgccattttttccctgtcgcggtaagcgatagggttcggcgtccgtcttctaaatccgcccttcttcgtttcgatttttccggcgttctgggagcaagcttcggcttcatcgacggcgttcttggtcttttgcggctcgacatgtctccgttccagggatacagaggcgatgcggttctctccggcgtccggtcgcggaagcgcgtgttcgcgacggcggccgcggagcccgtgacggcggcgcccaagaggcagaagcgcggggatgagatgcccctggacgcgctgccggacgagtgcctcttcgaggtcctgcgccgcgtgcagggcacccgcgcgcgctgcgcgtcggcctgcgtctcccgccgctggctcgcgctcctcgccggcatccgcgcctctgaggccgtgctggccccggccgcccccgccgtgccggacctcaaccaggagtacctcagcgaggacgacgaagccgatctgatggacctggacggcgacgcccgcgagaga

SEQ ID NO: 67121 - protein, 124 aa, Zea mays
  misc_feature: Ceres CLONE 1540904
MSPFQGYRGDAVLSGVRSRKRVFATAAAEPVTAAPKRQKRGDEMPLDALPDECLFEVLRRVQGTRARCASACVSRRWLALLAGIRASEAVLAPAAPAVPDLNQEYLSEDDEADLMDLDGDARER

SEQ ID NO: 67122 - DNA, 706 bp, Zea mays
  misc_feature: Ceres CLONE 1540906
  misc_feature (288)..(288): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (308)..(308): n is a, c, t, g, unknown, or other
  misc_feature (309)..(309): n is a, c, t, g, unknown, or other
  misc_feature (313)..(313): n is a, c, t, g, unknown, or other
  misc_feature (315)..(315): n is a, c, t, g, unknown, or other
  misc_feature (323)..(323): n is a, c, t, g, unknown, or other
  misc_feature (367)..(367): n is a, c, t, g, unknown, or other
  misc_feature (415)..(415): n is a, c, t, g, unknown, or other
ttggtggcggccgctctataactagtggatcccccgggctgcaggaattcgtctcacccctagaaaaatttacctggtaggcattctagtagtagtagtagataatgttaccagctgatgctgatgtcgattattgttttctttcgttcattcgttggttgtcagtcccgctgtggattttgctttatgtatatatatatactgctctacttcattcgtaccagcactctgctctgctgtatacactttgtttgctctcagtttttattactactgtagacaaatttnctnnnngnnnnnnnnnnggnnagancnatacaatngagaaaacgagataaagtaattttttttaaaagaagaggggaanaaaaagaaaaaaaaaaaaaatataggtgaggggacccccccctgtganaacccgaaaggccccaggggaccacaaattcccccaaaaggagggtttaaattccggggcccacagtgggcccggtttatttaaaacccctctgacttggaaaaaaccccgggggggccccccaaaattaaaaccccttgggaaaaaaacccccccttttccccccggtggggggataaaaaatcaaaaaagggccccccccccgattccccttattcccaaaaatttgcgcccccctctgtagggtggcacaagaaaaataattcaacccccctaatattttttgttata

SEQ ID NO: 67123 - DNA, 634 bp, Zea mays
  misc_feature: Ceres CLONE 1540920
  misc_feature: Encodes the peptide sequence at SEQ ID NO. 67124
  misc_feature (570)..(570): n is a, c, t, g, unknown, or other
ctccccgcggtggcggccgctctagaactagtggatcccccgggctgcaggaattcgtctcacccctagaaaaaaagagttaaacactcccttccctgctccgatggtgtatctcccacgccacaccccactatacaatctcaaccggaatctcctgcagccggatccaggctcctccagtccaatggcgccgaccacttgctcgcctcattctgatccttctcgctgccgccgtcccactcttggatgatcccgcggcggccgccgcggcggtgtttccaaatgaagacacttcagaccaagttggggtacctccccatcccggccgtgaacgcctctctcttcttcgccttctacgaggccacggatccgctcacgccggcggtctccacgccgctcctcctctggatgcagggcgggccggggtgctccagcctcatgtgcaacttcttctagctcagctcctacttcgtgaacccctactgcgagacactctcgtgcaaccccttcgcgtggaactgccgcttcggtctgctcttcatgctacagaccgctcggcactggctttancgcggcgaccatcacggcatgaatggccagcaaccagtccgtcatacccgggtaatactgggcc

SEQ ID NO: 67124 - protein, 69 aa, Zea mays
  misc_feature: Ceres CLONE 1540920
  misc_feature: SWISSPROT Homolog: EC 3.4.16.5 Carboxypeptidase C
MIPRRPPRRCFQMKTLQTKLGYLPIPAVNASLFFAFYEATDPLTPAVSTPLLLWMQGGPGCSSLMCNFF

SEQ ID NO: 67125 - DNA, 714 bp, Zea mays
  misc_feature: Ceres CLONE 1540925
  misc_feature: Translation starting site: 165
  misc_feature (485)..(485): n is a, c, t, g, unknown, or other
aaaactggagctcaccgcggtggcggccgctctagaatagtggaacccccgggctgcaggaattcgtctcacccctagaaaaagaggacctaacccaagacggtaggtaagtgccagcttaaagtctatctaaaggcggaccaccactgtccacctgggcggcgatggcgaccgccgcgagggaaaagcgcctgccgccggcgctgcccctggcgactctcatcggccgggagctccgcgcggggggctccgagcgcccggccctgcgctacggccaccccggctttgccaagcgtggcgaggactacttcctcgtcaagcccgactgcctccgcgtccccggggaccccgcatccgcgttctccgtctttgccgtgttcgacggccacaacggcgtgtcggcggcggtctacagcaaggagcatctgctcgagcacgtcatgagcgcgctgtcgccggacatcggcccgcgagactggctgcangcgctgccgcgcgcgctcgtcgccggcttcgtcaaggccacatcgatttccacgccaagggggaagtgtcccgaacccacgcaacactggtggtcatcaatgggtccacgtcacgggtggctcccgtgggggaccccccctgcatccgggacacccgtgccgccaaattccacctccataccttggacccccccctggagaaatacccaaaaaaccgggacccctcccc

SEQ ID NO: 67126 - DNA, 619 bp, Zea mays
  misc_feature: Ceres CLONE 1540931
  misc_feature (619)..(619): n is a, c, t, g, unknown, or other
tccccgcggtggcggccgctctagaactagtggatcccccgggctgcaggaattcgtctcacccctagaaaagtgttaggtggcagccaatatgtatcttgattaattgagaacttgtaatctgtgtcatatgtacgcgtgtcactgtcagtgacaatgaaaagcaaatgtaatatctattttatatggccgtgaaattcaggaaagagactagtttatcagaaagtgggtttttctgatttgatggagatgtttatttaaaacccccccttctttttttacctcagtttgtggcccccaaaaaaaaaaaaaaaccaaacccctcgaggtcccccatttccccctaaagggagccgttttcccccccctcccgggccccttttttcaaacgtgggaggggggcaaaaccccggggggtcccccaatataacccccttagggaaaaaccccccttttttcccaggggggggtaaaattaaaaaaaaagaccccccccccgaggacccctttttcccacaaatttttccccccccttttttgggggggggaggaggaaaatttttgaccgccccccccttttttttgtccgaaaaaacccccccccctattacatcttttn

SEQ ID NO: 67127 - DNA, 531 bp, Zea mays
  misc_feature: Ceres CLONE 1540932
ctccccgcggtggcggccgctctagaactagtggatcccccgggctgcaggaattcgtctcacccctagaaaaaatgaatgacaagcgtggtaataaaagctttgtagttgcgtgcgcacagtgtattccttggtgtactggcgctggcggtaagccggtaaccacttattaccagggatccttgtaatttttcctgttggtttcccaataatgatgtgaatatattgatcacatgcatggtgtttccaaggatttttatggctaagataacaagaacaacgagacgctcaaggaaccaatttcgccctatactgagtcctatgacgcacgctcactgaccgtcgtttgacaacgtcatgactgaacaaacctgccagtaacccaacttaagcgccttgcagcacatctcaccttgctactgcgtggcggtatagaccaagaaaggcccgaaaccgaatacgcccattcccaacaaggttgcctcagccctgaaattggcaaaaatggcaaaattggttaaaccagtaaaa

SEQ ID NO: 67128 - DNA, 736 bp, Zea mays
  misc_feature: Ceres CLONE 1540937
  misc_feature: Encodes the peptide sequence at SEQ ID NO. 67129
  misc_feature (496)..(496): n is a, c, t, g, unknown, or other
tggagctcaccgcggtggcggccgctctagaactagtggatcccccgggctgcaggaattcgtctcacccctagaaaaaagttccgttctgttggtgagcctatgccgggggctaacgttggcatgccagggcaaatgccacattttccacaacctgggcagcacatgcctcactcaaatcaagttccacctgtatcacaaggggttcccatggtatatcagccagctagaccaatgtcatcagcacctatgcaaccacagcaacaagctgcgtatgctgggggccatttgctcaccatgggtgctcctatgcaacccctgacctatacatatcaaccaacatcgatccctcctgtagtgcaaccctggagtacaggccccaggacagagtgtaactcatgtgcctcctctagtgcagtctgggcaccagcatgtgtcagctccaacgactatgcctactgtcaactagtctgaacctagctcttcagattggcangaacacactgctaccggagggaaaaaagtacttcttttatttaggggacaaagcaatcaagttggggaaaaaccagttgaaattgatgacaccttttggaaagggcgaatgcctaacctgattggaaagatttcctacccccaagggccggaaggatttttcaacaaggtgaccaaacaacaaaagggatttttcccgaaaaataaaaggtcccaccgaaattggaaaaaaaggtctcaa

SEQ ID NO: 67129 - protein, 123 aa, Zea mays
  misc_feature: Ceres CLONE 1540937
MPGANVGMPGQMPHFPQPGQHMPHSNQVPPVSQGVPMVYQPARPMSSAPMQPQQQAAYAGGHLLTMGAPMQPLTYTYQPTSIPPVVQPWSTGPRTECNSCASSSAVWAPACVSSNDYAYCQLV

SEQ ID NO: 67130 - DNA, 888 bp, Zea mays
  misc_feature: Ceres CLONE 1540945
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (37)..(37): n is a, c, t, g, unknown, or other
tttgttggttnnntnnatatnatacttcccgccagcnaagccttaattatattttatttcacgtgttgcggccgctctagtatactggatcccccgggctgcaggaattcatctcccccctagaaaaaaagaaggcgaagatggggcaaaagagtgaatacagtccatcatagaaagctgctgaagcatgaaagtttctgccttttttaagtgtgattgagctgagatgtttctcagtccatgactccccgctgcttccgattaatgccttctgattgctaggctaggcgaggtaccccctgttagttcccaatttctggttctgcagtttgttccttaccctctgttggagatggtgtcaaccaatttccataccaacttgggcagcccacctcacatctcctagttggtattgtggtatatccccttgtggcaaaaagatccccccgcatcgctactatttttgttagttttggtcccgccacctcccacccggccgccttatatccctaccaacccactataattatgatgatcacctcctcttgtcgttttccctatttccttccctctatttccttctgatctccgtctatttagccatgtagtaatacgattcggcccacgtcctgagcctcaccaccaccactactctaccctcccaaaaaaaacctcctggggccggattcccgcaaaccttactaccctccgcccttgtcccgcactctctcctccacctctccccccacacctcctcacctccaccactagtataattactctttccctatcctttctatctcttcccctcttaccccactcaccctggggttccctcttcttatgtttcttttacaattagcgttatttgtctctttcctctcttcc

SEQ ID NO: 67131 - DNA, 693 bp, Zea mays
  misc_feature: Ceres CLONE 1540947
ctggagctccccgcggtggcggccgctctagaactagtggatcccccgggctgcaggaattcgtctcacccctagaaaaaagcccgggcggagcggccgtcggtgcagatcttggtggtagtagcaaatattcaaatgagaactttgaaggccgaagaggagaaaggttccatgtgaacggcacttgcacatgggtaagccgatcctaagggacgggggaaacccggcagatagcgcgatcacgcgcgtcacccgaaagggaatcgggttaagatttcccgagccgggacgtggcggcagacggcgacgttaggaagtccggagacgccggcgggggcctcgggaagagttatcttttctgcttaacggcccgccaaccctggaatcggttcagccggaggtagggtccagcggccggaagagcaccgcacatcgcgcggtgtccggtgcgcccccggcggcccttgaagatccggacgaccgaattccgtccacgcccggtcgtactcataaccgcatcatgtctcccaagtgaacagcctctggtcaatggacaatgtatgcaagggagtcggcaaaacgggatcgtaacttcgggaaaaggattggcctctaagggttggggctcggggggtaccaggccccaaacccgtcgggctgcttggcggtaatgctcaaactggtccccgcggg

SEQ ID NO: 67132 - DNA, 646 bp, Zea mays
  misc_feature: Ceres CLONE 1540949
  misc_feature: SWISSPROT Homolog: EC 3.2.1.23 Beta-galactosidase
agctcaccgcggtggcggccgctctagaactagtggatcccccgggctgcaggaattcgtctcacccctagaaaaacatgaattaaatgttttttgaggggtttatcaaagagcagactgtctaagcttccccattatagaaggtttgagggagtaccactgtcagataacgataaactggagatgttacagcagaggtgtgaaagcgatagtagctagtaagaatccgatttttttctattcacatgattacattacaactactacatcaaattattaacggtaaaggaatcattggtaagtgattacaatgcaacttcatccttgtcttctcaagaaaaaaaaaaaaaaaaacgagacgctcgaggtacccaattcgccctatagtgagtcgtattacgcgcgcccactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttacccaataggccgaa

SEQ ID NO: 67133 - DNA, 719 bp, Zea mays
  misc_feature: Ceres CLONE 1540952
  misc_feature: Encodes the peptide sequence at SEQ ID NO. 67134
  misc_feature (415)..(415): n is a, c, t, g, unknown, or other
ctggagctcaccgcggtggcggccgctctagaactagtggatcccccgggctgcaggaattcgtctcacccctagaaaaacgagaagaattctggcttatggtattggtctgcactagaatggcttggtacatcgtctatggacaaaacacgctattcgattaattgttgttaattaagccttgggggggtacgagtgctattcatgtaaatggtttggtgcatcgtgtgctgctgctgcctgctgctgttactacgattgagctcccctataatactatgatttgaagagagatggcgatgtcatatgatcccttggaatcgggctttactgcctaaaaataaaaaaaaaaaaaaaacgagacgctcgaggtacccaattcgccctatagtgagtcgtattacgcccccccacntgccgtccttttacaacgtcgtgacttggaaaaccctggcgttacccacttaattcgcctggcagaaatccccccttttccccagctggggtaaatacccaaaaagccccccccgattcccccttccccaaaatttcccccacccttaagggggaaatggaaattttttaacccttaaaatttttttttaaaaattccccgttaaaatttttttgtaaacccgccctctttttttttaaccacaaaaggcccaaatactgggaaaacttcctttttaaattccaaaaaaaaaaaccccgggtgt

SEQ ID NO: 67134 - protein, 53 aa, Zea mays
  misc_feature: Ceres CLONE 1540952
  misc_feature (37)..(37): Xaa is any aa, unknown, or other
MIPWNRALLPKNKKKKKTRRSRYPIRPIVSRITPPHXPSFYNVVTWKTLALPT

SEQ ID NO: 67135 - DNA, 718 bp, Zea mays
  misc_feature: Ceres CLONE 1540954
ggagctccccgcggtggcggccgctctagaactagtggatcccccgggctgcaggaattcgtctcacccctagaaaaaaccgtctcttcctcctcaagaaccgttcaccagagtaaataacaagagggagagatccgccgtagtccaccatcctccacgccgttggctggccgccatggggaatcagaattcggtcgttgtgggggtgcctcacctccactctattctcgcggtgaggacacgtgtcatctgaagatcatcctggtacctgaaatctcaagtcccaggtcaagaccaggtactgcacgatgatgctcatggaagatgctgctatgagttcatgagtggtctaggtcgtcgtctcccagtcaactttgggttgttggaccgttgtcttcttcacccggcaattgttttatttagttttagaacctccctggtttatataaaagatttgaacattcggattccaaaaaaaaaaaaaaaaacgaggaggtttcgagggtaccccatttctcccctcatctggaggccgtattttcttccccgttccctggcccgatgcttttttcctactttcgggaaattgggaaaaacctttggccggtcccccaacttttattccgccctggaaggtaatattccccccttttttggccggttggttgctaattaactgacaaaaggccccctctccccgattcgcccccttgttcca

SEQ ID NO: 67136 - DNA, 717 bp, Zea mays
  misc_feature: Ceres CLONE 1540964
  misc_feature: Pfam Name: PTS_2-RNA Pfam Description: RNA 2'-phosphotransferase, Tpt1 / KptA family
  misc_feature (571)..(571): n is a, c, t, g, unknown, or other
  misc_feature (572)..(572): n is a, c, t, g, unknown, or other
  misc_feature (632)..(632): n is a, c, t, g, unknown, or other
aaagctggagtcaccgcggtggcggccgctctagaatagtggaacccccgggctgcaggaattcgtctcacccctagaaaaaccgcacacgcatcgagcggctccgtctcatgagagccgtcgctgctgccgcctcgcccccgctccgcgccctcctcctcctctcccgccacccacgccgcgcaggcttcaccaactggccgtcgctgcctaggggccagaacgcaggacccacagccccgccggccgccaccgcccccaagcctgctgcgccgtccaggaggcaaggccgcggcctcactgccagcctgcctcgccaagtcgcccggatctcgacgccccacctgcggccgccggcgaccccgccaaggtgccctgacagacgccatcagagccacggagttcgtgcgctggctggttgtccgcggaagacggtccgccacctccctgctccaacctcgcacctccggttcaccatgaacccttcgtcctcctcctcctcctctggcgggtaccactccagggccgctgccttcgcttccccgcagccacgcggcggtggcggcagacnngcgtggtgggcggccgcgtccaagacgggagcgaccgcatcgacgcccttggccgcctgnctgacgagggtgttgcgccacatggcggcggagctgcgcctagatatgaggaccgatggatacgtgcgcgtccgcgacctgctga

SEQ ID NO: 67137 - DNA, 715 bp, Zea mays
  misc_feature: Ceres CLONE 1540968
  misc_feature: Encodes the peptide sequence at SEQ ID NO. 67138
aagctggagctccccgcggtggcggccgctctagaactagtggatcccccgggctgcaggaattcgtctcacccctagaaaaattcccacactcctagtccttccccccatctccagtcgagtgctctctccagtccccacgcccgatctcgcccccatcccatggacgccgatgagatggacgtcgactccccatcctcggcctcccccgcgcccgcctccggctccctccccaccgtcctctctgagctcgccgccctccaccgccgcgcgtcttcctcctccgtcacctccccgcccttgtccctgccctccatcacattcctctcctccagccccgcagccgtcgcgtccatcttccctcgcctcgccgaggccggcgtccccgcatcctccttgctgcccccgctcgaggcctcgctctccgcgcacccgctccccgcagccgtcgcctacctccgcctcctcctcgccccggcctccccgcttctcaccctcttctccccgcttccattcctctccctcctcctcgtcatccgcaaggccgccaacccccgcaagcgcaagaaccagcgccagaagccagcagcggctccgcgggcggcgccgtcgctgctcccgaaggcgctctccctgctcgcggacgccgcggggaggctgccgctcggagcccacccggacgcgcgggcgtcgcttgtcgataccgcgcggagcc

SEQ ID NO: 67138 - protein, 184 aa, Zea mays
  misc_feature: Ceres CLONE 1540968
MDADEMDVDSPSSASPAPASGSLPTVLSELAALHRRASSSSVTSPPLSLPSITFLSSSPAAVASIFPRLAEAGVPASSLLPPLEASLSAHPLPAAVAYLRLLLAPASPLLTLFSPLPFLSLLLVIRKAANPRKRKNQRQKPAAAPRAAPSLLPKALSLLADAAGRLPLGAHPDARASLVDTARS

SEQ ID NO: 67139 - DNA, 742 bp, Zea mays
  misc_feature: Ceres CLONE 1540969
  misc_feature: Translation starting site: 263
  misc_feature: SWISSPROT Homolog: EC 2.4.2.11 Nicotinate phosphoribosyltransferase
  misc_feature (367)..(367): n is a, c, t, g, unknown, or other
  misc_feature (448)..(448): n is a, c, t, g, unknown, or other
  misc_feature (457)..(457): n is a, c, t, g, unknown, or other
  misc_feature (507)..(507): n is a, c, t, g, unknown, or other
  misc_feature (528)..(528): n is a, c, t, g, unknown, or other
ctggagctcaccgcggtggcggccgctctagaactagtggatcccccgggctgcaggaattcgtctcacccctagaaaaaaattccattctggtcccttccttgccttctccgcctccgcatccatccggtctccagttgtctcctcccgcctccttccggtcccctcccggcgcagcctctcccgccccctccagccaagcggaccctaggcggagccaccttccacgcttcccgaagctcgcccgtgaggggaggccaggatggcagcgacgtcggcgccgcccgcgagcgcccacgccaacggcaacggctccctcgtgggggtggcggcgccggtgggagcgcccacccaacccatggcgacngctctgctcaccgaccagtaccagttctccatggcctacgcgtactggaaggccgggaagcacgccgaccgtgccgtgttngacctgtancttaggaaaaatcatttggtggggaattcactgtttttgctggccttgangagtgcatcaaatttaatgcngattttaagttcccagaactgaaatttcctttcctgcattcagtcatgccaagggggaagggggcgttcctcattacccccgggaattttaacgccctcaattaaagggttccccccttccggggggaacagagattttttccaaaggggcctttaaaaaaatttaaggggcccatttcctggggttcaattctggaaaaccccttttgaaaat

SEQ ID NO: 67140 - DNA, 661 bp, Zea mays
  misc_feature: Ceres CLONE 1540970
  misc_feature: Encodes the peptide sequence at SEQ ID NO. 67141
  misc_feature (535)..(535): n is a, c, t, g, unknown, or other
  misc_feature (598)..(598): n is a, c, t, g, unknown, or other
  misc_feature (601)..(601): n is a, c, t, g, unknown, or other
  misc_feature (623)..(623): n is a, c, t, g, unknown, or other
ggagctccccgcggtggcggccgctctagaactagtggatcccccgggctgcaggaattcgtctcacccctagaaaaatcctcccttcgtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcngggtgggcgtggcgcccgaagtggggcaggggtcgtcgtcggcgaccacaatgctcagcaggnggngcagctccctccgccgcccgcngtttgcgcggtggtccttgcaacgaggcgcccgccgtc

SEQ ID NO: 67141 - protein, 83 aa, Zea mays
  misc_feature: Ceres CLONE 1540970
  misc_feature (42)..(42): Xaa is any aa, unknown, or other
  misc_feature (63)..(63): Xaa is any aa, unknown, or other
  misc_feature (64)..(64): Xaa is any aa, unknown, or other
  misc_feature (71)..(71): Xaa is any aa, unknown, or other
MSALLDLLMGIFRQQTLGGAALELAALAAPLWLAALVGLLIXVGVAPEVGQGSSSATTMLSRXXSSLRRPXFARWSLQRGARR

SEQ ID NO: 67142 - DNA, 607 bp, Zea mays
  misc_feature: Ceres CLONE 1540971
  misc_feature: Translation starting site: 153
  misc_feature: SWISSPROT Homolog: EC 2.7.11.1 Non-specific serine/threonine protein kinase
ctggagctccccgcggtggcggccgctctagaactagtggatcccccgggctgcaggaattcgtctcacccctagaaaaaaaattacccacacacccagcagccagcaccgatcgagtcatccttaattaccgtaataatacgaaggcggccatgattgttgttgcagtagtactggcgctgctactgctgttctatggggcgggacacgccgactgcgcaacggcgaccatcccccagaacagcagcagcacggccgacatgctctccctgctcgacttgagaaaggaaatcagcagtgatccaggaggtttcctcacatcctggaacactaattataacagtagcgccggcgccgccgactactgcggctggaatggcgtcacatgcagcagaaagccccagggcgggtcattgaactcaacctcagcagccaaagcttgcaaggcctaatctctccatctctcggtaaccctacccttcctagaatactggacctgtccctcaacatgctagctgggccaataccgcctaatatcggttccctctttcaccttaaaattctcgaccttgattctaacaacttcactggagccatcccgtccagc

SEQ ID NO: 67143 - DNA, 654 bp, Zea mays
  misc_feature: Ceres CLONE 1540978
ctggagctccccgcggtggcggccgctctagaactagtggatcccccgggctgcaggaattcgtctcacccctagaaaaaggccatttccttgagccgttccgccgccactcgaccaccaccaccacggtgccgccgacgccgaccacaaccactcgtagagactaccgtctccgcccccgctgcttctcgtctccacgcagccgtccgatggccaagcggctcgccggcgccaacaaagaggtaggggacggcatgccaacaaagcagcccacccggactcggcaggccgcctcgtttcgctaacccatttgatctgcgccgggtgctcgtcgaggtggtgaggttcacgcagaagagcggactgaggggctgtgacggtggctggaaggatttcctggcccggaacgacaggaagtttggagcgtcggtgagcgaccagaggaagcgctctagggacgtgttgttcgccttcctacagaccttccccaaggatttccagaagaaacacttgatgccactagtccgacgagagccactggaaggcaacacaggcattcctcagtccccaaagtgagctgctgggcagctgctcatcaccaaacacattctaacccccagcagtttcaggcgatgggcatacgaatcgccaaga

SEQ ID NO: 67144 - DNA, 689 bp, Zea mays
  misc_feature: Ceres CLONE 1540982
  misc_feature: Translation starting site: 174
  misc_feature: SWISSPROT Homolog: EC 2.5.1.18 Glutathione transferase
agctccccgcggtggcggccgctctagaactagtggatcccccgggctgcaggaattcgtctcacccctagaaaaaacttgcgtagagagttgggcgcagagaatccccaggcaaacaaacagggtagagggagaggagaggagaggagaggagaggttgggtctggaacaccatggctccgatgaagctgtacggggcggtgttgtcgtggaacgtgacgaggtgcgcaacggcgctggaggaggccggctccgactactatatcgtgcccatcaacttctccaccgccgagcactagagccccgagcacctcgtccgcaacccgtttggtcaggttccagctctgcgggatggtgacttgtacctcttcggacgaactaagaaaagcacttgctgaacctgtggagtctctatttgatgatgcagaccctacaacctagcaatcgataagaaacgtttactaatgtgagacgaatggcatcctaccagagtttctgaataaccttgtcagtttgaaatgaatacgctccagcacaagaaatgtatccgaattaaggattatgcccggagtgttgtggaaattaggctaactagggatcctgcaaagttttgatcctgttgaggatagggtcccaacattgttactcttgacatggatcaatttcaggggcttgacggaaacgaaatt

SEQ ID NO: 67145 - DNA, 777 bp, Zea mays
  misc_feature: Ceres CLONE 1540983
  misc_feature (28)..(28): n is a, c, t, g, unknown, or other
  misc_feature (32)..(32): n is a, c, t, g, unknown, or other
agctcgccgccgtgagagatgctacagnaaangtggatcccccgggctgcaggaattcgtctcacccctagaaaaatggcttaagataaatgcggtgtgcccactctgcaaaacagagattgggggtgtggttcgatctttctttggcttgccatttggccgccgccgtgtcgaataggatagcggcaagaggtgtagctagctcaagattcagtgtatagaacaatgctgttttttccgcataaaaagctctgctctgttgcaatggtttgattgattgtcaaggaaagccgctgtgtgcattaattgaaaacaatgacccttggtgggagaacctgagcttggtaggggcaaattttctaagaaatgtaaccgcactgaaggttgcttctcatactcctgaataaccattttccctcctcccaggcatgtcaattaagggaacccccaaaggttctacttggcccaaaaaaaaaataaaaaaaaaacgaaaatgcttcaaggggcaccccaaattcctctcctaataagggaccccaaaattagcgcgccctctaacttggccccgccgtgttcacccaaattctctttaactgggagaacaacccccagcccgttacacccaaactttacatccgcctctgttcaaaatcaaattccctcttttactgccgcgggttgggccgcaaaaaattccaaaaaaagtgcccccccccccagatccccttatatttcccattaaattgcccctcaccccccttaattcagcgtataagt

SEQ ID NO: 67146 - DNA, 654 bp, Zea mays
  misc_feature: Ceres CLONE 1540990
  misc_feature: Encodes the peptide sequence at SEQ ID NO. 67147
  misc_feature (371)..(371): n is a, c, t, g, unknown, or other
  misc_feature (623)..(623): n is a, c, t, g, unknown, or other
ggggctccccgcggtggcggccgctctagaactagtggatcccccgggctgcaggaattcgtctcacccctagaaaaaactagagcggcgttgtctctgttggtctcattccgacgcacgcactcggctaggcgcagaggcttttcctcccccaagccgaaacaccagagggcgagactcgagagagaagagcggcgcggcggaggacagcactggatggagccctcgccggcggcgggagagcttggcgcgatgcttcgtgcggccgctgacttcgcgtcctacccagggttgcatagtgatgatactgtgaggcagttcctggaacgatgtccgctgcctaagctcttaggtgcattgcagagtgaagnagatgtacctgggatgggttgaactgtcacagagtgtttagacaaaatattttcctcaagatatggagcgtcacttctgccaaactacggtgcatttattcaagctggattgctcacagactcgaagcaaatcagaaaattagcctgcaaagctgtactccatcttcttgcaaggctgaagatggtggtgctgctgtggaaacagttgtgcagcataatctgtatcctcttctgatcaaatgtttgattganggagatgaagaatttcagcatcattttggac

SEQ ID NO: 67147 - protein, 58 aa, Zea mays
  misc_feature: Ceres CLONE 1540990
  misc_feature (52)..(52): Xaa is any aa, unknown, or other
MEPSPAAGELGAMLRAAADFASYPGLHSDDTVRQFLERCPLPKLLGALQSEXDVPGMG

SEQ ID NO: 67148 - DNA, 818 bp, Zea mays
  misc_feature: Ceres CLONE 1540991-R
  misc_feature: SWISSPROT Homolog: EC 6.3.2.13 UDP-N-acetylmuramoyl-L-alanyl-D-glutamate--2,6-diaminopimelate ligase
gggaaccgctaacttcacaagatcttacaatcactgccaaaggacaaaatcttttgaaactgtgacccagaagctcctacattgtcgttttgactttttcacatcatggaaccttcatcgatctactttcacagctacacctcatttacgtgcatgaactaatacaacatttactgggccatctggttatctactaactagtatggcagtgtaactgaatagctgataagctagcaatttgttagccattagcacttgggttagaaaactcagcacgtaaggagtaattttcttgcaggacttggatatcatatcctcaaatcctaaaaaagcacacgttctttaaattgagagtctggtgttgctcttcaaatgataaactcgactatcttgcctaaatcaaaatcagtggctttctggtaaccgccaagggaactctgaggtgtctattccagctcggtgcaattgatccacgtattgtaatgcttctcggcactcttctctgtcatcaaaaaattcatttttatcggcttcaatctgataggcatcattccctttgccagtgataacgaccacatcgccttgttcaccaattgcaacatcagctcgaactgcaactcttctaatatcatgtaggaatagtctatgcccttttggaaggggtcgggtaataatcatttagcaccatatttaaagtatttctgcaagaggtccagggctacaccctgccaaacatatcattccaaggaaattctaaagggaaccttcattttagccgggaactgaacagaatgttccaacaggaacaaccatacgct

SEQ ID NO: 67149 - DNA, 604 bp, Zea mays
  misc_feature: Ceres CLONE 1540992
  misc_feature: Encodes the peptide sequence at SEQ ID NO. 67150
  misc_feature (410)..(410): n is a, c, t, g, unknown, or other
  misc_feature (451)..(451): n is a, c, t, g, unknown, or other
  misc_feature (506)..(506): n is a, c, t, g, unknown, or other
  misc_feature (514)..(514): n is a, c, t, g, unknown, or other
  misc_feature (515)..(515): n is a, c, t, g, unknown, or other
  misc_feature (522)..(522): n is a, c, t, g, unknown, or other
  misc_feature (549)..(549): n is a, c, t, g, unknown, or other
ctccccgcggtggcggccgctctagaactagtggatcccccgggctgcaggaattcgtctcacccctagaaaaatcgccttcctcgcccccatctctttctcgccgtgccactcccacctcttttcgctgataagcacgccgctactccccactccatccatccatccacccgccgcttttctctctgctttggagagggagccgcacgcagtggtttggtgccgctggtccgccagggtcctgggcgctgtgctcattccaccggtcggcggtgggcttttcaggcttcttcgacggtgtcgagagtggaggaaatgtcgacgacggagtgcgcggacctcgggggaggagttctggctgccggaggactttttggacgacgacttcttctccgaggaggagaaaggcngccgtggcagcccggagcgagagcgacgaggaagacagccntggcggggctctcgcgcccgctcggggggctcctcggcgacgggggagagcgcangggctccnngcgcaangcggaggtgacggttgggtccccgcantcaacgctgtgcgggctgccccagtcggggcaagaaagccccagcggggggcgtc

SEQ ID NO: 67150 - protein, 96 aa, Zea mays
  misc_feature: Ceres CLONE 1540992
  misc_feature (32)..(32): Xaa is any aa, unknown, or other
  misc_feature (46)..(46): Xaa is any aa, unknown, or other
  misc_feature (64)..(64): Xaa is any aa, unknown, or other
  misc_feature (67)..(67): Xaa is any aa, unknown, or other
  misc_feature (69)..(69): Xaa is any aa, unknown, or other
  misc_feature (78)..(78): Xaa is any aa, unknown, or other
MSTTECADLGGGVLAAGGLFGRRLLLRGGERXPWQPGARATRKTAXAGLSRPLGGLLGDGGERXGSXRXAEVTVGSPXSTLCGLPQSGQESPSGGR

SEQ ID NO: 67151 - DNA, 670 bp, Zea mays
  misc_feature: Ceres CLONE 1540995
  misc_feature: Translation starting site: 115
  misc_feature: SWISSPROT Homolog: EC 3.2.1.23 Beta-galactosidase
  misc_feature (475)..(475): n is a, c, t, g, unknown, or other
  misc_feature (566)..(566): n is a, c, t, g, unknown, or other
  misc_feature (592)..(592): n is a, c, t, g, unknown, or other
cccgcggtggcggcgctctagactagtggatccccgggctgcaggattcgtctcaccctagaaaattttgtactgtagaagcacatacccacatggagtgaggtgcaacgcgcgatggacaatatgtttgcaggtgaaagttctgtgaactgcccgggggcaagtgattttatcccactatctgtaatatgtgtgctgtttcccggttgaactattaagaaaaaataggaataagctgcaggatcggtcgtaatgcgtgtaattgtcgccacatttggcattaccttgctattgtaacatttgtaccatttgttgtatcattataactgagatatatacggtctcgtcaaatttgcttggtgacaaaaaaaaaaaaaaacgagacgctcgaggtacccaattcgccctatagtgagtcgtattacgcgcgctcactggccgtcgttttaacacgtcgtgactgggaaacccctgncgttccccaacttaatcgccttgcagcacatccccctttcgcagctggcgtaatagcgaagaggcccgcaccgatcgcccttccccacagntgcgcagccctgatggcgaatggaanttgtagcgttaatattttgtaaaattcgcgttaaattttggtaaatcagctcatttttttaacaataggcccgaatcg

SEQ ID NO: 67152 - DNA, 647 bp, Zea mays
  misc_feature: Ceres CLONE 1540999
tccccgcggtggcggccgctctagaactagtggatcccccgggctgcaggaattcgtctcacccctagaaaaaagaagcgaacccagccatcgtttccaagtacgcgcagagagagagagccacaagagttagagcgaaacatcagcgtatggatctaggggctcgagcaagcaagagaggagagatgcctgcgtcaatagatcatgtatgaggaagtgaggacacgagtcatctgaaaagcaagttggtacctagaatctcaagtcccaggtcaagaacaggtaccacaggacgaggcgcttgaaggatgctgtgcgagttcgtgagaggtctaggtcgtcgtctcccagtcaactttgggttgctggaccgttgtctccttataatgtaattacttaattattttgtatagaactcctgttataaagatgtgacattcgatccgaaaaaaaaaaaaaaaaacgagacgctcgaggtacccaattcgccctatagtgagtcgtattacgcgcgctcactgggcgtcgttatacaacgtcgtgactggaaaaacccctggcgtaacccactttattcggcttggcggcccatcccccttttccccagctggggttaatagccaaaaggcccccaccgattccccttt

SEQ ID NO: 67153 - DNA, 944 bp, Zea mays
  misc_feature: Ceres CLONE 1541000
  misc_feature: Encodes the peptide sequence at SEQ ID NO. 67154
  misc_feature (19)..(19): n is a, c, t, g, unknown, or other
  misc_feature (20)..(20): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (441)..(441): n is a, c, t, g, unknown, or other
  misc_feature (935)..(935): n is a, c, t, g, unknown, or other
ccagggccccgcgtgtttnnccccttccccccnnnnggcgaaannnnnccacccaagagctccccgcggtggcggccgctctagaactagtggatcccccgggctgcaggaattcgtctcacccctagaaaaaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggactgtccgaaccctcacggcctgatcaggaagtacgggctcatgtgctgcaggcagcgcttttccccgcccccggcgagggacgttggttttctccccgtttccgttgggagatggccaccgggcgccgcccccgcccggaatcttctttttttttcccccccccccccccntgcgggggggggggggggggggggcggtttccccccccattttttaccttatcggcgccccgtcaaaagcctccccccccccaccaaccctatcgggattcatcggtgtcaaaccctgggtaagttatgtggcccccgcgcggcagtagccgccccctcgtccgccgatggtaggcgcgccgctattcgccggcggcgcaggggcgtcgggcgcagatgtcccgcccccgccatgcgccacccgctcgctgtacatctctttgcgaactgcgcgcccaccgtgagtccccggcagactgcgatattgtacccgcgtatctcctctatggctgcgttctccaaagggcgatccgtttcctgtgccccgccccgcgcccgttgtctgggcgctgatataacgcgacgcgaataaaggtgggcctccaccgaccttgtcgcggtatcctactccgcgtttgtagctttcgcttgtgggcgcgcttcattttcgcggncgtatctgt

SEQ ID NO: 67154 - protein, 216 aa, Zea mays
  misc_feature: Ceres CLONE 1541000
  misc_feature (3)..(57): Pfam Name: Ribosomal_S14 Pfam Description: Ribosomal protein S14p/S29e
  misc_feature (80)..(80): Xaa is any aa, unknown, or other
MGHSNVWNSHPKNYGPGSRVCRDCPNPHGLIRKYGLMCCRQRFSPPPARDVGFLPVSVGRWPPGAAPARNLLFFSPPPPXAGGGGGGGGFPPHFLPYRRPVKSLPPPTNPIGIHRCQTLGKLCGPRAAVAAPSSADGRRAAIRRRRRGVGRRCPAPAMRHPLAVHLFANCAPTVSPRQTAILYPRISSMAAFSKGRSVSCAPPRARCLGADITRRE

SEQ ID NO: 67155 - DNA, 656 bp, Zea mays
  misc_feature: Ceres CLONE 1541010
  misc_feature: Translation starting site: 153
  misc_feature: SWISSPROT Homolog: EC 3.2.1.23 Beta-galactosidase
ctccccgcggtggcggccgctctagaactagtggatcccccgggctgcaggaattcgtctcacccctagaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccaaaaaaaaaaaaaaaacgagacgctcgaggtacccaattcgccctatagtgagtcgtattacgcgcgctcactggccgtcgttttacaacgtcgtgactgggaaaaccctggcgttacccaactaaatcgccttgcagc

SEQ ID NO: 67156 - DNA, 520 bp, Zea mays
  misc_feature: Ceres CLONE 1541013
  misc_feature (47)..(47): n is a, c, t, g, unknown, or other
  misc_feature (241)..(241): n is a, c, t, g, unknown, or other
  misc_feature (261)..(261): n is a, c, t, g, unknown, or other
  misc_feature (277)..(277): n is a, c, t, g, unknown, or other
  misc_feature (278)..(278): n is a, c, t, g, unknown, or other
  misc_feature (325)..(325): n is a, c, t, g, unknown, or other
  misc_feature (326)..(326): n is a, c, t, g, unknown, or other
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (375)..(375): n is a, c, t, g, unknown, or other
  misc_feature (376)..(376): n is a, c, t, g, unknown, or other
  misc_feature (404)..(404): n is a, c, t, g, unknown, or other
tggagctccccgcggtggcggccgctctagaactagtggatcccccngggctgcaggaattcgtctcacccctagaaaagcatccgtgattccgttcaccttcacggcttcaccagcctgcgctctctcctctcagcgcgacgactgggtgggcggggctaccgccgccgccgccgcccgacaccaggtgcccgaggttttcgtcgggtctcttcgccgggcgacgagctccaccagtggncagagaactggagcagtggnggactgccgctggagnngagacaggaaagagagatgacaagcaaaaggatcagggttgctggtnngacaaggcnacnnagagaagaagaccaaggcgccagtaagtggggatcnnaaaggcggtgaattgaggatgccccggntggtttgaaaaaggctgggcctgggttgaccgggagaaaaggaaaatccttaataccccgggaaaataaacggtggcaagatttttcacttcccaatcaaagtttccccaaaaggg

SEQ ID NO: 67157 - DNA, 862 bp, Zea mays
  misc_feature: Ceres CLONE 1541018
  misc_feature: Encodes the peptide sequence at SEQ ID NO. 67158
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (862)..(862): n is a, c, t, g, unknown, or other
tttgttcccgccttccctttcgttcctgcaccccccctnnntaaaaacaacaacctggagctccccgcggtggcggccgctcttacaatagtggatcccccgggctgcatgttttcgtctcacccctagaaaaactgatgtggaaaaggagttgctcaaaaggaaacccaaaacgtggagattggcgtgccaggcaacggtgggcaacgcagattcgactggagagatgatcattcaacagctgccggagtggaagatacatgagtgggacaagtaggacttactgttttactggtcctgaagaatgctctcgttgccctcctatatatcccctgcagtgcaacgggggaaaaaaaaaaaaaaaacgagggcgctcgaaggtaccaaattttccgctatgactgagttttagacacgtgtccgctcgcaggccctaccgataccacgacgttcttgaagtgggtaagaatcccccccccccgggcgaatctaattgccgctattgctccctagatgccccccctcctctccctggccattgtggtaatttcatctcaacacgtgttccctggtttttcgcttcgcccccttttccccatacctaaccgtctgtcggctccacgacatcggccaaacgttggtaatcacttatacaaatgcttctacacagactccctttcgcgacacactcgtgtgcgtattaatattttcttgttttccacacccgggccccggcttcccgtttctacgcacaaaagcgcaccaaagatattacgttaggtggcacccctgtactaaaagtttggcggccattcgcgtgctctttgaaatacgcggtccaagcaatgatcagcgccctccn

SEQ ID NO: 67158 - protein, 42 aa, Zea mays
  misc_feature: Ceres CLONE 1541018
  misc_feature (14)..(14): Xaa is any aa, unknown, or other
FVPAFPFVPAPPLXKNNNLELPAVAAALTIVDPPGCMFSSHP

SEQ ID NO: 67159 - DNA, 720 bp, Zea mays
  misc_feature: Ceres CLONE 1541019
  misc_feature: Encodes the peptide sequence at SEQ ID NO. 67160
ctggagctccccgcggtggcggccgctctagaactagtggatcccccgggctgcaggaattcgtctcacccctagaaaaaattaccaaccaaccaaccaacccgcgcacccccgaaggagaagagcgggggtcggaggcccgaggtcggagctgagcgcgcccccatcttccgtcggcgataagagctttgtctgtttcagcttcatgagttctgggatagcactggcatccaacatctcttattcaacagtgaacagcagcatcatctttctctgccttttcgcgggatacttgggaattcctggtggaagcttcgctggaggaagctaatttagtcttcactgtagtagaagtttggcctaagagtttgtaggctttcaagcttcagaaatggtttcttctcagccatcctctctgactgcaattctcgcacagggccccaaccactgcccagtcaatatactcctcccgatggggcccccagatgtcgtctcctcagataatgttgagtacgatttctctgatgtttttggttccaccccgggtcaaacaccaacaaaccctttgtggggtttgggtccgggagagtcttgcaccctactggtggagtccaatggaggaattttaacaggtgaatcccggtttggcctcatccaacccggatcccccatttttttctttttggggggggggccacacaacaacaccctttgggtggg

SEQ ID NO: 67160 - protein, 41 aa, Zea mays
  misc_feature: Ceres CLONE 1541019
MSSGIALASNISYSTVNSSIIFLCLFAGYLGIPGGSFAGGS

SEQ ID NO: 67161 - DNA, 621 bp, Zea mays
  misc_feature: Ceres CLONE 1541020
  misc_feature: Encodes the peptide sequence at SEQ ID NO. 67162
  misc_feature (204)..(204): n is a, c, t, g, unknown, or other
ctggagctccccgcggtggcggccgctctagaactagtggatcccccgggctgcaggaattcgtctcacccctagaaaaactctcctcccccgtcggcacgagatccttgcccgaacaaaaaccagaagatgggcgaggggagggggagacgagatctcactccccgcttcctctccacctctcaaatggcgccaccgagcgcntaccgtagccaccagcagctcgtcgtcctacccgtcctgctcctactcctgatccggatccccgcatcccgcgcagcggcggcagatacctccctgtccacctattcctattccccacactgcccccaccctcccgtccgggtttgacctgcccgggggggaaatttttgggcgtcgggcccaaacccctttttcccctcccccagggtcccccccgggacttcttttggggggggaaccaatttttggggcccaaccccccttcccaggggggggcttttttttgtggcccccccccctggggccccgccaacacaaagcgccgggcccctcccggtttccccccttttttcaattttttggggggggggggcccctttctccccccccggggggggggaaaaccttttttgtgac

SEQ ID NO: 67162 - protein, 54 aa, Zea mays
  misc_feature: Ceres CLONE 1541020
MAPPSAYRSHQQLVVLPVLLLLLIRIPASRAAAADTSLSTYSYSPHCPHPPVRV

SEQ ID NO: 67163 - DNA, 641 bp, Zea mays
  misc_feature: Ceres CLONE 1541024
cccccgggctgcaggaattcgtctcacccctagaaaaaaaacagcgcctcaccagccagccaccagcgcgctccatttcctttctctctctctctcggctcctccgctctcttgcccgagtcgctagcttccctgccccgcctcctcccgtccccgtggacagacagctccccccacctccgcttccatagcatccgagctaaggtcaactcctccgtcggcggagcgagagcggggaagagacgggagggtcccggatccgagccgagctgcgctccccgcgcgaccgacacccaggtctcgccgtcccatgcagatctgctcctcctccggagatctaaacccaaacttgagctccggtttgttggtggccggcccggcggcggacaggggaggcttccaaaatgtcgtcgagcacgattccgaaggcccctgggccccgttgaaagaacaaaaccatcatccgcctcccccaaggtaaccaggaactttcgcgccctaactgggaagtggtttatgggtaaaggccaagaaccaccaacgaacgagtccggcccaagggaggcccccttcccggagaaattcccccccccctaaaatcccggaatccccgccgcccccacgttttttttttcttcaag

SEQ ID NO: 67164 - DNA, 688 bp, Zea mays
  misc_feature: Ceres CLONE 1541029
  misc_feature: Encodes the peptide sequence at SEQ ID NO. 67165
catagctggagctccccgcggtggcggccgctctagaactagtggatcccccgggctgcaggaattcgtctcacccctagaaaaaagccatggaagagcagcagccccgcccccgcccaagcatcgtgttcgtcctgtcgtcgctcgccaagaataacccagagtccgtgctggcgctcatcgcggtgctcaccgtcgtcgccctgcgccacttgatctcctcatggcggcagcaggcccggctgcgcccgtcaccgacgagcctcccggtgatcggccacctgcacctgctccgcccgccggtgcaccgcaccttccaggagctggcgtcgcggatcggtccgctgatgcacatcagcctcggctccacgcactgcgtggttgccagcaccccggaggtggccagcgagctcatccgcggtcacgagggcagcatctcggaggggacgctcacggcggtggcccgccagttcgcgtacgactcggccggcttcgacttcgcgctctataacacgcactggcgcttcatgaagcgcctctgcatgtctgagctgctcggcccgctcactgtctagcagctgcgcccccgtcgccgcgccgggatcggtgtccctgctcgacgacctggtggcgtcatccgctacggggggaagagggtggacctcaacccgccatctttttccgcctt

SEQ ID NO: 67165 - protein, 161 aa, Zea mays
  misc_feature: Ceres CLONE 1541029
  misc_feature: SWISSPROT Homolog: EC 1.14.13.87 Licodione synthase
MEEQQPRPRPSIVFVLSSLAKNNPESVLALIAVLTVVALRHLISSWRQQARLRPSPTSLPVIGHLHLLRPPVHRTFQELASRIGPLMHISLGSTHCVVASTPEVASELIRGHEGSISEGTLTAVARQFAYDSAGFDFALYNTHWRFMKRLCMSELLGPLTV

SEQ ID NO: 67166 - DNA, 695 bp, Zea mays
  misc_feature: Ceres CLONE 1541032
  misc_feature: Encodes the peptide sequence at SEQ ID NO. 67167
  misc_feature (75)..(75): n is a, c, t, g, unknown, or other
  misc_feature (77)..(77): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
gctggagctcaccgcggtggcggccgctctagaactagtggatcccccgggctgcaggaattcgtctcacccctngnanannnnnnnnnnnnnnnnaaaaaaaaaaccaaacacagaagacaggcagggcggcagcgcccacctccatctcccagccccgctccccaaatctcagccccgctccttcccagtcccagtcccagacccaggatgtcctcctccgacccggacgacgcccccgacgggggcgaggactcgcccctcttccgccgcagcggggggccgtcctccggcggcaccgttggcgacgtccccgtctcgcagtcgctcatcaaggcggcaagcaacgtgtgcttctccctcttcgtgctcgccgtccttgtcgtcaccgtcgtcgccgtcacataccagccgccggacccctggctccagtcctccgccgccatcaccacctcgctctcccgcgtcctccccaactccaccttcctcgtccccgacgactcgctcctccccaccggcgaggatttcaactcctccaccgccgtcccagccccggtgcgggatgacgatgacgcggctgcggccgtcagcgccgcctccgccgcggccgcgggcaacaggactgcgacccggacgcgcgcttaattgcttcgacccgcgcgtcctcgccgcggtcaaggggttcaacgcagggc

SEQ ID NO: 67167 - protein, 144 aa, Zea mays
  misc_feature: Ceres CLONE 1541032
MSSSDPDDAPDGGEDSPLFRRSGGPSSGGTVGDVPVSQSLIKAASNVCFSLFVLAVLVVTVVAVTYQPPDPWLQSSAAITTSLSRVLPNSTFLVPDDSLLPTGEDFNSSTAVPAPVRDDDDAAAAVSAASAAAAGNRTATRTRA

SEQ ID NO: 67168 - DNA, 617 bp, Zea mays
  misc_feature: Ceres CLONE 1541041
  misc_feature: Encodes the peptide sequence at SEQ ID NO. 67169
  misc_feature (388)..(388): n is a, c, t, g, unknown, or other
ccccgcggtggcggccgctctagaactagtggatcccccgggctgcaggaattcgtctcacccctagaaaaagttttaaatattttgtcgagaagcaaagcagttactacgaaggataaaggtttctatgatcatagatgatgggaaggactgctgtacattctccttttttccttgggtttcatcagtcagtgtataagtactaatgtccatgctgatgttaatctctgtaagactgccttcagtttactgaatcttttttttctaaaaaaaaaaaaaaaaacgagacgctcgaggtacccaattcgccctatagtgagtcgtattacgcgcgctcactgagcgtctttttacaacgtcgtgactggtcaaaaccctggcgttaccnagcttcatcgacttgcagcagatccccctttctccatctggggtatagtcgaaagaggcccgcaccgataacccctcccaaacatttgcccaagcctgaatggtttaatgggaaatggaaacctttaatatttttgttaaaatccccgtttaatttttgtgtaagaccgcttaattttttttaacccaaagggcgcaaattcggaaaaaatccctttataaaaaaaaaa

SEQ ID NO: 67169 - protein, 46 aa, Zea mays
  misc_feature: Ceres CLONE 1541041
PRGGGRSRTSGSPGLQEFVSPLEKVLNILSRSKAVTTKDKGFYDHR

SEQ ID NO: 67170 - DNA, 672 bp, Zea mays
  misc_feature: Ceres CLONE 1541044
  misc_feature: SWISSPROT Homolog: EC 3.2.1.23 Beta-galactosidase
  misc_feature (653)..(653): n is a, c, t, g, unknown, or other
ggagctccccgcggtggcggccgctctagaactagtggatcccccgggctgcaggaattcgtctcacccctagaaaaagagaggtcttactgtgcagggcattgagatcagggtcaagaagtaaggatgtgaaggctgtggggatcgggctttgcgcatcaaaacaaataaaagtatcttagttagatttgttgtgcgtgttctactgcagcacttgcgtatgtgtgtgtcttgcctatgcccagcaaaaaaaaaaaaaagttcttgaggcaagcaaaagaactgcagttttgtacacaatattgttgtgtcccagatcactcggtgctcgccatgtttgcttttgaaagtgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaaattgtagcgttaatattttgtaaaaattcgcgttaaatttttgtaaatcagctcattttttaaccaatnagccgaatcggcaaaatcc

SEQ ID NO: 67171 - DNA, 662 bp, Zea mays
  misc_feature: Ceres CLONE 1541061
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaaccttgacatgtcaacagattagtgttgggttgcagtcatgtggtgtttaagtcttggagaaggcgagaagtcattgctgccagcattgtgatcgtcaggcacagaagtactcaaaagtgagagctacttgttgcgagcaaacggagggcgatataggttgatagccaatttcaattcagtgtatgtgtgtgtgtgtgactgtgtgtgtaccaataaacatttaagttcaatcatttgcttgtctatggtcaaaagaaccatttccttcgaaaaaaaaaaaaaaaaacgagacgctcgaggtacccatttcgccctatagtgagtcgtattacgcgcgctcactggccgtcgttttacaacgtcgtgactgggaaaaccctgcggttacccacttaatccgcctgcagcacatcccccttttcgcaacctggcgtaataacgaaaaggcccgcacccgatcgccctttcccaaaattgccccaccctgaaatgccaaagggaatttgaacccttaataattttgttaaaattcccgttaaatttttttgtaaaaccccccccttttttttaacccaaaaagccc

SEQ ID NO: 67172 - DNA, 699 bp, Zea mays
  misc_feature: Ceres CLONE 1541064
  misc_feature: Translation starting site: 167
  misc_feature (699)..(699): n is a, c, t, g, unknown, or other
tccccgcggtggcggccgctctagaactagtggatcccccgggctgcaggaattcgtctcacccctagaaaagcactttggattcactcgatccgccatcatctgactgtgcgagccctagagggggatacatcgcattcataatccgtctcactggtatgacaagatggtggccaatggcgatgcatctgctaaagggagcgcggcggctgctgcaagcctgcttacgcgtatgaccacaagtggtgctgctgctggtggaggcggtgccagctctatgctccaattctaccactgacgagactgctggccgcaaaatgtcaccaaacactgttctgatcatgagtattgagttcccacccaacattgctgtgctccatgtattcgggaaactgtaccgaacccccacccaggttgggctcgcttttcccaagacggctggagttcacccagagaggattcctgcggaacatttttaattggtacccggggaaaacctagactcttccaaaaattttattttattaaatttgatatccctttcagggccatttgcgtaaaaaaaacaaaaaaaaacggaaacccttccaggcccccccattttccccccaaaagcggagcgtggttaacccgcgccacctctcgggcccgcccatttttttgactaacaccccccggggaaaacaccccgggaaatan

SEQ ID NO: 67173 - DNA, 615 bp, Zea mays
  misc_feature: Ceres CLONE 1541065
ggagctccccgcggtggcggccgctctagaactagtggatcccccgggctgcaggaattcgtctcacccctagaaaaaaatccgcggattcgactatcttgactcatacgtgtgaagaactgagctttggtgactgttgtgctaggtgctggctgaaggttctgatgcgcggttcagggaatatatctgcctgctcttagttcatggcgaatgatggttcggtgggactcgacgccagcgaatctgccgtgtaaatagtttagaatttgaagcgtagtgtagcgctgtggaccaatgctgtctctgaacatacatatgatcagagtaatgtgtgtttgcgttgttagtttcagactccggaatacaaatagttttggaccaaatccctaaagcctgtttgtactgtggaacacatgaaaaggctagtttgtatccaaaaaaaaaaaaaaacgagacgctcgaagtacccaattcgccctatagtgagtcgtatacgcgccgctccctgccgtctttttacaacctctgaccgggaaaacccctggcgtttcccaactttatcccctttgaagccaatcccccttttcccccttgggctaaaaaccaaaaaacccc

SEQ ID NO: 67174 - DNA, 659 bp, Zea mays
  misc_feature: Ceres CLONE 1541071
  misc_feature: Encodes the peptide sequence at SEQ ID NO. 67175
ctccccgcggtggcggccgctctagaactagtggatcccccgggctgcaggaattcgtctcacccctagaaaaatgatgctaacatttccccaccaaagagatctatattacaccagtatagaacggtggatgttacgcttacattggttgtcatcttcacctgcaatttgtagtacggctgctaaggttcttttgacttctgatgccaccacgataactcaaataacttccttcctcactgtcttataatgcgccaccttgaaaatacttcgatttatacacttcatatgttctcatgtttgaccatctatgtcatgaagacatgacgttgcaaccatagcagtgccaatccgacacaatgcctaagagcacttgtcttttttttatccaccatactaagaactgacgtttccatgtccatatgcacattccaaaaaaaaaaaataaaacgagacgctcgagtccccacttcgccctatagagagtcgtattactcgcgctcgctggccgtcgttttacaacgacatgactgggaaaaccctgtcgtcacccaacttaatcgacttgcagcacatcctcctttcgcctgctggcgtaatagccaagaggcccgcaccgatcgcccttctcaacagttgcgcagcctgtatggctaatg

SEQ ID NO: 67175 - protein, 80 aa, Zea mays
  misc_feature: Ceres CLONE 1541071
  misc_feature: SWISSPROT Homolog: EC 3.2.1.23 Beta-galactosidase
MSICTFQKKKIKRDARVPTSPYRESYYSRSLAVVLQRHDWENPVVTQLNRLAAHPPFACWRNSQEARTDRPSQQLRSLYG

SEQ ID NO: 67176 - DNA, 662 bp, Zea mays
  misc_feature: Ceres CLONE 1541074
  misc_feature: Translation starting site: 189
  misc_feature (662)..(662): n is a, c, t, g, unknown, or other
ggagctccccgcggtggcggccgctctagaactagtggatcccccgggctgcaggaattcgtctcacccctagaaaaagctcgctggctgtcttccccctgctgcggctcctcagtcctctcgcttctgttcccctatcgtcggcctccacaagcgccacgtctcgcgccctcgtccgctccccgccgatgagctgccgcgcggcgccgtggagtcgcccgtcgcacattgctggtccgcgtgtgcccaccccggcgcggccgcgcttcgcacttggaagtaggaatctgtggaagaactcatggacaattggtgctggtgtttcaaatatgtttgcgctgccatcaacactgtttaggtgcatggcttcaagtggctctggtgatggtgattttgctcggtctacattgactgacgaagcagcaccatttccattatactcttggccagataagcagagaccacgagtgtgcattttagtggtgggggtttggtggcctgtacaccgctttaagacttgaatctcttgtgtggcccaatgataagaggcctcaggttcttctggttgatcaatctgataaatttgtatttaaacccatgttgtacgagctattgtcaggagaagtggatatctgggagatagctccatcttttacagagtn

SEQ ID NO: 67177 - DNA, 823 bp, Zea mays
  misc_feature: Ceres CLONE 1541078-R
  misc_feature: Pfam Name: NAD_binding_6 Pfam Description: Ferric reductase NAD binding domain
  misc_feature: SWISSPROT Homolog: EC 1.6.3.1 NAD(P)H oxidase
  misc_feature (397)..(397): n is a, c, t, g, unknown, or other
tctcgatcttagttcttgtctagaggaagtgaagaagatggagatgctattatttgttcaaaaaaaactgttggggttttgacccacccaacccaactggtcaagcaaatacctactttgcgctactccgatcccctctctacacccatccatatccttacatatatatatagagagagagagctagaagttctccttgtggaactcgaacttggtgttggtcttccgcgagaagtcctgcgccagctcgcgcagctccttggtcagcaccggggcgccgcagtagaacactccgacgcgctggttctggtggttgagcgcgatgcgcttgtagacgttgcgccagttaggcctggcgaagtgggtcttgacgcgggtgccggacaccacgtcgacnccgtgcttggcgtggttgagcgactggagcatggcgatgagcgcggaccgggcgtccccttcctcgtacacgctggtgcaatagttgtgcagctcgatgacgccccttcctgtccgtctccgccacctcgtccatcacgccgcggaaacactcgaaagaaccctgctcccggggcacccaatagaagtagggccgcccggggggggaaacagggcctcgacgacgaccaccaccaacaacgcgtcccgaggcctccaggttgccgcccgtcagctgcctcaagtttgttgatgaagtccttggaataatggaaaatcatggggcggaaaccgccaatgccctatgcccccaccagcaacacgaatgtccgtaaccggcttggtaatccctggcgccccggggccccccttaaaggccccgttcaaa

SEQ ID NO: 67178 - DNA, 699 bp, Zea mays
  misc_feature: Ceres CLONE 1541080
  misc_feature: Encodes the peptide sequence at SEQ ID NO. 67179
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (438)..(438): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (445)..(445): n is a, c, t, g, unknown, or other
  misc_feature (446)..(446): n is a, c, t, g, unknown, or other
  misc_feature (450)..(450): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (468)..(468): n is a, c, t, g, unknown, or other
  misc_feature (469)..(469): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (495)..(495): n is a, c, t, g, unknown, or other
  misc_feature (499)..(499): n is a, c, t, g, unknown, or other
ctccccgcggtggcggccgctctagaactagtggatcccccgggctgcaggaattcgtctcacccctagaaaaaccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaaataaagttgaatgatctgcctgcaaannnnnnnnnnnntnnncaaanaannnannaaanannnaaaaannnnaaaannaaaaaannnaaaaaaaaggaaaaaanaaanaaaaacccggggcccctcgggggacccaatttccccccatagggggagcccttttttcccgcgcccccggggcccccttttttaaacccgcggggggtgggggaaaacccggggggtttcccaaatttaatcccccttgggaaaaaaatcccccttttcccaaagttggggataaaaccaaaagaggccccccccccttc

SEQ ID NO: 67179 - protein, 65 aa, Zea mays; identical to SEQ ID NO: 66489
  misc_feature: Ceres CLONE 1541080

SEQ ID NO: 67180 - DNA, 786 bp, Zea mays
  misc_feature: Ceres CLONE 1541081-R2
  misc_feature: SWISSPROT Homolog: EC 3.4.16.6 Carboxypeptidase D
  misc_feature (1)..(1): n is a, c, t, g, unknown, or other
nggacgattgggtactcgagcgtctcgtttttttttttttttttgagcattgaggtcagcactatgacttttatttctgaacttttttccaatcgaattacacttgcaactttggtagaagcgagaaggagggaaagaaacatatcagccggctttgccgggcaagaggaggcaccttttttaaattcttttgaaactaggggaacgccgttgggggcatcttggtgcctgccaggaagttgctgaagagcgtcagcgcctgccgcggcgcgtgcagaggcacctcgtgcccggctccgcggatggtgacgaacgtcaggccctcgtagacgatcgtccatccacccaacctgcagatgggtcggaaccacgggcgtcccactccctggaacgggctttaagcccctaacctttttttaaaggggtaaacccccctgggaaacgtcccccgggggaaacccccccccccctgggggttccccccccccttaaaaaaccccccccccccccttttaaaaaaaccccccccgggggaaaaaaaaaaaattttttttccaaaaataggttggggggggaaaaaagtggtataaaaaaaaaaaaaaaagggggggccctttttttttttttctccaaaaaaaagggggggtggttttttttaaataaacaaacaacaacaattgtttatgtaatagaggtgggggccgcgctccaccccaatttgtgttttgtttttttttcacgcaccccaaacaaatttttttttgtgtggtgggtggggatgcacct

SEQ ID NO: 67181 - DNA, 1046 bp, Zea mays
  misc_feature: Ceres CLONE 1541081-R
  misc_feature: SWISSPROT Homolog: EC 3.4.16.6 Carboxypeptidase D
gggtacctcacgcgtctcgtttttttttttttttttgagcattgaggtcagcactatgacttttatttctgaacttttttccaatcgaattacacttgcaactttggtagaagcgagaaggagggaaagaaacatatcagccggctttgccgggcaagaggaggcaccttttttaaattcttttgaaaataggggaacgccgttgggggcatcttggtgcctgccagtgaagttgctgaagagcgtcagcgcctgccgaggcgcgtgcagaggcacctcgtgcccggctccgcggatggtgacgaacgtcaggccctcgtagacgatcgtccatccaccaacctgcagatggtcgtaccaacgcgtccactcctgggacggtcttgagcccttacttgtttaccccccaacccccctggacatcacgggggaatctcatccccgtccggtgggccccctccttaaaaacccaccacccttgaaaacccgccggcataccaacgttggcggatgggtggggtggatagggtgtagtggattattttaaagaagggaaaaactgggggaaaatgttttcgctgcgcaatatcttccttctcacgtcgttaagtctttttgcccgtttgaaaagagcggtatgcacctctggctcgccaataagaacagtggtgggcgattgtatttttatctccggtcttgtgggcgcgagaaaagtggtttgttatatcggaagagcggtgggaagtcgtgtggtcggggcgagagactttctgtggatgtgctatggtcttaaaaaaatcctggccgctcccgcgtgtagggactcggccgaaatgtgttcatatatgtattcgattttcttttttgtattttcgtttgacgcactaaatgggtttgtgtggtttataattatctaaacccccaccagttagtgcttcattctctccgtgttatggaggagcggcgtgccctggttcttgtcagcgtgggtacgtattctctcttatggaagacaacaaccatatacgagcacttcctcaaccctg

SEQ ID NO: 67182 - DNA, 898 bp, Zea mays
  misc_feature: Ceres CLONE 1541081-R3
  misc_feature: SWISSPROT Homolog: EC 3.4.16.6 Carboxypeptidase D
gaggtcgcacttgacttttatttctgaacttttttccatcgaattacacttgcaactttggtagaagcgagaaggagggaaagaaacatatcagccggctttgccgggcaagaggaggcaccttttttaaattcttttgaaactaggggaacgccgttgggggcatcttggtgcctgccaggaagttgctgaagagcgtcagcgcctgccgcggcgcgtgcagaggcacctcgtgcccggctccgcggatggtgacgaacgtcaggccctcgtagacgatcgtccatccaccaacctgcagatggtcgtaccacggcgtccactcctggacggtcttgagccctagcttgttgagggtgagcctcgtggacgtcacggggatcctcccgtcggtgtcgccgctgaagacccacaccctgagaccgccggcgacgagcttgcggatggtggggtagggtggagaacgctgcgtcgttcccagtgttgatctcatccctgcagtgcgtccagtttggatcccgatcttgtgtcacgtttcgcattgttgttaacatcctggaatttttaggccaggttgaaagtaaggccatccgcggtacttcctccaccaccaagatgatcgttaactccgacacagactttattaaattccattcctacaggtattctgcgagaaataatacctgtggagacaagagcccgataaaacggctgacctattgtcgttggtctgtggtgcggggtgcgcttctttttacttaccgtctttacatgtgtccggtaccgtttatcacaattcagtattctataccctctcggatttgatatgtcgctcgaggtgcacttgtttcatacaacgggcaggcccttcccactgttgtaatggtagttctctctg

SEQ ID NO: 67183 - DNA, 687 bp, Zea mays
  misc_feature: Ceres CLONE 1541083
ctcaccgcggtggcggccgctctagaactagtggatcccccgggctgcaggaattcgtctcacccctagaaaaaaaatgcgccaccataaagcccggcgcctgtgtcgtgtgagggagcgtctgagctcgccagacaagaccctgacagtccgacacccgcaagccacaaagtgcagcctcgttgctacaggaatgctgagagatgtctgaccttgccggaaagcgcaacctgcgcagtggccgcaactgccaccgcaagcacatgcgaggaccggtagggtcatcggtctcgtcgccgggtttcaggttaagtcagggcaggccaactctgtccaagaagggaaccatcaaaaaaaaggaagggaggtggggcgcaaatggaaggattcgatggccggctgaaggggaaaaaaccccccctccccgggcccggaccaaactgggggctgggtgttgggggaaagggcaactttcgggctgggtgttactcttgcccgggacccctgggtcaagggcccccaaacgtttcgggggccaggggggggggccaaggaaaaacttttgaccccccgggggatggggggaaaaaaaataaacccgggaaaaaccccgccacgaaaaaaggggtgttccccccccccacaatttggggggaccccccccaggggagaagggcctccccctcc

SEQ ID NO: 67184 - DNA, 862 bp, Zea mays
  misc_feature: Ceres CLONE 1541083-R
  misc_feature (1)..(1): n is a, c, t, g, unknown, or other
  misc_feature (862)..(862): n is a, c, t, g, unknown, or other
ngggatcaccctggtacattcgtactactacttgttacagttcttcccacttcagagctgacacggtatgggcgtgcatgcaggatacgaatgctagttcccgctgattctgctttgctcgcgccccgcgggcaacagcccaactgcaactgccagcagccgctgcaccacagcagaaaccaactacgagagtggcaaacgacaaacaaacatcacttcgtcaccaaacaataatgcacgagcacgaccccccctacacggacaccaacagcaattgatgggcaaggacaataatggtggcaggagcgacagcgacgacatcaagcggcgcccggtgtgtcctggctggagggccagacgatgtccttgagcggggggcggaactcctcgctacagaacgaccgggtactccatattgtcgccgccgtcccttccttaacgtccaccaaggagcccccaacggggcccccccctgaagaattcccgcgggccactggccaggcccggcccccccaagggcccccccccgaaacggggcctcccaaaaaaaaaaacccccccgcgaaggcccccccctttttttaacaccccccaatttttgggctccccccggggccggggggaaaccaccgaaaccccccaaaaaggggagaaacccacccctttttgggggggggcccctccccgcctttataaaaaaaaagagaatcccccccccccgccccaaaaaacccccccctaaaagcaccccccccccccaaaggccccttggttggtaaaaaaaaaagggggaaaaaaaggggtcaaaaaacccccccccccaaaaaaaaaaaaaaaaaaaagagggggggaaacccccccn

SEQ ID NO: 67185 - DNA, 657 bp, Zea mays
  misc_feature: Ceres CLONE 1541084
  misc_feature: Encodes the peptide sequence at SEQ ID NO. 67186
  misc_feature (556)..(556): n is a, c, t, g, unknown, or other
  misc_feature (617)..(617): n is a, c, t, g, unknown, or other
  misc_feature (654)..(654): n is a, c, t, g, unknown, or other
ccgctctagaactagtggatcccccgggctgcaggaattcgtctcacccctagaaaaagccctcccctcctccccatcgcgtcctctccgctacacctcgccgatcggatcgcgacgagacgccgcgcgatccgacctaggctgacgccaacgaccactctcgccgccggcggtcatggcgtacggcgaccgcgttaccaccttcgaggactcagagaaggagagcgagtacggctatgtccgcaaggtctctggacctgtggttgttgctgatggaatgggtggtgctgccatgtatgaacttgtccgcgtcgggcatgataacctctttttggaaactatccgggggggggggggttcccccccatcccaatttttgcacaacacccctgggctggatggtcaatggccccggtattgagaacgagggagacctcttttcgttggattgggaacctggcactccttggaaagcgtttgtgatgggagccgcgtgccccctgaaaccccggcgcgatggctcctgccgcggtggattctttcgccgggggccgtntcctccggctgtttgatcacgggggtttgtcggggacgttccgccccggcagactgcgccnccaaccgcgtatctaacgaggcgacgtccgtttgggngat

SEQ ID NO: 67186 - protein, 81 aa, Zea mays
  misc_feature: Ceres CLONE 1541084
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLFLETIRGGGGSPPSQFLHNTPGLDGQWPRY

SEQ ID NO: 67187 - DNA, 672 bp, Zea mays
  misc_feature: Ceres CLONE 1541086
  misc_feature (542)..(542): n is a, c, t, g, unknown, or other
ctcaccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatgggggtcgacgtggcggctcaaccgtcttcttagatcacatctncgttgagacgggtgaaagtcttcacaccctctcgacctcctggctgtcccaattttttttttaccggcaaggataaacaaatgacccccttgggtgcttacacccccccctttcgttggataccagggcc

SEQ ID NO: 67188 - DNA, 682 bp, Zea mays
  misc_feature: Ceres CLONE 1541087
  misc_feature: Encodes the peptide sequence at SEQ ID NO. 67189
  misc_feature (384)..(384): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (604)..(604): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
tcccgcggtggcggccgctctagactagtggatccccgggctgcagggattcgtctcacccctagaaaatcgggcgactcggcggccgaccccctttcttccttcctccgccaccccggcgcgttctccttctcccgtcgcgtcgccatggcgcgcgacgccaccgccacatccgtgccagcgctccgcccctggcttgttgacctcctcccgctcctcgtcgtcctcctcatcgccgcccacgtcctcgctctcggttactggatctacaggctcgccacggacgggtccaggcagcccgcgcggagcaagaagcactaaggggacggcgcccgcggccggatgcttgaaaccagtttgttatttcagtcctgcatccttggncttgttgatctccaagccttcccacgtcagatgatggcgtgggaaagttcctgaaagaactagaacagggaaccgatcttatcccaatggtttggtcaaaatgttggtgtcaaaagtgacgatagctgaatagctgattatgtggaaggagcccttttgagcataaatagttttcgggtgctnnnngaaaaggtgttgactctctcgacctctccgtggnttaagacagtagctaaaaaccgaagtgccgttttcaacatgagttggggnnnnntgtggctggnnngcggggcggggc

SEQ ID NO: 67189 - protein, 57 aa, Zea mays; identical to SEQ ID NO: 56654
  misc_feature: Ceres CLONE 1541087

SEQ ID NO: 67190 - DNA, 661 bp, Zea mays
  misc_feature: Ceres CLONE 1541088
  misc_feature: Encodes the peptide sequence at SEQ ID NO. 67191
tcccgcggtggcggccgctctagaactagtggatcccccgggctgcaggaattcgtctcacccctagaaaaaatatcccgttgccgttcgactccctctgctcttcctcggaaacggattccgacgacacgactagcaatagcaaacctctctctcttcagcctttagaatcccacctctccattcccagcggctataaatccccgcgtcgccgctgcgccaaccaccctccctctccttcctcacatcttccttcgtcagccgcagatgcgccagcatctctcccacgggcagcacgaggaggagcgagaggcacagagacatacaaacagagagcgcgcgcggggggagcccagaacagcacctacactagctagccaccaccaatactaccacccaccaaatcgggtgagcacagcgcgctgctcgtcagctccggccggccgcccggccgctttataaagccacccacccagacacggctgatcgtcatcgccataccaccgcctccgtcgagggacacacacccgccttgccagccggcaccctgcaggtctccgccatcggtgatcatctggcctcgccgcctcataacacgacacgcaggccggttgctccgattgggagtgccgatcggagtcgatcgcgagggaagcgcatg

SEQ ID NO: 67191 - protein, 64 aa, Zea mays
  misc_feature: Ceres CLONE 1541088
MRQHLSHGQHEEEREAQRHTNRERARGEPRTAPTLASHHQYYHPPNRVSTARCSSAPAGRPAAL

SEQ ID NO: 67192 - DNA, 692 bp, Zea mays
  misc_feature: Ceres CLONE 1541092
  misc_feature: Encodes the peptide sequence at SEQ ID NO. 67193
ctccgcggtgggggccgctctagaatagtgggatcccccgggctgcaggaattcgtctcccccctggaaaaaatcttctccaatctccaccctcggcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgagggcgtcaacgccaggctccggcggctcgagccaccagaaccgcgcttcctcggctacggcagcccccgtgcgtccaacgcgggacacatggcatcctttgcggcgccagagaccccgggtaaccacactgccccaggggcttggggattgccccggaagttcttcccttcgccggccgcacgggtttacggttcggggttggggaatcaattgcgggcccccgggtacaaaaaaaaagggaggcgggccggggttcccccaatttttgtcaaaagcacatggttttttcaaggggcccggggaaaag

SEQ ID NO: 67193 - protein, 160 aa, Zea mays
  misc_feature: Ceres CLONE 1541092
MAFRRILSTAVRRRSAVAAAAAGNAREASTAVAAAPGVLAPDATAVRAPVMPYDRIAEGVNARLRRLEPPEPRFLGYGSPRASNAGHMASFAAPETPGNHTAPGAWGLPRKFFPSPAARVYGSGLGNQLRAPGYKKKGRRAGVPPIFVKSTWFFQGARGK

SEQ ID NO: 67194 - DNA, 644 bp, Zea mays
  misc_feature: Ceres CLONE 1541099
  misc_feature: SWISSPROT Homolog: EC 3.2.1.23 Beta-galactosidase
  misc_feature (615)..(615): n is a, c, t, g, unknown, or other
gcggtggcggccgctctagaactagtggatcccccgggctgcaggaattcgtctcacccctagaaaaacccctagaaaaataaaaatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagaagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggnttgagtgttgttccagtttggaacaagag

SEQ ID NO: 67195 - DNA, 656 bp, Zea mays
  misc_feature: Ceres CLONE 1541100
  misc_feature: Encodes the peptide sequence at SEQ ID NO. 67196
  misc_feature (169)..(169): n is a, c, t, g, unknown, or other
acccgcggtggcggccgctctagaactagtggatcccccgggctgcaggaattcgtctcacccctagaaaaacaagttgccaaaacaaaagaatgtgtgattcgctgtaattaacatattgtactgataatctgatatggcatacctaatctgggtcagttaacaggtngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccgggacccccgggggccccaaatccccccaaaagaaaggaaaaaaacccccccccccgggcccctttttaaaaaggggggaagggaaaaaacccgggggtacccaaattaaaacccttgggaaaaaccccccttttcccaaggggggaaaaaaaaaaaaaaccccaaacaaaaccccctcccaaaaatttcccccccccaaagggcaaaggaaaatttaacccttaaatttttttaaaaaacccccttaaaatttttgaaaaaccacccctttttttaaccaaaaagccaaaaaagggaaaaaccccttaaaaaaaaaaaaaaaaacccaaaaaggggggaaggggtcccccaa

SEQ ID NO: 67196 - protein, 37 aa, Zea mays
  misc_feature: Ceres CLONE 1541100
TRGGGRSRTSGSPGLQEFVSPLEKQVAKTKECVIRCN

SEQ ID NO: 67197 - DNA, 657 bp, Zea mays
  misc_feature: Ceres CLONE 1541105
  misc_feature: Encodes the peptide sequence at SEQ ID NO. 67198
  misc_feature (390)..(390): n is a, c, t, g, unknown, or other
agctccccgcggtggcggccgctctagaactagtggatcccccgggctgcaggaattcgtctcacccctagaaaaaccagaagcgaaggcggaggcggaggagcggaggtaggagatctcgagcaagccggaggcagaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactccaagttcgtccaggaacacaagaagaagcactgacgaaccaggtgaaggagttgtcagaaacgcatgtttggccagccagtttctgtatgcttttgaatgaaaatttnagacccttcttctcgtttcctaatcgaaatgctggcactctatggtccatttgtaatgtataagaggcaaatggattgaccaactaaaaaaaaaaaaaaaacgagacgctcgagtaccaaatccccctatggtggtcgtattaccccgcctcctggcccgcgttttccacgtcctggctggggaaaccctgggttaccaaatttatccccttggaaaaaatcccctttcccccggttggttaattccaaaaaagccccacccttcgc

SEQ ID NO: 67198 - protein, 57 aa, Zea mays; identical to SEQ ID NO: 4512
  misc_feature: Ceres CLONE 1541105

SEQ ID NO: 67199 - DNA, 684 bp, Zea mays
  misc_feature: Ceres CLONE 1541106
  misc_feature (655)..(655): n is a, c, t, g, unknown, or other
ggagctccccgcggtggcggccgctctagaactagtggatcccccgggctgcaggaattcgtctcacccctagaaaaaaatgccgaacagttagtatttgggcgattcaaggcggagagtgcctccgcctttgggatcaggctgggattccgatgcgattcgtagatgttcctatgctgctcaggtgtccccctctgatcaatcgtgtcagttcttcgggctgtcatagggagtggcctgcgtgtatggtgattggtagcctggcaggccaccaataatatcttctctcctgggcttatttgcctccatttgtcatcagcttcttgaaatccacagtctggtcaaatgctgtgaagaaaattcctctagtgctgaataagttcagcatagaaccactatgggcgcctgtgtatcttcaagcaaaaagcggagatcgcaaaggtcatgctgtatatacaggcgctaccgtggcaaggttttaaccaatacacctatagtacgcgtcggtgaagtggagaaccttgcttcttctggagcagcagtccatttagggacttctgcagctgctcgacggagatccgatggctcaaacgttacgttccaccctcacacattgcagtggcgtcacagtgagctggacacagagaatggaaantgtgtgtgccagaaagagcgtggttcgac

SEQ ID NO: 67200 - DNA, 645 bp, Zea mays
  misc_feature: Ceres CLONE 1541114
  misc_feature: Encodes the peptide sequence at SEQ ID NO. 67201
  misc_feature (551)..(551): n is a, c, t, g, unknown, or other
  misc_feature (557)..(557): n is a, c, t, g, unknown, or other
  misc_feature (558)..(558): n is a, c, t, g, unknown, or other
  misc_feature (625)..(625): n is a, c, t, g, unknown, or other
ctcaccgcggtggcggccgctctagaactagtggatcccccgggctgcaggaattcgtctcacccctagaaaaaagccccagccgaaggaacattaacaaaccgcccgccgcttccttcacgtaatctcgcgtctcctccgccgcccccgtcttctcctcccctcttgctaaagcaaagcaacctgcaacccgcaattattcctcccccgcacgcgaaatccgcccgcagctcttcgtccccggaggaccaagcctgcgcaccagagatgtcgtacgcctacctgttcaagtacatcatcatcggcgacacaggcgtcggcaagtcgtgcctgctgctgcagttcaccgacaagcgattccagcccgtccacgacctcaccatcggcgtcgagttcggggcccggatgatcaccatcgacaacaagcccatcaagctccagatttgggacacggctggtcaagagtcattcagatccataactagatcatactacagaggcgctgctggtgctcttttggtttatgacataactaggagggagactttcanccaccnntgcagctggctgggagatgcgagacagcacgccaatgctaacatgacaataatgctttgtgggaacnagtgcgatctgtctcacagc

SEQ ID NO: 67201 - protein, 126 aa, Zea mays
  misc_feature: Ceres CLONE 1541114
  misc_feature (8)..(126): Pfam Name: Ras Pfam Description: Ras family
  misc_feature: SWISSPROT Homolog: EC 2.7.11.1 Non-specific serine/threonine protein kinase
  misc_feature (95)..(95): Xaa is any aa, unknown, or other
  misc_feature (97)..(97): Xaa is any aa, unknown, or other
  misc_feature (120)..(120): Xaa is any aa, unknown, or other
MSYAYLFKYIIIGDTGVGKSCLLLQFTDKRFQPVHDLTIGVEFGARMITIDNKPIKLQIWDTAGQESFRSITRSYYRGAAGALLVYDITRRETFXHXCSWLGDARQHANANMTIMLCGNXCDLSHS

SEQ ID NO: 67202 - DNA, 666 bp, Zea mays
  misc_feature: Ceres CLONE 1541117
  misc_feature: SWISSPROT Homolog: EC 3.2.1.23 Beta-galactosidase
agctccccgcggtggcggccgctctagaactagtggatcccccgggctgcaggaattcgtctcacccctagaaaaacctagaaaaacatgtacttccctctgcttatgtacaatgtttgaaagttaaaaccaaatgtttcagtgtggcattatgacgtgttttagacatcaattcatggctttaaactggtttgttcagagtcattttagcaaaaactgagtgttctgcatgccaaacttcggttaactcaaacattggtggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaccaataggccgaaatcggcaaaatcccttataaatcaaaagaatagacggagatagggttgagtgttgttccagtttggaacaagagtcactattaaagaacgtggac

SEQ ID NO: 67203 - DNA, 669 bp, Zea mays
  misc_feature: Ceres CLONE 1541118
  misc_feature: Encodes the peptide sequence at SEQ ID NO. 67204
  misc_feature (399)..(399): n is a, c, t, g, unknown, or other
  misc_feature (509)..(509): n is a, c, t, g, unknown, or other
ctccccgcggtggcggccgctctagaactagtggatcccccgggctgcaggaattcgtctcacccctagaaaaaatggagaggccgcgttgctactctccgcttgccctgcacctcctcctctgcctcttctcgctccgcgcctgttccgccgcgtccatcacagccggcacccccgacgagtcggagctgtgggggtacgtcgaggtccggccaaaggcgcacctgttctggtggtactacaagagcccgcagaagacgtcgacgccgtccaagccatggcccacggtcctctggctgcagggcggcccgggcgcgtccggggtcgggctcggcaacttcctggagatggggccgctggacgtggaccctgagcccgcgcactcgacgtggctccacnaggccgacctcatctttgtgggacacccggtcggcacagggtacagctacgtggaggacgacagcctgttcgtgaccagcgactggcagcaggcccgcgacatgacgacngtggtcaggccgctgggcaagggagtgcccaccctggcgagcagcccgctgttctggtcgccgagtctacggcggaagtaccccgcacgcttggccgtccattgcaggggcgtccccctgggaagtcacgtccctttcgagggtgggcgttggaatacct

SEQ ID NO: 67204 - protein, 198 aa, Zea mays
  misc_feature: Ceres CLONE 1541118
  misc_feature: SWISSPROT Homolog: EC 3.4.16.5 Carboxypeptidase C
  misc_feature (109)..(109): Xaa is any aa, unknown, or other
MERPRCYSPLALHLLLCLFSLRACSAASITAGTPDESELWGYVEVRPKAHLFWWYYKSPQKTSTPSKPWPTVLWLQGGPGASGVGLGNFLEMGPLDVDPEPAHSTWLHXADLIFVGHPVGTGYSYVEDDSLFVTSDWQQARDMTTVVRPLGKGVPTLASSPLFWSPSLRRKYPARLAVHCRGVPLGSHVPFEGGRWNT

SEQ ID NO: 67205 - DNA, 674 bp, Zea mays
  misc_feature: Ceres CLONE 1541120
  misc_feature: Encodes the peptide sequence at SEQ ID NO. 67206
ctccccgcggtggcggccgctctagaactagtggatcccccgggctgcaggaattcgtctcacccctagaaaaacccagagagacagacacgcctcacccccaccacaagaacaccaaagccacatcccatccatctccacggtgaggcttgagcgatccgagcaaaaaaaatcatccgcgacgcagcgacgcaggtttgttctctgatctctctggttcttcttttagcagcagggacgcacaacacaagaaaaggtccggttcaagaggctcttctgttgggtttttttagaatcctcaagagaagcgtgttcttgggttaggatttttttctcacctcataacacctctcctaggaggaacagagatccagagaaccttttttctcttctggatccttgccgccttttggcgttcgaaagggggttgttttgcaataccctctctctgttttttttttctttcttgggcacaacccacctcgtttctctacttttattgaggaacagagctgggttttcaaaaaaaaaaaatctgctttgattttccataaagaaaactctcagccttcttcttctagctccatcaaggctgtagtcctaatggccgaggcatcgacctgtcaagtcctacaatccggggccccccgaaacccctcctatcccccttggaa

SEQ ID NO: 67206 - protein, 47 aa, Zea mays
  misc_feature: Ceres CLONE 1541120
PRGGGRSRTSGSPGLQEFVSPLEKPRETDTPHPHHKNTKATSHPSPR

SEQ ID NO: 67207 - DNA, 663 bp, Zea mays
  misc_feature: Ceres CLONE 1541121
  misc_feature: SWISSPROT Homolog: EC 3.2.1.23 Beta-galactosidase
  misc_feature (548)..(548): n is a, c, t, g, unknown, or other
ccccgcggtggcggccgctctagaactagtggatcccccgggctgcaggaattcgtctcacccctagaaaaatatattcaaatttcactctgtgaatagtagtctagaatacagtagtgttttgagtaaactatggataaactgctggacaaggtctaagacaagtgctgcgtggtggcaacaaacgacacttagtcttgtttggtggcaatgacattggaggggctaaagttttttcgctcctaaacaagctcctaagaatcttacgtgttatgttgcattatggaatatctatgtatctgcaaactctctgtagtatgtatgtacctcggatgtgctctatgtggctttgtaattttgaacggaggaagtaataataagataaatggatggcgtaacaagatactttgctttaaagtacaaaaaaaaaaaaaaaaaacgagacgctcgaggtacccaattcgccctatagtgagtcgtattacgcgcgctcactgggcgtcgttttacaacgtcgtgactgggaaaaccctggcgttaccaacttnaatcgcttgcagcacatccccctttcgccagctggcgtaatagcgaagaagcccgcaccgatcgcccttccccacagttgcgcagcctgaatggcgaatggaaatttgtagcgtt

SEQ ID NO: 67208 - DNA, 684 bp, Zea mays
  misc_feature: Ceres CLONE 1541124
  misc_feature: Encodes the peptide sequence at SEQ ID NO. 67209
tccccgcggtggcggccgctctagaactagtggatcccccgggctgcaggaattcgtctcacccctagaaaaaattcctcccacattccaccgcacccacacgtttctttaccctaaccccgacagccgccgccgtttcttcatcttcctcgcagcgccggcgctccatcttccgctccctccccgactcgcgatcggcacgcaggcgacgtcggggcagtctcggactcggcggcggcgtcagcggctccccctcccgccctcgccagtcgcttccggtcctccgcacaccaaccggcgactctgcgtgcgcgcctcctgcttccggtggaccgtcgacggcgcccgggccccggtggccggcgggcagcgagagccagcagcctggcagttttcctcattggaaaggaaggacaatcagagccaagagtttcttcataaacctgaataaaaggacatgcgattacggaatacagacagggcaccgcgtagctcaggtcgtcgcaataatgttctttcatggatctctgaagttaaagacacatctaatgtgggcgtaagaaagaaaagggggagaagagcacctccatctgctaaaagattgcgtgataaaagggtggataaggcgattgaaagtgatggtgctgttgacagtgacagcgatgatacagatggacaggttga

SEQ ID NO: 67209 - protein, 75 aa, Zea mays
  misc_feature: Ceres CLONE 1541124
MRLRNTDRAPRSSGRRNNVLSWISEVKDTSNVGVRKKRGRRAPPSAKRLRDKRVDKAIESDGAVDSDSDDTDGQV

SEQ ID NO: 67210 - DNA, 2129 bp, Zea mays
  misc_feature: Ceres CLONE 1541128
  misc_feature: Encodes the peptide sequence at SEQ ID NO. 67211
aacccgccccgccctagctcacacgccaagccccagtacaaacaaagcctacggaatttcccccagctccaattcgcgctgttcgttccctttcagccagtcagtcgccgcctccgctgaactggaagtccaaactagctagctcactgggcaccgatttcccccaatttttcgctgccaggaggccgcggcgaccatgggcaactgctgcgccgcgccgtcgacggagggaagcggcaagacccgccccaagaagcagaaggagaacccctacaacgtcgcgtacaaccgcggcgcggcgccgccggcgccggtgcgcccgggcctggtggtgctgcgggacccgacggggcgggacctcggcgcggagtacgagctgggcggcgagctggggcgcggcgagttcggcgtcacgtacctgtgcacggagcccgccacgggggcgcgctacgcgtgcaagtccatatccaagcgcaagctgcgcacgcccgtggacgtggaggacgtgcgccgggaggtggacatcatgcgccacatgccgccgcaccccaacatcgtcagcctccgcgccgcctacgaggaccgagacgccgtgcacctcgtcatggagctctgcgagggaggggagctcttcgacaggatcgtcgcccgcgggcactacaccgagcgcgccgccgccgccgtcatgcgcaccatcgttgaggtcgtccagaagtgccacaggcatggcgtcatgcaccgggatcttaaaccagagaactttttatatgcaagcaaggacagttcccctctaaaagcaattgattttggcctgtctgtgttcttcaggcctggtgagcgatttacggaaattgtaggcagtccatactacatggccccagaggttctgaagcgaaactatggccctgaagttgatgtctggagtgctggagtgatactttacatacttctttgtggtgtaccaccattttgggcagaaaccgaacagggagtagcgcaggcaatcatacgatctgtggtagatttcaaaagagaaccatggcccagagtatctgagcctgctaaagatcttgtcaggcgcatgcttgacccaaatccattgacacggtttactgcagcacaagtacttgagcatccatggctacatgactctaaaaacacgccagacgtttctcttggcgatactgtccgagcaagactgcagcaatttgctgcgatgaacaagttaaagaagaaagcactaagggtgattgccgagcatctgtctgcggaggaagtagctgacataaagcaaatgttcgataagatggacgtgaacaagaacggcaagctaacattcgaggaattcaaggccggcctccgtaagctgggaaaccaaatgcatgattcagaccttcagatactgatggatgctgccgacgtcgacagaaacgggaccttagattacgaggaattcgtcacggtgtctgtccacgtgaggaagataggcaacgacgaacacatccagaaggccttcgcatacttcgaccggaataagagtgggtacatagagatcgaggagcttagagaggcactggctgatgaactggatggcagtgatgaagacatcatcggtggcatcatccgggacgtggacacagataaggacgggaagataggctacgacgagttcgcggcgatgatgaaggccggcactgactggaggaaggcctcccggcagtactcgcggcagcggttcagcaacctgagcctgaagctccagaaggacgggtccctcggcgccgacacacggtaggccgccgagtgtagtggtggtgctggtgttcgtccgtctctttgcttgcttgcttgttttgctgtgcggggtttttgttggttggtcagacagacagtcagtcaggtcattagattccacttccacgttctgtttccattacacggtgaaccctcagctggagctgtgattcttgggcttgtgattgtagaagaaagatgcacgtacaacgtacgtattgtagatgggtgcagcagcgtgtgctgacaaagaacgctggagtagcacaagacacgagtagtcttgctttgcttgtaacttgtaagtagaatttgtttaaaaaaaaaaaaaaaaa

SEQ ID NO: 67211 - protein, 532 aa, Zea mays
  misc_feature: Ceres CLONE 1541128
  misc_feature (59)..(316): Pfam Name: Pkinase Pfam Description: Protein kinase domain
  misc_feature (363)..(391): Pfam Name: efhand Pfam Description: EF hand
  misc_feature (435)..(463): Pfam Name: efhand Pfam Description: EF hand
  misc_feature (471)..(499): Pfam Name: efhand Pfam Description: EF hand
  misc_feature (399)..(427): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNCCAAPSTEGSGKTRPKKQKENPYNVAYNRGAAPPAPVRPGLVVLRDPTGRDLGAEYELGGELGRGEFGVTYLCTEPATGARYACKSISKRKLRTPVDVEDVRREVDIMRHMPPHPNIVSLRAAYEDRDAVHLVMELCEGGELFDRIVARGHYTERAAAAVMRTIVEVVQKCHRHGVMHRDLKPENFLYASKDSSPLKAIDFGLSVFFRPGERFTEIVGSPYYMAPEVLKRNYGPEVDVWSAGVILYILLCGVPPFWAETEQGVAQAIIRSVVDFKREPWPRVSEPAKDLVRRMLDPNPLTRFTAAQVLEHPWLHDSKNTPDVSLGDTVRARLQQFAAMNKLKKKALRVIAEHLSAEEVADIKQMFDKMDVNKNGKLTFEEFKAGLRKLGNQMHDSDLQILMDAADVDRNGTLDYEEFVTVSVHVRKIGNDEHIQKAFAYFDRNKSGYIEIEELREALADELDGSDEDIIGGIIRDVDTDKDGKIGYDEFAAMMKAGTDWRKASRQYSRQRFSNLSLKLQKDGSLGADTR

SEQ ID NO: 67212 - DNA, 656 bp, Zea mays
  misc_feature: Ceres CLONE 1541130
  misc_feature: Encodes the peptide sequence at SEQ ID NO. 67213
tacccgcggtggcggccgctctagaactagtggatcccccgggctgcaggaattcgtctcacccctagaaaaaaccaaaacctttcccaactccccgcaccccggcgcgcaccatgagccgcgccacgccacgccactcctcctcgtcctcgcaccatgcccccactccccgcgccagcctcctccatcccctccgccccgccgcggggcaccgccaacgacgccgcccgctcctccgtcaacctcctccgctccctcgcgcgcgcgcggcgcgcggacctgtcccaccgcgcgctgctcctcttccgcacgctgcacgcctccccgtccccgccgccgccgcgctactccctgcccgccgcgctctccgcggccgccttcctcgccgcgctcccggagggccgccagctccacgcgctcgccgccaagctcgccctcgcgcccgcccacaccgtcgtcgccaactccctcgtccacttctacgcctcctgcggccgcccgggcgccgcgctcgccgtcttccgccgcgtcccggaccggtcgctcgtgtcgtggaacaccgccgtcgacgcgctcgcgggcaacggggaccacctcgccgcgctcgacctgtttcgggagatgcagcgcgacaggcccgaactcgcgcccgacgc

SEQ ID NO: 67213 - protein, 166 aa, Zea mays
  misc_feature: Ceres CLONE 1541130
  misc_feature (131)..(165): Pfam Name: PPR Pfam Description: PPR repeat
MPPLPAPASSIPSAPPRGTANDAARSSVNLLRSLARARRADLSHRALLLFRTLHASPSPPPPRYSLPAALSAAAFLAALPEGRQLHALAAKLALAPAHTVVANSLVHFYASCGRPGAALAVFRRVPDRSLVSWNTAVDALAGNGDHLAALDLFREMQRDRPELAPD

SEQ ID NO: 67214 - DNA, 908 bp, Zea mays
  misc_feature: Ceres CLONE 1541131-R
  misc_feature (372)..(372): n is a, c, t, g, unknown, or other
gggtacctcgagcgtctcgtttttttttttttttttccttttattatcctttccattcagcacaaactgaagcagacaaccttgatccatgtaccggaaaagattcacaggtatcgacaatcatgatcagtaggctctcaagtgacaactgcaccttggagaaccaagaagcggtcacccaatggcgggcctagtgttgtacagagtcgattatatgacggtgttagcaggaactcgttcattcatatattgctacaaaatgattaagacatgtgtggccgtacagtaaagaaacctcgtgatcgtgaaaatatttaatctctatcaggtgtaggcatgtaatctgaacccctgctgccatctgtcgttganaaagagcccttgtgccttgttatgtttccacagaacgtatccagctcttcttccgttctcttgatttcacaggaccaaaggactgggtccaacattctttgggcaaaggattcttgaagttggggacccccttccccttagccactgctcagcttttttggcactcattgggcaacagcattctcctttccaggggggggaatattgactttggcagcattttctttggggttaaaaataggccctttataaaagatcttctccttggggtttcgggctgtcgactttccggcattcttttaaagacgattttcccaatttggtatcttacaaaagctttttttcggcttcctcaagtgttggcaaagtgataaaactgggattttgttgcttattatttaacctttttttaggtaatacgaagtcttgacaggcgggggggggaaatttaattcgaagttttgtgtcccctttctcaaaaacaattaacagaaagccctcggtgcgcgcctagaaaaagactggtcttcgaggtt

SEQ ID NO: 67215 - DNA, 652 bp, Zea mays
  misc_feature: Ceres CLONE 1541131
  misc_feature: Encodes the peptide sequence at SEQ ID NO. 67216
acccgcggtggcggccgctctagaactagtggatcccccgggctgcaggaattcgtctcacccctagaaaaaaccgcggcgtgcgcggaccgtgcgtccgtgccctccggctccggcgcaccgctccgctcattccatctccatccaccgcgccccaaatcgcacggccccgcctccccattcgcgccgatcgaatcccaatcggcggccatgagcgtggtcggcttcgacgtcggcaacgacaccctggtggcggcggcggcgcggcagcggggcattgatgtgctcctcaacgccgagtccaagcgcgagtcacccgccgccgtcgccttctcccacaacgcgcgcctcatcggctgccacgccgcgtccgcctcgtccgcccacgcccccttctccagcgtcaaacgcctcctcctgggcgccacggggaggaacccggactcctccctcctccgcgacctcccccgcctccctttctccgtctcccacgcctccggtggcggcgccgtcgtccacgttgaccacatcggccgccgcatcgcgctctctccgacccatctcctctccatgctgctcgcctacctcaagcagctcgcggaggccgacctcggaggcgcccccgtcgccgactgcgtgatctccgtgccct

SEQ ID NO: 67216 - protein, 147 aa, Zea mays
  misc_feature: Ceres CLONE 1541131
MSVVGFDVGNDTLVAAAARQRGIDVLLNAESKRESPAAVAFSHNARLIGCHAASASSAHAPFSSVKRLLLGATGRNPDSSLLRDLPRLPFSVSHASGGGAVVHVDHIGRRIALSPTHLLSMLLAYLKQLAEADLGGAPVADCVISVP

SEQ ID NO: 67217 - DNA, 692 bp, Zea mays
  misc_feature: Ceres CLONE 1541132
  misc_feature: Encodes the peptide sequence at SEQ ID NO. 67218
tggagctcaccgcggtggcggccgctctagaactagtggatccccccgggctgcaggaattcgtctcacccctaaaaaaaatccctcccgatcagatccctcgacaatggcactccaggcagcctacgagtacctgcagcaggccgtcggccatgggcgcgtggtcgtccacgcagacgctgacgctgctgctcatcgccgtacccaccgtactactgctgctagcgtccctcgccaagagcacgtcgtcgtccggtaggggcaagcccgcgctccctccctcgccgccggggcaccctccccatcgtggggcacctacaccacatcgggccccagacccacatctcgctccaggagctggtgggcaagtacgggcacaacgggtttcctgttcctccgcgccggcgccgtgcccaccctgatcgtgtcgtcgcccagcgccgccgaagccgtgatgcgcacccacgaccacatcttcgcgtcccggccgtggtccatggccctccacatcctccgctacaacacctgcgacgtggccttctcgccgctcggcgaatactggcagcagaccaggaagctgatgaacacgcacctgctcagcaacaagaaggtctactccttcccgccatggccgcgagaaagagtgtgcctcgtcgtggacaactccgcgaggcgcccgcaagtcgccgtca

SEQ ID NO: 67218 - protein, 79 aa, Zea mays
  misc_feature: Ceres CLONE 1541132
  misc_feature: SWISSPROT Homolog: EC 1.14.13.21 Flavonoid 3'-monooxygenase
MRTHDHIFASRPWSMALHILRYNTCDVAFSPLGEYWQQTRKLMNTHLLSNKKVYSFPPWPRERVCLVVDNSARRPQVAV

SEQ ID NO: 67219 - DNA, 663 bp, Zea mays
  misc_feature: Ceres CLONE 1541133
  misc_feature: Encodes the peptide sequence at SEQ ID NO. 67220
  misc_feature (126)..(126): n is a, c, t, g, unknown, or other
  misc_feature (382)..(382): n is a, c, t, g, unknown, or other
  misc_feature (387)..(387): n is a, c, t, g, unknown, or other
  misc_feature (513)..(513): n is a, c, t, g, unknown, or other
acccgcggtggcggccgctctagaatagtggatcccccgggctgcaggaattcgtctcacccctagaaaaactgtcgtctcctcgcgctcgtcctccgctgcccgactccggcgtcgtccccacangtccgcaccagccgacccaaccaccgctcaagccttaacccaacatttatctgtatcccgtggcaaggagcatctgcgcgtcacatccgcgatcgcgcgctctacgtcgcctcccgccgccgccgcacggccgcgacggatgctcggccaccgcttccctaccgccctccgcctcccacatggtctgctgctgaggaggagcatcatggcccgccgcggcctgaccatcatggccggtggggcgagcgaaggtccnctcgncgggttcttcgactacatggagcggctacgcaaactacgagcgctcgggcgtgcggcgcggggccggcaccgactccgacaacgggtcgaactcggacgcatgcgccggttcttcgccgggttggnaaccccaaacccacttcccggttgggctatcgcccgccccagggggaaaggttaactggggatttctgtccaaaataaggggggcccaggggtaaagggagggctgtttttttagccccatttttcaaaaaaaacggaaagggttttttt

SEQ ID NO: 67220 - protein, 100 aa, Zea mays
  misc_feature: Ceres CLONE 1541133
  misc_feature (41)..(41): Xaa is any aa, unknown, or other
  misc_feature (83)..(83): Xaa is any aa, unknown, or other
MLGHRFPTALRLPHGLLLRRSIMARRGLTIMAGGASEGPLXGFFDYMERLRKLRALGRAARGRHRLRQRVELGRMRRFFAGLXTPNPLPGWAIARPRGKG

SEQ ID NO: 67221 - DNA, 667 bp, Zea mays
  misc_feature: Ceres CLONE 1541136
  misc_feature: Encodes the peptide sequence at SEQ ID NO. 67222
  misc_feature (514)..(514): n is a, c, t, g, unknown, or other
tcaccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatcccactccgctggggcatgctgggcgcgttgggctgcgtgttcccggagctgctcgcccgcaacggcgtcaagttcggcnaaggccctgtgggtcaagggccgggtccgcagatcttcagcgagggtgggctggactacctcggcaacccgaagcctgatccccgcccaaagcatcctccccctttggggccttgccagggcggtgcctatggggccccatccgggggggacc

SEQ ID NO: 67222 - protein, 177 aa, Zea mays
  misc_feature: Ceres CLONE 1541136
  misc_feature (64)..(170): Pfam Name: Chloroa_b-bind Pfam Description: Chlorophyll A-B binding protein
  misc_feature: SWISSPROT Homolog: EC 2.7.11.1 Non-specific serine/threonine protein kinase
  misc_feature (127)..(127): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIPLRWGMLGALGCVFPELLARNGVKFGXGPVGQGPGPQIFSEGGLDYLGNPKPDPRPKHPPPLGPCQGGAYGAPSGGD

SEQ ID NO: 67223 - DNA, 813 bp, Zea mays
  misc_feature: Ceres CLONE 1541141-R2
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (12)..(12): n is a, c, t, g, unknown, or other
nnccattcnncnggcgccgcaggatgtttttgttttttgttatttttttttttttgctctctaattaccatgtccagtggcacaaataaataaatatccaagaagggttcatcatgacgctaggtcagattaagaaatagcactagactagatatattacagacattgaggaaattgccacttccaaaggatagggagagcaacgttaaacgtggacttcagaacatgattcagcgtaatctcagataatttagaacattgctactgaccacactaaaacactagagcacgtccagggatttagacatggaatcacatccatccaccaaaaccgacgaataatggtcaaaagagatgataaatcaccgcagacccttatctgattctaagcttctaatgttgcttcttgtcttttaatgggcccttcggaatctttgataggcatttctcgtcgaagatggcgtagtacctcttcagctcgaccatggccttctcaccaaaagcatcaaccttatcctcatgtttctcatacaggaccggtacagtgtacagtaccataaaaactatgtaaggacaggtgaggaaattgcagcagctcccaagaacagaaaggatccacagtcctgcaatcacctgacagtagagataagcacattagttacattcagaaagaactgccttaagtaacacaagtctatgcagaaaaaaaatccgcccggtcaacataacaatcagaaaattccttgaggtcaatggccttggccaattcttccctcaaagggagcaaaaaaccccctgttggatcttcatagt

SEQ ID NO: 67224 - DNA, 668 bp, Zea mays
  misc_feature: Ceres CLONE 1541141
  misc_feature: Encodes the peptide sequence at SEQ ID NO. 67225
ctccccgcggtggcggccgctctagaactagtggatcccccgggctgcaggaattcgtctcacccctagaaaaaaaggaaggcgaggggagccgagcgggcaaccggcggcgacagacatggcggagcagcacaaggaggagtcgggcgtgacagtgctggacaagatctccgacaagctccacgggcgcgggggcggctcgtcttcgtcgtcggactcggacgacgagcgctcgtcggcgacggccgccgtgaaggccaagatctaccgcatcttcgggcgcgagaagcccgtgcactccgtcctcggcggcggcaagcgtaagcccggacctcaactcctcatcctcaagcctcttctccgatctccactagagggccttcgtcttgtttggtctttatagagatgagatccaaccgctttggcgttgcttcacttgtcaagcgttggtgaactattattgatctgtagccgcatccatgtggacaaatgcaaattcctgggtagagatcttgggcgtctgggaaaccgctcgacttccgatccgatgtggtttgggtcaaatttctgcggcattgtctccacgatgcgagtatggcgcgaccagattactgtctctgtcgctgtaagatttgcctttacgccaggagtaagttatcgggctattc

SEQ ID NO: 67225 - protein, 94 aa, Zea mays
  misc_feature: Ceres CLONE 1541141
MAEQHKEESGVTVLDKISDKLHGRGGGSSSSSDSDDERSSATAAVKAKIYRIFGREKPVHSVLGGGKRKPGPQLLILKPLLRSPLEGLRLVWSL

SEQ ID NO: 67226 - DNA, 805 bp, Zea mays
  misc_feature: Ceres CLONE 1541141-R
aacatgtcacgtggcacaataaataaatatccaagaagggttcatcatgacgctaggtcagattaagaaatagcactagactagatatattacagacattgaggaaattgccacttccaaaggatagggagagcaacgttaaacgtggacttcagaacatgattcagcgtaatctcagataatttagaacattgctactgaccacactaaaacactagagcacgtccaggtatttagacatggaatcacatccatccaccaaaaccgacgaataatggtcaaaagagatgataaatcaccgcagacccttatctgattctaagcttctaatgttgcttcttgtcttttaatgggcccttcggaatctttgataggcatttctcgtcgaagatggcgtagtacctcttcagctcgaccatggccttctcaccaaaagcatcaaccttatcctcatgtttctcatacaggaccggtacagtgtacagtaccataaaaactatgtaagacaaggtgaggaaattgcagcagctcccaagaacagaaaggatccacagtcctgcaatcacctgacagtagagataagcacattagttacattcagaaagaactgccttaagtaacacaagtctatgcagaagaaaatccagccagtcaacatacaatcagaaatttcttgaggtcatgggcttgggccaatcctcctcagggtagcaaaaacccctggttgatcccataatcccaggggaaccgtgcaaacattcccaggccaggtcattctggggatcttcaccctcggggaaagttc

SEQ ID NO: 67227 - DNA, 692 bp, Zea mays
  misc_feature: Ceres CLONE 1541143
  misc_feature: Encodes the peptide sequence at SEQ ID NO. 67228
  misc_feature (221)..(221): n is a, c, t, g, unknown, or other
  misc_feature (224)..(224): n is a, c, t, g, unknown, or other
  misc_feature (317)..(317): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (406)..(406): n is a, c, t, g, unknown, or other
  misc_feature (408)..(408): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (425)..(425): n is a, c, t, g, unknown, or other
  misc_feature (444)..(444): n is a, c, t, g, unknown, or other
  misc_feature (690)..(690): n is a, c, t, g, unknown, or other
aagatggtagtcccgtccgtcgaggttgatatagaactagtggatcccccgggctgcaggaattcgtctcacccctagaaaaaacacacacacacacacactcacacactcaacagcaacagctaagcctctcccacaagacagcaacatggctgaggaggaggccaagaaggtggaggtggaggtcaccaaggagcccgaggcggcggcgaaagaggacntanccaatgacaaggccgtcatccccgcaaccgacccgccgccgccgccgccgccggccgacgactccaaggccctgggcatcgtcgaaaaaattncaaatgatcctgctcccgagaagcctgcccctgcgaagcaagtttgctccccccccagggaggggggggggggggaannntnaaaacananaaanannaactcttttnatcaaaacttgagaaaganaatgggaagagcggggcgggagaacaatgcttcttaaaaaactatcccctattcctttcttggggaaaacccaaaagaaggcaaacatatgaagctggaccggaaggaagattgaggggaccaactgggaaaaagaaaaacggttgaaatttggccgaggaaacatggaaaaaacacgggtgcgtaatgatcccccaagggaagcccgaagaaaaaagcgtggcctatggtgggagggcgaaaaancg

SEQ ID NO: 67228 - protein, 110 aa, Zea mays
  misc_feature: Ceres CLONE 1541143
  misc_feature (25)..(25): Xaa is any aa, unknown, or other
  misc_feature (26)..(26): Xaa is any aa, unknown, or other
  misc_feature (57)..(57): Xaa is any aa, unknown, or other
  misc_feature (83)..(83): Xaa is any aa, unknown, or other
  misc_feature (84)..(84): Xaa is any aa, unknown, or other
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (89)..(89): Xaa is any aa, unknown, or other
  misc_feature (93)..(93): Xaa is any aa, unknown, or other
  misc_feature (99)..(99): Xaa is any aa, unknown, or other
MAEEEAKKVEVEVTKEPEAAAKEDXXNDKAVIPATDPPPPPPPADDSKALGIVEKIXNDPAPEKPAPAKQVCSPPREGGGGEXXKXXXXNSFXQNLRKXMGRAGRENNAS

SEQ ID NO: 67229 - DNA, 652 bp, Zea mays
  misc_feature: Ceres CLONE 1541147
  misc_feature: Translation starting site: 339
  misc_feature: Pfam Name: GILT Pfam Description: Gamma interferon inducible lysosomal thiol reductase (GILT)
acccgcggtggcggccgctctagaactagtggatcccccgggctgcaggaattcgtctcacccctagaaaaaaaagggtgaaaggggaagggggagaataatctcggttttgggcacgcatactcacggcacgagcagctgagcgcccatggcacgtccccgtgcgtctcctactcctcgtcccgctgctcgtgctcctcggcgcgcacccgctctgcagtgcgggtccgcggaggaggggacgaacgtctccctggtagctctactacgagtcgttgtgcccgtactgctcgcggttcatcgtcaaccgcctcgcggggatattctaggacgggctgatgcacgccgtccacctccggctcgtcccctacggcaacgcgcgcgtcgcatccaacagcgaggatctcttgccagcatggtccgtacgagtgtctgctcaacaccgtggaagcttgcgccatcaactcctggccagatctggatgtgcatatcagcttcatctactgcgtggaggacctgctggtgaaacggcagaacacagactgggagtcctgcttctagaagctgggcctcgaccccaaccccgtaacagaatgcttcgaaagcgagcatggccacaagctcgagctcaaggacgccaaacaggaccgac

SEQ ID NO: 67230 - DNA, 629 bp, Zea mays
  misc_feature: Ceres CLONE 1541149
  misc_feature: Encodes the peptide sequence at SEQ ID NO. 67231
ggagctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaacta

SEQ ID NO: 67231 - protein, 164 aa, Zea mays
  misc_feature: Ceres CLONE 1541149
  misc_feature (83)..(164): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLN

SEQ ID NO: 67232 - DNA, 813 bp, Zea mays
  misc_feature: Ceres CLONE 1541150-R
  misc_feature (802)..(802): n is a, c, t, g, unknown, or other
cacgagtgtgtcatgtttcatgcccattaatggtgttccattaggaatgaaaataattagtcatcatcttaaaataacttgaaagatcctagacaatattttcaacctctgtcctgtttgaaatcaagttgtagtaatcagcaggctggagctcataaaagttgtcatctttcacatgatctgcactaggcaactttctggattgtagagcaaagttcttacttgaaaaaaacttgaatctcatgtccaagttcatctgactccctcatcaaaaagatcactcaacagtcgtcctggaacaaggcatccatcatttcaaacataaatctgctcataccaatcaattcctcaaatggctgcgccattgctcctcctcgccagcttggtccatttcgtgtggaatgaacctagacactagactcgacacatctttggaatctcggggagcagacttggtggcagggtgttcgtcttctccagcgttgcactaccaccgatttgtcgtcgcctcattcaagttcgtctcttctggctcagtatacgaggatgtactctgtcgatggaggttgacgtagccgacgtccttcccgacaaatctagcaggcggggagtcgatgggtcacgaatccaggactcagtgtcgtcctctgccagccagagaagagctccaaactagagaggcgggggaaagcattaaagatggcagcgcgggctgagcgacaggagataggggtgaatccgccatgggctgcgtgcacctatcgaaagggcgagtgcagggcactactgctacacggcatancggatgcactt

SEQ ID NO: 67233 - DNA, 629 bp, Zea mays
  misc_feature: Ceres CLONE 1541152
  misc_feature: Encodes the peptide sequence at SEQ ID NO. 67234
ctccccgcggtggcggccgctctagaactagtggatcccccgggctgcaggaattcgtctcacccctagaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcacgctcatcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaacagagctgga

SEQ ID NO: 67234 - protein, 166 aa, Zea mays
  misc_feature: Ceres CLONE 1541152
MSWFGHHHHNQPAPPASGPNQVFKIFCRANENYCLAVRDGAVVLAPVNPKDDHQHWYKDMRFSTRVKDEEGMPAFTLINKATGLAIKHSLGQSHPVKLAPFSPDQEDASVLWTESKDVGKGFRCIRMVNNTRLNFDAFHGDKDHGGVHDGTAVVLWEWCKGENRAG

SEQ ID NO: 67235 - DNA, 684 bp, Zea mays
  misc_feature: Ceres CLONE 1541162
  misc_feature: Encodes the peptide sequence at SEQ ID NO. 67236
agctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggccccctgcgacgccatcctcgtggcgagctccatcctgcaaatgctcaacctcgccaacctgcccaagaggtgcagattgggcaccccggccaaaaagaaactaaaaaaagggggctcccccaacaaaggccccccccccccccagtccaaatccgggagaaacctcaggcccccccgggtccaaggccggaaaaccccccaaagagggggttaagggccctaaaaaaaaaaacgggtaaacccttttttcccggc

SEQ ID NO: 67236 - protein, 161 aa, Zea mays
  misc_feature: Ceres CLONE 1541162
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPCDAILVASSILQMLNLANLPKRCRLGTPAKKKLKKGGSPNKGPPPPQSKSGRNLRPPRVQGRKTPQRGG

SEQ ID NO: 67237 - DNA, 673 bp, Zea mays
  misc_feature: Ceres CLONE 1541178
  misc_feature: Translation starting site: 193
  misc_feature (36)..(36): n is a, c, t, g, unknown, or other
  misc_feature (69)..(69): n is a, c, t, g, unknown, or other
tccccgcggtggcggccgctctagaactagtggatntcttgggctgcaggaattcgtctcacccctagnaaaaacctcagcctcacctgccttcccaatcaatcgcattctccgtccgcgacccaatccaggtgccgacagaccagataccagagcaaacaagaagccgtctcactccacgtcgcaagggaaatggccaccgcctcgctcgcactgctcgatcagacgctgctgccgtcccctctggcgtacaacggcggctccgaccgcctcagccaggagatcttctccatcctcgagtccaacttcctattcggcgcgtcgccgctggagggcggcgcgtgctccgcgggccgcgtccgcgtgcggggcggggcgggggtgccgacggcggcgctcttccccccccagcgctggtacggctcgagcgccgcctgcaggagctctccggcaaccccgcccggcgcgtcgcggacttcttcacctggcggccggcttccgcgcggggcgggttcctcgcgggggcggtggttcccgtggccggatgcccgcccaaggccgggcgcgacggtcttggcccaaaaccgggaggtccctgccccgggcgtggcggggggcccgaatgttccttccggggccccccaaggcccccgtttccggaaagggggttcgg

SEQ ID NO: 67238 - DNA, 713 bp, Zea mays
  misc_feature: Ceres CLONE 1541184
  misc_feature: Encodes the peptide sequence at SEQ ID NO. 67239
tggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgggctggctttggtgaacaaagcggggggcaacagccgccgggatccccctggcttggtcgacgaagaccaacccgctcgcgcctcgaaatcgttttctaaaccttcactcttgttgaacaaaggcaagggcccttccctaaagccttgaaaaaaggaatgttatccaggagccctaactttcgtggccttatacgaagccagggcaacgccctccttggcccccctccaagaagaaacacgggccgccaacgtttctccgttcgggggaggattgtttaattcccggttgggccccgtggggggaacacaaacgttcgggctccccttatccttccccgcgctac

SEQ ID NO: 67239 - protein, 102 aa, Zea mays
  misc_feature: Ceres CLONE 1541184
MKGGTQAVSLMVHLAVPWLCLASWAALLPALASGNVGAAAPILRADYIKLNFSTASATPDKYKSFIASVRAGFGEQSGGQQPPGSPWLGRRRPTRSRLEIVF

SEQ ID NO: 67240 - DNA, 661 bp, Zea mays
  misc_feature: Ceres CLONE 1541186
  misc_feature: Encodes the peptide sequence at SEQ ID NO. 67241
  misc_feature (661)..(661): n is a, c, t, g, unknown, or other
ctagaactagtggatcccccgggctgcaggaattcgtctcacccctagaaaaagtgcacaagcacaacacaacggccaccaccggaccaccggccctcgcaggtcgcgcaaccatttcccttggaaaacaacgcgcccacccgagcccggccggccccaaccactccaaccaaaccaaagcccaaacccgctttcccccgaaacccaggccctcgcgtcatttgatgcgattccggcggcgatcgtcagcgcctccaacaccacccgctcccccgtcctagcgtgcgttcgggcgatcgcccctctcgcggcggtcatggctggcgttggcggcggggcgcgcagctcagacagggcgggggcggcgcgctcgccaacaccaccaccagcaccaccacggggatccagtccaccatccagtcgatcaacgaggtcgtcgtcggccactccgacgccgacatcttggaccccccccgcgagtctaacctggaccccaacgagacggggcaaaagctgctgaatcaaaatccatttcaggaagggaaaagaaaaatgggacagaaagaaggagagtgctgggccaaaaaagccttgcctgatagtcctggaaaaagtggaccagaaccccttaatgggtggagggccccatcccccacagggn

SEQ ID NO: 67241 - protein, 36 aa, Zea mays
  misc_feature: Ceres CLONE 1541186
MGQKEGECWAKKALPDSPGKSGPEPLNGWRAPSPTG

SEQ ID NO: 67242 - DNA, 707 bp, Zea mays
  misc_feature: Ceres CLONE 1541188
  misc_feature: Encodes the peptide sequence at SEQ ID NO. 67243
  misc_feature (48)..(48): n is a, c, t, g, unknown, or other
  misc_feature (74)..(74): n is a, c, t, g, unknown, or other
ggagctccccgcggtggcggccgctctagaactagtggatttcttggnctgcaggaattcgtctcacccctagnaaaggccaccgccttcttcaaccctccttccgtcttcctcctctagtcttacctcgttgcacctcaagaaacttggcgcgcaaccaggaaaccccctcttctctctctctctctctctctctctctctgccttctgattccaagctccccaactgcccagcaccaacctgccgaactcccctcctttttgttggtttgtccaattataaattgagcccggccggctgactaccatgaagccgccatcactggtgcactgcttcaagctgctggtcctgctggcgctcccccggctgaccatgggggtccccgacgaggacatgctatcgccccttggggggctgcgcctcgacggtcatttcagcttccctgacgtcccccgcttggcgggggaatttcgcaacaagtgcagcttcctggcggccgccgtgctcccccccggttccgctcttccgaatccccccccccctggaagggaccgtctttcccctggggggaggggttctacgcttcacccgtcgcggggccaccgggcttggaacctctccccctggggtccaatcgccggtcccctcccagaggaatcctggtccccgatttgagttccccccccggggaggccctggcgccccg

SEQ ID NO: 67243 - protein, 122 aa, Zea mays
  misc_feature: Ceres CLONE 1541188
MKPPSLVHCFKLLVLLALPRLTMGVPDEDMLSPLGGLRLDGHFSFPDVPRLAGEFRNKCSFLAAAVLPPGSALPNPPPPGRDRLSPGGRGSTLHPSRGHRAWNLSPWGPIAGPLPEESWSPI

SEQ ID NO: 67244 - DNA, 733 bp, Zea mays
  misc_feature: Ceres CLONE 1541193
  misc_feature: Encodes the peptide sequence at SEQ ID NO. 67245
tcccccgggctgcaggaattcgtctcacccctagaaaaaaaatgaaacccgcactcgcccaaaaccctactgctcccgctccgctcctgcttggtcgagatcacttctccgccgccgctttcgagatctccgggtggagcaagcgagcaaaggctgcagccatgtcgctccgcgtgctgaaccctaacgccgaggtgctcaacaagtcggcagcgctgcacatgaacatcaacgccgccaagggcctccaggacgtgctcaagaccaaccttcggcctcaagggcaccaatcaagatgcctgctgggtggagctggtgtttttaaatcttgataaggaggggggagacccctctttaaatgtaatggtaaattccaaaacccaactgccaattattgattggccaaggacgggttgctttggtctcggtgcacattttttggggtattagcccacaactttctacgtgggcttattttctctcggggaagtaacgcgaagatactttttcaccccgggggatgtccatcgaatgataactcacctaccaaatatctcccggctttactggttttttcactactccccccatcactctcctctgttctttcctatcatcccctcttttaagttcaccaccatcccctcgcccatctgcatgctcgtgtatccaccttcaccacttaatacctcctgtaaatacggtgtccttctaaaattcactcccttttctg

SEQ ID NO: 67245 - protein, 56 aa, Zea mays
  misc_feature: Ceres CLONE 1541193
MSLRVLNPNAEVLNKSAALHMNINAAKGLQDVLKTNLRPQGHQSRCLLGGAGVFKS

SEQ ID NO: 67246 - DNA, 894 bp, Zea mays
  misc_feature: Ceres CLONE 1541195
  misc_feature (7)..(7): n is a, c, t, g, unknown, or other
  misc_feature (8)..(8): n is a, c, t, g, unknown, or other
  misc_feature (21)..(21): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (68)..(68): n is a, c, t, g, unknown, or other
  misc_feature (386)..(386): n is a, c, t, g, unknown, or other
  misc_feature (464)..(464): n is a, c, t, g, unknown, or other
  misc_feature (475)..(475): n is a, c, t, g, unknown, or other
ccttttnntttttacctttcnctcttncgnnnnnnnnggggacactnnnnggaaacttaagtctacgncgtggcgggcgctctagactagtggatcccccgggctgcaggaattcgtctcacccctagaaaaagatagggacagccgctgcctccctacggctggtgcccaggtgtcctttgccggcgaccagcacccggggtatgggaatggaggtgggtggtgctgaaccagcacccgcagaggtcaaaatttccgatggagaagtgaatctattcccagagaaggcaaaccaaccgcctgccacagagcgtgactacccagctttttttggttctcaccacatggggggaggtcattggttctggcactttttttaaaatggnaaaggatgatttgggtctgcaccctattttttttttcccccccccccagggggggagaagaaggggggtcctttttcnttttttttttnattttacccccctcccgtttcgggggagaggaaaaaaacctccgcttttccccggatcgcggggaggcgcggccccccctttcccccccccacttatctggcgcgcccgtgatctgtttgtcctttgcacctgtctcacaaacgctctcgcctgttattctgtcttccttacaccattcctaccggctttttttctgtgtttgggctggagggcctgctcccctccttcttcacttatgtacctcctggctgactccctttgctttctaacacccctgttcctgtccagctcccccactcccgacgttccccctatcctccacaccctctcgggcaccgtcgcatacggcaccatgcccttcttgcgcgctcacgtatgtgggggtaggctctctcctctttgaggcgcctttctcgtg

SEQ ID NO: 67247 - DNA, 710 bp, Zea mays
  misc_feature: Ceres CLONE 1541199
  misc_feature: Encodes the peptide sequence at SEQ ID NO. 67248
  misc_feature (44)..(44): n is a, c, t, g, unknown, or other
  misc_feature (276)..(276): n is a, c, t, g, unknown, or other
  misc_feature (389)..(389): n is a, c, t, g, unknown, or other
ctccccgcggtggcggccgctctagaactagtggatctctgggnctgcaggaattcgtctcacccctagaaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgangagcactacgccgatctcgcctccaagcccttcttccaggcctcgtggactacatcatctctggccctgtggtggtcatggcctcgcagggcagggggggtggtcacacctgnccccaaaatcatttcccccccccaacccccttggccttctgagcccgggcacccattcgggggcgactttggctgtccacctttggcaggaatgtcattcctggggaatgacccccctttgagagggctattaagggaattggccccggggggtcccccaaggggccccgcctaattgggaaaacccccccccccccctgtggttttccaagaaatgaacatgggaaatgtttccctctcaaacctttgggaagcccaagagaacctttgccccccttttggctctttaacagtgttttccaaaaaaaatttatatctggt

SEQ ID NO: 67248 - protein, 141 aa, Zea mays
  misc_feature: Ceres CLONE 1541199
  misc_feature (2)..(112): Pfam Name: NDK Pfam Description: Nucleoside diphosphate kinase
  misc_feature: SWISSPROT Homolog: EC 2.7.4.6 Nucleoside-diphosphate kinase
  misc_feature (46)..(46): Xaa is any aa, unknown, or other
  misc_feature (84)..(84): Xaa is any aa, unknown, or other
MESTFIMIKPDGVQRGLIGEIISRFEKKGFYLKALKLVNVERSFAXEHYADLASKPFFQASWTTSSLALWWSWPRRAGGVVTPXPKIISPPQPPWPSEPGHPFGGDFGCPPLAGMSFLGNDPPLRGLLRELAPGGPPRGPA

SEQ ID NO: 67249 - DNA, 711 bp, Zea mays
  misc_feature: Ceres CLONE 1541205
  misc_feature: Encodes the peptide sequence at SEQ ID NO. 67250
  misc_feature (711)..(711): n is a, c, t, g, unknown, or other
aagctggagctccccgcggtggcggccgctctagaactagtggatcccccgggctgcaggaattcgtctcacccctagaaaaaaaaaataatctgaaccattttacttctacggcttcaactcactcaaaccattctgttagtattgagtctcttgaggattctgttgctgatgccagaagcaataaggaacgtgctgcccatgccgtcgtcctgatgctgttgctcggatttgaccgcagacgcctccaagtccaaggtgacactgtagggatgaaaacggtcagaaacggaacgtgctgcccatgccgtcgtcctgatgctgttgctcggatttgaccgcagacgcctccaagtccaagaatgatctgttaccttctatagaattggttacaaaaatgatagaggatgttgagcttctagaagaaaaggctaaagtggccaaacatgaattgtccgttgctgggacaggcattctggcaaaagttgaggagctcagagaaatgataacttatgcgaaggaagcaaatgatatgcatgctggtgaggttttaggcgagaaagctattttaaccacagaggcacgtgagcttctatcacgacatcagaggctttcggatgagaggaataaatatctggtgataattgaagagatacaccaaattcttgctgaaagattggttgctgcacaacaagaaattgcagcagctgn

SEQ ID NO: 67250 - protein, 104 aa, Zea mays
  misc_feature: Ceres CLONE 1541205
MIEDVELLEEKAKVAKHELSVAGTGILAKVEELREMITYAKEANDMHAGEVLGEKAILTTEARELLSRHQRLSDERNKYLVIIEEIHQILAERLVAAQQEIAAA

SEQ ID NO: 67251 - DNA, 700 bp, Zea mays
  misc_feature: Ceres CLONE 1541206
  misc_feature: Translation starting site: 229
  misc_feature (463)..(463): n is a, c, t, g, unknown, or other
  misc_feature (490)..(490): n is a, c, t, g, unknown, or other
ctggagctcaccgcggtggcggccgctctagaactagtggatcccccgggctgcaggaattcgtctcacccctagaaaaagccccaaaccaaaaaccttccccgtattggagtccgcatcgctcgctagtcacctaccgcaccgccaccgccaccgccgccgccgccagcgcgcccgtctcgcacgcgcagcacaggacgcgcgcgatcccctcgcgtccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctctggtccccctgcccgtccggcccggggggcaggctgcccccgcccccgccgccgcgatcgtacggcggcggcggcggatctggtggcacgnaaaaaacctcggggcgggggccgcccncggcgggggcatcctcgggctcttcctcgccgggtgggccgcccgggtcgccgcggacccgcagttccctttcaagggctcatggaggagctcgtgggcgtcacccgcgtgcgtgctgggcgacatggcctccccccccaaccttcggccttcaaggaggctcgacttcgtccttctccaccctccgtggtggggttccattcctaaatt

SEQ ID NO: 67252 - DNA, 660 bp, Zea mays
  misc_feature: Ceres CLONE 1541213
  misc_feature: Encodes the peptide sequence at SEQ ID NO. 67253
  misc_feature (406)..(406): n is a, c, t, g, unknown, or other
ctccccgcggtggcggccgctctagaactagtggatcccccgggctgcaggaattcgtctcacccctagaaaaaaaaaaaaccctatcctccccagtccccaccactccaccaccctctccccgcctcccgctgcgaccaccgtacccgcgaacttggcgggccgctcggcgctgcacaccaagccggggatggccgccgcgcttgcgagctcgccgcttgttcacctaactacctcccgcctccgcctccccaggccccaggcctccgcttccagttcgggtccagtctgctcgatcggcgtgtgcttgggatggaggctcaaggtcgggtggagagccctgaggcggcgcgaccggcttcgatgcttctccaccgacgggggcggcggggaagaaggggaaaancgtggcgaggaagaggcatcggcaacggcggcggcatccccggcctcggttccagcggagacacggtgggcgctggggaagagctgccgtccgagcggagtcggtcaggaaagctttcttcctcctcctcgtcgtccgggactcctggggtatcaagtgagccacgctggtggattttagggttgaaaataatccataccgttaaactggtgggaacttctaggccccgaaaagggtgatcccgtttgatgtca

SEQ ID NO: 67253 - protein, 131 aa, Zea mays
  misc_feature: Ceres CLONE 1541213
  misc_feature (72)..(72): Xaa is any aa, unknown, or other
MAAALASSPLVHLTTSRLRLPRPQASASSSGPVCSIGVCLGWRLKVGWRALRRRDRLRCFSTDGGGGEEGEXRGEEEASATAAASPASVPAETRWALGKSCRPSGVGQESFLPPPRRPGLLGYQVSHAGGF

SEQ ID NO: 67254 - DNA, 692 bp, Zea mays
  misc_feature: Ceres CLONE 1541219
  misc_feature: Encodes the peptide sequence at SEQ ID NO. 67255
  misc_feature (398)..(398): n is a, c, t, g, unknown, or other
  misc_feature (420)..(420): n is a, c, t, g, unknown, or other
  misc_feature (588)..(588): n is a, c, t, g, unknown, or other
aaagctggagctccccgcggtggcggccgctctagaactagtggatcccccgggctgcaggaattcgtctcacccctagaaaacgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaagcgaagctgaaggtggcgatcaaacggctcngccgcatcggccggaaactccntcggtgctggcacggccgcgaggactcgccgatcgacgtcgtcgtcgtgaacgacggcggaagcgtcaaggacgcgtccccacctcctcaagtacgactcgatggctcgggaccctttaaagggcccaaagttccaaaaaaatgggtgggacagaaaaaaccgggaancctattagggttcgaagggaaaccccatcaggggccgtctcccaaaaagaaccccccaaaagctccccgggggggaaaaccccggatttgaaacaccccccccg

SEQ ID NO: 67255 - protein, 183 aa, Zea mays
  misc_feature: Ceres CLONE 1541219
  misc_feature: SWISSPROT Homolog: EC 1.2.1.13 Glyceraldehyde-3-phosphate dehydrogenase (NADP(+)) (phosphorylating)
  misc_feature (91)..(91): Xaa is any aa, unknown, or other
  misc_feature (98)..(98): Xaa is any aa, unknown, or other
  misc_feature (154)..(154): Xaa is any aa, unknown, or other
MATHAALAASRIPAGARLHSRAPASSRHGVQRLDFADFSGLRPGSCSVSAAAREASFSDVLGAQLVAKATGENAVRAPAEAKLKVAIKRLXRIGRKLXRCWHGREDSPIDVVVVNDGGSVKDASPPPQVRLDGSGPFKGPKVPKKWVGQKKPGXLLGFEGKPHQGPSPKKNPPKAPRGGKPRI

SEQ ID NO: 67256 - DNA, 638 bp, Zea mays
  misc_feature: Ceres CLONE 1541220
  misc_feature: Encodes the peptide sequence at SEQ ID NO. 67257
tggagctccccgcggtggcggccgctctagaactagtggatcccccgggctgcaggaattcgtctcacccctagaaaaaaaaaaaaccaggcaaacggttcacacgttcgaaccccatatggctgaacccaagtcaaataatggcggggcggacacgacggcatcgatgatgctccacggccgcgtagccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggcgagagccagcagccgcgagccatcgcggtcgaggcggacgtgtccgacgcggcagccgtgaaggcgctgttcgacgcggccgccgcagccttcggcggggagctccacatcctggtaacgttggcggcggtgctggactactcctacccgccgctggcggagaccagcgaggcgacgttcgacgccgccttcagcgtcaacacacggggcaccttcctgtgctgccgcgaggcggccaggcggctggtgcgtgacggccgcggccgaatcgtgacgttctcttcgtcgggagttgggtctc

SEQ ID NO: 67257 - protein, 173 aa, Zea mays
  misc_feature: Ceres CLONE 1541220
  misc_feature (22)..(173): Pfam Name: adh_short Pfam Description: short chain dehydrogenase
  misc_feature: SWISSPROT Homolog: EC 1.1.1.140 Sorbitol-6-phosphate 2-dehydrogenase
MAEPKSNNGGADTTASMMLHGRVAIVTGGAGGIGSAVSKHLSSLGARVVVGYIGDPAPALTLVAAINSSEHPGESQQPRAIAVEADVSDAAAVKALFDAAAAAFGGELHILVTLAAVLDYSYPPLAETSEATFDAAFSVNTRGTFLCCREAARRLVRDGRGRIVTFSSSGVGS

SEQ ID NO: 67258 - DNA, 668 bp, Zea mays
  misc_feature: Ceres CLONE 1541225
  misc_feature: Encodes the peptide sequence at SEQ ID NO. 67259
  misc_feature (563)..(563): n is a, c, t, g, unknown, or other
  misc_feature (564)..(564): n is a, c, t, g, unknown, or other
  misc_feature (571)..(571): n is a, c, t, g, unknown, or other
ctccccgcggtggcggccgctctagaactagtggatcccccgggctgcaggaattcgtctcacccctagaaaaaacagcagcacgggcgccagcgccatcctgatctcgctatctcccttctcccccgatgcgatctcgccaaaccctaatcccgccgcccgccgcgcggccgtcgccggagccctagccccgaatgtggcggtgacgcgcgcggcgtgtcaccaccaccaccaactcagcgagcgtgcgcgcccgccacgccacgccacgccaccgcccgtcgtgccggccgacaccgagcagccatgggcgccgccgacaagtggctgctcccgctcgtctccgtctccgtcgtctcgctcctgctcttcctctccgcgctctcgggcttctccgcctcctccgcgctcttcgcgcgcctcccgccgccctcctacgtgcgccggggcgccgccgcgccgccctcctttcgcctactgctcgcgggcggccgaggggacggcaagaagctcctgcggctgctccctcgcgtctaccacccaggaaccgctacttggctcannctctcgncgaacgcgcggattccgagcgcgccgagctcgccgcgggcgccgggggcgccggtcccgccgtgggcgccttcgggacgttcatgtcgtgggagggc

SEQ ID NO: 67259 - protein, 120 aa, Zea mays
  misc_feature: Ceres CLONE 1541225
  misc_feature (86)..(86): Xaa is any aa, unknown, or other
  misc_feature (89)..(89): Xaa is any aa, unknown, or other
MGAADKWLLPLVSVSVVSLLLFLSALSGFSASSALFARLPPPSYVRRGAAAPPSFRLLLAGGRGDGKKLLRLLPRVYHPGTATWLXLSXNARIPSAPSSPRAPGAPVPPWAPSGRSCRGR

SEQ ID NO: 67260 - DNA, 671 bp, Zea mays
  misc_feature: Ceres CLONE 1541229
  misc_feature: Encodes the peptide sequence at SEQ ID NO. 67261
  misc_feature (386)..(386): n is a, c, t, g, unknown, or other
  misc_feature (393)..(393): n is a, c, t, g, unknown, or other
  misc_feature (409)..(409): n is a, c, t, g, unknown, or other
  misc_feature (671)..(671): n is a, c, t, g, unknown, or other
gagctccccgcggtggcggccgctctagaactagtggatcccccgggctgcaggaattcgtctcacccctagaaaaagctcaggcgagcagcggagccgagcagagcctcgagatcccgcccaccatttgccctccggccgacgcggagccgatcgcttcaccggcagcgaggacgatgggttccgtcgcggaggactccaccgcggcagcggcagcagcggcgtcggtagtgttccgctccaagctacccgacatcgagatcccgcggaacctctcgctgcaggcctactgcttcgagcggctccccgaggtgtcctcccgcccctgcctcatcgacgggcagacgggcgccgtgcacacctacgccgaggtggacggcctgtcncgctccncggcggcggccctgcncgggctcggggtggcaggggcgacgtggtgatggcgctgctccccacctgccccgagttcgcctgggtcttcctcggggcggcgcggctggggcgccccacccccccgggccaccccggtctacacccccgcaggagatccccccgccgggggggccccggggggggcccagggtgggccgtcacccgaggcctgggcccgttcaaaagggggccgggggttctccccccaagccgcggggtggccggggggccccctccan

SEQ ID NO: 67261 - protein, 87 aa, Zea mays
  misc_feature: Ceres CLONE 1541229
  misc_feature: SWISSPROT Homolog: EC 6.2.1.12 4-coumarate--CoA ligase
  misc_feature (73)..(73): Xaa is any aa, unknown, or other
  misc_feature (78)..(78): Xaa is any aa, unknown, or other
MGSVAEDSTAAAAAAASVVFRSKLPDIEIPRNLSLQAYCFERLPEVSSRPCLIDGQTGAVHTYAEVDGLSRSXAAALXGLGVAGATW

SEQ ID NO: 67262 - DNA, 647 bp, Zea mays
  misc_feature: Ceres CLONE 1541232
  misc_feature: Encodes the peptide sequence at SEQ ID NO. 67263
gctctagaactagtggatcccccgggctgcaggaattcgtctcacccctagaaaaaacccacctgacttcgcgcgccacgccgagcctgcgagccatctgcccatctcccacccaacccctcgccacgcagatctagggagcttgccctcccaccgggcggtgattcttccgtcccatcaccgatgcggacgccggcgatgctccggtgggccgcggcgctcgcggtcctgctcgccgtcgccgcgccggccgccgggttctacctccccggggttgccccgagcgatttcgcgaacggtgatccgcttcccgtgaaggtgaataagttgacttctatcacgactctactctcgtatacctattattcccttccgttctgcaagccagaaaccctagtcgacaggtgccgaaaatcttggggaagtaccccgcggcgatcggcttgagaactccccttatggggtccaagtgggaagagtccagaagtgtccgaattgttcgcgtaacaccgatcactggcaaacgaagctagggagttcttggataacgtttgggggaacaattacccgactgaacaatggatccttgttcccccctccccgttttgtcggttcccgggttaccggggaaatgttcgcgaaccgtg

SEQ ID NO: 67263 - protein, 87 aa, Zea mays
  misc_feature: Ceres CLONE 1541232
MRTPAMLRWAAALAVLLAVAAPAAGFYLPGVAPSDFANGDPLPVKVNKLTSITTLLSYTYYSLPFCKPETLVDRCRKSWGSTPRRSA

SEQ ID NO: 67264 - DNA, 703 bp, Zea mays
  misc_feature: Ceres CLONE 1541233
ctccccgcggtggcggccgctctagaactagtggatcccccgggctgcaggaattcgtctcacccctagaaaaaaaaccaaacccagctcaggcacaaccccaacgcaccgccgccgctcgcctggcctcacctcgccggagaagagttataagacaggagaaccccgtccccggggcgcaggcctcggcagcttccgtgaccaccgcccaatcctgccacagctgccctccctcctcccctctgggcgtggccgagttgtaggcatcacggctagcgttgcagccccccggcgcggccccgcagctgcgcaggtggagcccacgggcaccatcgcctccgctgtcgcgtccagccccgctccgcacggcggccgcggggcgctgccctcggccggaggaaaccccccccatctcctcttcctcgccggcggcggtcgcctctgagccgttcctgtctctcaccttcttcccttcctagcaattagtccccttctgctaacccccccggacccccgacgagttctcccccccaagagtaactgaccgacctacccggcatggaagttaaacctgaaccctcagggaggggggcccacccgttgtcttccaacttccagggaggaccccccaacgagcccgcgccccggggcttcgcgggagggaactgccttcggtggaacgtgttgcctgtgcctggtttcc

SEQ ID NO: 67265 - DNA, 681 bp, Zea mays
  misc_feature: Ceres CLONE 1541237
ctccccgcggtggcggccgctctagaactagtggatcccccgggctgcaggaattcgtctcacccctagaaatagtgccagcgccagcggagaaaagaaacagagttcgaccggccccgccctgccccggtgggccggtgcccccccaccgcagcgcccgcgaagccgccaaacaccaccacctatatccgccagaagcctcttcctccctcgctctcccccaccggcgcgctgccaatggccgcgtggtgaagcgcacccgacggaagaagcaggcaccaacacccaagccccctgtgccctcgccgtcgccgcccgcgcaagattgagatcccggattcagacaggtgctaccattcgatttgatttggcgtggagcactttcctatgggcgcctccaatcgcgcctcgtccttctttccagggtcaccggcccccggccgctctaagaacggccttggggagcgcccaaatacctggaacctccccggcgtaacgccaaaaccgaaagctcctttaatgcccttagggcaaaaaaaaaccccccccccctttcggtcccccaaaataaaagtgggggcaaaaccccccgtgtgccgatggggaaacaaaaaacccttcccttttttgggtgccaaaaaaatttttttaaacaagctttcccaaattgggaaatttcct

SEQ ID NO: 67266 - DNA, 591 bp, Zea mays
  misc_feature: Ceres CLONE 1541239
  misc_feature: Encodes the peptide sequence at SEQ ID NO. 67267
gcggtggcggccgctctagactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcgggggccgccgccagcaggaggacccgcggccgcctgtcctcccggtccggctcccggcggcccgtgcgggtgccgaggatcagctgcagcgccacccaaggaggtccagcggcgcctggtcgtcccgtcaccggggaggaggaggctgacggtgaacggcccccgtggaagcgctccccggccctccgggcaaatgtacttcccgcgccgccgctaacaaacttcgggaacc

SEQ ID NO: 67267 - protein, 107 aa, Zea mays
  misc_feature: Ceres CLONE 1541239
MMNLNLKQPLVLPAHHSNVVGSRLSSPSPSGAAASRRTRGRLSSRSGSRRPVRVPRISCSATQGGPAAPGRPVTGEEEADGERPPWKRSPALRANVLPAPPLTNFGN

SEQ ID NO: 67268 - DNA, 644 bp, Zea mays
  misc_feature: Ceres CLONE 1541243
  misc_feature: Encodes the peptide sequence at SEQ ID NO. 67269
  misc_feature (284)..(284): n is a, c, t, g, unknown, or other
  misc_feature (291)..(291): n is a, c, t, g, unknown, or other
  misc_feature (292)..(292): n is a, c, t, g, unknown, or other
  misc_feature (360)..(360): n is a, c, t, g, unknown, or other
  misc_feature (394)..(394): n is a, c, t, g, unknown, or other
ggagctccccgcggtggcggccgctctagaactagtggatcccccgggctgcaggaattcgtctcacccctagaaaaacccgaaagctaagggagacgagcagcctaaaaaccctagcccccgaatcagatcccaccgcccgccggaacgcggaaccctgcccccggccgccatggagatgagcgatgcggagcggctgttcttcttcgagatggcctgcaacaactccgaggtcgcgtacgagcagaaccccaacgacgccgacaacttgacgcgatggggcnggagcgnnctgctggagctatcacagatgcgtaacggccccgacagccctcagctccctccagatgcggaaagccnagctgggaggaggcactgcaaattgatccccacnagtctgatgccttcctgtgcctgggaaatgctccaactttccatggatcttccatcccaaaactgcatgggcaatggagttcctttggaagggaactgaatgtttcccaaaaggtttccaatgtgaaaccccccaataggccttccgggaaggctttttaactttttccccaaagggccccctaaattccccccggggaaaccctctgggggaaatggtgttttttaggggggggcaaaaaaaaattctt

SEQ ID NO: 67269 - protein, 106 aa, Zea mays
  misc_feature: Ceres CLONE 1541243
  misc_feature (6)..(106): Pfam Name: TOM20_plant Pfam Description: Plant specific mitochondrial import receptor subunit TOM20
  misc_feature (38)..(38): Xaa is any aa, unknown, or other
  misc_feature (40)..(40): Xaa is any aa, unknown, or other
  misc_feature (63)..(63): Xaa is any aa, unknown, or other
MEMSDAERLFFFEMACNNSEVAYEQNPNDADNLTRWGXSXLLELSQMRNGPDSPQLPPDAESXAGRRHCKLIPTSLMPSCAWEMLQLSMDLPSQNCMGNGVPLEGN

SEQ ID NO: 67270 - DNA, 736 bp, Zea mays
  misc_feature: Ceres CLONE 1541244
  misc_feature: Encodes the peptide sequence at SEQ ID NO. 67271
  misc_feature (32)..(32): n is a, c, t, g, unknown, or other
  misc_feature (624)..(624): n is a, c, t, g, unknown, or other
  misc_feature (736)..(736): n is a, c, t, g, unknown, or other
ggcggccgctctagactagtggatctcccggnctgcaggaattcgtctcacccctagaaaaaagctttcccccttttttcctgcccacatacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggtggctgcccccgcgcctcatgcgggggttctcgtccaagatcgagcccaataaattgggggttggcctcatcccccgatgatgcctcgcgctccttacttaagtctgcctcggcaaggggcggggaaatccactcccctgttctttgctagattcggccaacccctccccgcccgaattaagaaaaaaagcggccgccacccttcttccaaaaccttcccttgccggataaccggaaaccaattccccccacacagaagaccctttggtaccgggggcgccgacctacccagcaaccccccccggaacggcctgtaatggggcccgcgagagcgcctcatagaaataccgtggtgtcccaggaaacccagctccccaccncgacaaagtaatctggttcctgtgaagtccgcgaaaagatctgccggttttggctaccctcgccatggacgcacgtgggcaacttggccgtccgcccctcggttcgcctacn

SEQ ID NO: 67271 - protein, 43 aa, Zea mays
  misc_feature: Ceres CLONE 1541244
MTSTAYSRSSKLPGGERWLPPRLMRGFSSKIEPNKLGVGLIPR

SEQ ID NO: 67272 - DNA, 717 bp, Zea mays
  misc_feature: Ceres CLONE 1541251
  misc_feature: Encodes the peptide sequence at SEQ ID NO. 67273
  misc_feature (36)..(36): n is a, c, t, g, unknown, or other
gtggcggccgctctagaactagtggatcccccgggnctgcaggaattcgtctcacccctagaaaaagcgatctcaagcgactagtcgaaggcggcggcggcgatggggagcgaccaggagacggagaagaagaagaccccggtggcgctaatgcccatcgcgaagcccctcgcaggaaagaagctctgcaagcggaccctcaagctcgtgcgacgagcctctgaggccaagtgcctcaagcgcggagtcaaagaggtagtcaagagcattctccgcgggaacaaagggttgtgtgtgattgctggaaatatttctcctattgatgtgattacacacgttccaatactatgtgaggaatttagtgggggggggggatttgttccatcaaaagaggatcttgggaccgcccgaacccctaaaaggcccactttgttgcgtcccgggttcttacccaaacccaaaaagggggggaactcattggaccagggtggaaggataaacttgaagtcccgacctttgacccaagtttgtaccggaaagttgcctgagggctacattcggcaagggttccaaggggccttttcggggggcccccccccttccggagaaatcccggcggcctcccttccttgggcggcatctagggaacctgggtatccccggggggcttcggccctcggttttggtgcaaccccggcccccgtttttcctttttcc

SEQ ID NO: 67273 - protein, 205 aa, Zea mays
  misc_feature: Ceres CLONE 1541251
  misc_feature (30)..(120): Pfam Name: Ribosomal_L7Ae Pfam Description: Ribosomal protein L7Ae/L30e/S12e/Gadd45 family
MGSDQETEKKKTPVALMPIAKPLAGKKLCKRTLKLVRRASEAKCLKRGVKEVVKSILRGNKGLCVIAGNISPIDVITHVPILCEEFSGGGGFVPSKEDLGTARTPKRPTLLRPGFLPKPKKGGNSLDQGGRINLKSRPLTQVCTGKLPEGYIRQGFQGAFSGGPPPSGEIPAASLPWAASREPGYPRGASALGFGATPAPVFPFS

SEQ ID NO: 67274 - DNA, 693 bp, Zea mays
  misc_feature: Ceres CLONE 1541253
  misc_feature: Encodes the peptide sequence at SEQ ID NO. 67275
  misc_feature (401)..(401): n is a, c, t, g, unknown, or other
  misc_feature (412)..(412): n is a, c, t, g, unknown, or other
  misc_feature (494)..(494): n is a, c, t, g, unknown, or other
ctcaccgcggtggcggccgctctagaactagtggatcccccgggctgcaggaattcgtctcacccctagaaaaatccgaaaccaactgacatcgccccgcagccaagaagctcggctcggctcagctcagctcagttggttcctccattttgagtggaggactgactgtcctcccgtcggccgtctcgcgatgctgatggggttccccgtggggtactcggagacgcccaagctgctgctgcacctcctcttcctcctcgaccacctgcgccgcctctcctcctggctgctccgcctcgcgggcgccgccgacgccgacgccgacaccgacgccggccaccctcgccacccctgcgcccgcgcccagcgcctggaggagcactcccccgcggtgcgcttcnactcgctgtcntgcggaaagcgagaaggggtgatggcgccgcgcccgctgcccgagggctgctgcgtctgcctgggcgactccacgcccgcgncgagtggcgcgcgcccggggctgccgccacgttttccaccgggcttgcctgaccggtgggcccggccaggccaccgcacttggccgttttgcggaaaccggttcttccccccgttgccgttgccgtgcccctgccccctccgttgccccgttttaagaaccggaatccccccccccggtgggccctttggcaaaaaaaa

SEQ ID NO: 67275 - protein, 167 aa, Zea mays
  misc_feature: Ceres CLONE 1541253
  misc_feature (71)..(71): Xaa is any aa, unknown, or other
  misc_feature (102)..(102): Xaa is any aa, unknown, or other
MLMGFPVGYSETPKLLLHLLFLLDHLRRLSSWLLRLAGAADADADTDAGHPRHPCARAQRLEEHSPAVRFXSLSCGKREGVMAPRPLPEGCCVCLGDSTPAXSGARPGLPPRFPPGLPDRWARPGHRTWPFCGNRFFPPLPLPCPCPLRCPVLRTGIPPPGGPFGKK

SEQ ID NO: 67276 - DNA, 720 bp, Zea mays
  misc_feature: Ceres CLONE 1541258
  misc_feature: Encodes the peptide sequence at SEQ ID NO. 67277
  misc_feature (504)..(504): n is a, c, t, g, unknown, or other
  misc_feature (505)..(505): n is a, c, t, g, unknown, or other
  misc_feature (546)..(546): n is a, c, t, g, unknown, or other
  misc_feature (580)..(580): n is a, c, t, g, unknown, or other
  misc_feature (673)..(673): n is a, c, t, g, unknown, or other
ctggagctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatcccactccgctgggccatgctgggcgcgttgggctgcgtgttcccggagctgctcgcccgnncacgcgtcaagttcggcgaggccgtgtgggtcaaggccggntcgcagatcttcagcgagggtgggctggactacntcgggaaccccgagcctgatccacgcgcgagcatcctccgcatctggcccttgcacgtctgggtcatggcccccttcgagggggtacgggttnccgggggccccttcgaaaagggtttaacccgttttacccggggggac

SEQ ID NO: 67277 - protein, 192 aa, Zea mays
  misc_feature: Ceres CLONE 1541258
  misc_feature (64)..(188): Pfam Name: Chloroa_b-bind Pfam Description: Chlorophyll A-B binding protein
  misc_feature (121)..(121): Xaa is any aa, unknown, or other
  misc_feature (146)..(146): Xaa is any aa, unknown, or other
  misc_feature (177)..(177): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIPLRWAMLGALGCVFPELLARXRVKFGEAVWVKAGSQIFSEGGLDYXGNPEPDPRASILRIWPLHVWVMAPFEGVRVXGGPFEKGLTRFTRGD

SEQ ID NO: 67278 - DNA, 696 bp, Zea mays
  misc_feature: Ceres CLONE 1541260
  misc_feature (571)..(571): n is a, c, t, g, unknown, or other
  misc_feature (581)..(581): n is a, c, t, g, unknown, or other
  misc_feature (615)..(615): n is a, c, t, g, unknown, or other
  misc_feature (634)..(634): n is a, c, t, g, unknown, or other
ctggagctccccgcggtggcggccgctctagaactagtggatcccccgggctgcaggaattcgtctcacccctagaaaaaacccgtacccatcagattctccgggagggggagggtagctgaagggcacccagtgggcgcaatgcgcgtcctcgccgtggtcctcctcgccgcagcgtgcgcggcggcggcggccggaggcggcggggagcttccggagttccgggaggctcctgcgttccgcaacggcgcggcctgcgcgggcgcgccgacgatccacatcgcgatgacgctggacgccacctacctgcggggctccctcgccggcgtcctctccgtgctccgccacgccgcgtgcccggagtccatcgccttccacttcgtggcctcctcggcgtccccggcgcgccgcctcgcctcgctccgccgcgcgctggcggccgccttccccacgctcccggccaccgtgcacccgcttcgacgcgcgcctcgtccggggcaagatctcctccctcgtccggcgcgcgctcgaccagccccctcactacgctcgcatctacctcgcggaactncctgcgcgcntcgtcccccgcgtgctctacctcgactccgaccntctcgtggtcgacgacgtncgcccgcctctgggggccacgactcggccccgacggcgccctcgctgcccccgagtactgcc

SEQ ID NO: 67279 - DNA, 673 bp, Zea mays
  misc_feature: Ceres CLONE 1541262
  misc_feature: Encodes the peptide sequence at SEQ ID NO. 67280
ctccccgcggtggcggccgctctagaactagtggatcccccgggctgcaggaattcgtctcacccctagaaaaatgccagaagtaatatgattggagagattgagaacagatcaacattcctcttagctgtaaaagctgatgtggagacacaaggagaatttgttgaatctctagcaaatgaggtccgagcagcaagcttcataaatattgacgacgttgctgcatttgtaaattggttggatgaggagttgtctttcttggttgatgagagagcagtgctaaaacattttgattggccagagagcaaaacagatgcaataagagaagcagcttttgagtaccaggatctgataaagttacagaacagggtttcatcctttactgatgatccacaacttgcatgtgaagaggctctcaagaagatgtattctttgcttgaaaaagtggagcagagtgtctatgcactactccgtacaagagacatgaccgtctcacgctacaaggagtacgggatccccattgactggctgtcagaatctggagtagttggcaagatcaaagtggcatctgttcagcttgcaaacagtatatgaaagaggttgctcaaaactgatgcattaaaagcactgagaaagagcccataagaagttttgcttcccaaggtgtgaagtc

SEQ ID NO: 67280 - protein, 168 aa, Zea mays
  misc_feature: Ceres CLONE 1541262
MIGEIENRSTFLLAVKADVETQGEFVESLANEVRAASFINIDDVAAFVNWLDEELSFLVDERAVLKHFDWPESKTDAIREAAFEYQDLIKLQNRVSSFTDDPQLACEEALKKMYSLLEKVEQSVYALLRTRDMTVSRYKEYGIPIDWLSESGVVGKIKVASVQLANSI

SEQ ID NO: 67281 - DNA, 733 bp, Zea mays
  misc_feature: Ceres CLONE 1541278
  misc_feature: Encodes the peptide sequence at SEQ ID NO. 67282
  misc_feature (542)..(542): n is a, c, t, g, unknown, or other
tctagaactagtggatcccccgggctgcaggaattcgtctcacccctagaaaaaatggcctcctcgtctgcatcttcgatgcaccaggtcaccatcaccctcggccgcagcggtcaggttgttaaaaggaggactatatctgatgatattaacggcgataaaatgccattgtcggcgaaaaaacaatctgtggagggatatgttaggaatgtctgtggctgattctgattttttggatgcgagcttgaggtacttagtggtgttttctgtagtttataggtaagttgaagatgatggctaaggtgatgaaaacccctcaatttccttgtcgatttcccaccgccttccatttttagtgatctggccccttacttttctctggtatgatttgggcggctctatttcttcccaatatctccctgggctggcacaggtggaaccccgcccacttatcatccctcgtaatgaaaggcgtccgtttctgcgcgctgcacaggagggcgggtgtgtatctctagatacttccgggacccccccctctncaaacgccactttcgggaagaaaaaacataacagaatttttacgagatctgcctcctcttcgcgcgcccatcccggggaaacaccgggctgcttttttctcttcagacgtaggacctgaaacggatcgggatcgcccgggggtgatttctctctctcttcgggatgtgattttccaggctaccacccatcg

SEQ ID NO: 67282 - protein, 55 aa, Zea mays
  misc_feature: Ceres CLONE 1541278
MASSSASSMHQVTITLGRSGQVVKRRTISDDINGDKMPLSAKKQSVEGYVRNVCG

SEQ ID NO: 67283 - DNA, 715 bp, Zea mays
  misc_feature: Ceres CLONE 1541279
  misc_feature: Translation starting site: 217
  misc_feature (577)..(577): n is a, c, t, g, unknown, or other
aaagctggagctccccgcggtggcggccgctcctagaactagtggatcccccgggctgcaggaattcgtctcacccctagaaaaatccttgacgaccgacgccgccctactcgcagcttcctgggtttcatcggatcctctgctagcgacgagcaccccctacaccaggccgttacttgggcgccggtgccatgcccggcgggtcttcgggtccagatggtgaagtggatgcaggatttgcgaagctccagggagaggatttcgagtattacatgcaaacgtactccatcatgctgggacgcaacagcaagaaatcaacagtggatgtggatctctcgagcctcggtggggattggggacaagaagttctacttcctactgccaacacggtccatcttcgcttcggctgctgctgctcggcatgctcctattattccacagcagcttcctcctccaccgtatgcacatgcacgggcaggccgccctcgtttgtccgagtttcatgaccgctccttcgaaggtgattatgggcgggaggttgatgaagattgggaatggtatcagtgaaactgggatngaggggaaagctggtaaagaggaacaagaagtcttctggcgacttggatatctatggtgggcatagaatcaatgtggaaccaatagggacgctaggtgaagacagtagatcagaaataagatcaaggggtgacaggga

SEQ ID NO: 67284 - DNA, 633 bp, Zea mays
  misc_feature: Ceres CLONE 1541284
  misc_feature: Translation starting site: 231
  misc_feature (473)..(473): n is a, c, t, g, unknown, or other
aaactggagctccccgcggtggcggccgctctagaactagtggatcccccgggctgcaggaattcgtctcacccctagaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgaggccagatggtggacatccgcaagccaagcgcgaggaaagcctccagaagaagcgccgcgatgggtttcccgcctccgacgctggtgtgcccccgatgggccactccaccgcgctccagaaaaagctcgatggcttgaccgcgatggtgcaggncgtccaatcctacaacccctccgtgcagcttgaagcccacacaccagtcaggaaactgcttcctaaagaacggtgcccccccacccaaaaagtgacccgccctgggatggggccccgaattttttgattttcttacccgggggggccacccccccccccc

SEQ ID NO: 67285 - DNA, 728 bp, Zea mays
  misc_feature: Ceres CLONE 1541292
  misc_feature: Encodes the peptide sequence at SEQ ID NO. 67286
  misc_feature (356)..(356): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (374)..(374): n is a, c, t, g, unknown, or other
  misc_feature (376)..(376): n is a, c, t, g, unknown, or other
  misc_feature (377)..(377): n is a, c, t, g, unknown, or other
  misc_feature (445)..(445): n is a, c, t, g, unknown, or other
aaagctggagctccccgcggtggcggccgctctagaactagtggatcccccgggctgcaggaattcgtctcacccctagaaaaaaaccacgagacaccacttcctagcttcccttcccctcggctgccctcaaaaccccctcaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataaactcgnccccgcacnnngcacacngnnctctaagcattcaccatttgagaccgcccgggcgagcagtgggcccgcctggccccgtgtccctgcgnccaaggggggaaggaaaaagaggtcaagggtgaacccccccttgggccaaggggccctcccctccctcccgctgggggcggaccgggggggcccccccaaaaggaatttccgggtaagggggagggtccccaaggcccccgccccgaagaggccccccccctaaaggtcccccggggccacaaaaaaggagggggggaagggtttttctcccccccccggggggggcctcccccccgaaaaaaaactccgccccccattttgtgtttggtgggaaaaaaaccc

SEQ ID NO: 67286 - protein, 143 aa, Zea mays
  misc_feature: Ceres CLONE 1541292
  misc_feature (60)..(60): Xaa is any aa, unknown, or other
  misc_feature (63)..(63): Xaa is any aa, unknown, or other
  misc_feature (64)..(64): Xaa is any aa, unknown, or other
  misc_feature (66)..(66): Xaa is any aa, unknown, or other
  misc_feature (67)..(67): Xaa is any aa, unknown, or other
  misc_feature (90)..(90): Xaa is any aa, unknown, or other
MALARRLLRLTPYLGTLSLPPPNSHLLRNRTYISDMRRSAFVDRLLRSVRSEISFLDKLXPAXXTXXSKHSPFETARASSGPAWPRVPAXKGGRKKRSRVNPPLGQGALPSLPLGADRGGPPKRNFRVRGRVPKAPAPKRPPP

SEQ ID NO: 67287 - DNA, 657 bp, Zea mays
  misc_feature: Ceres CLONE 1541300
  misc_feature: Encodes the peptide sequence at SEQ ID NO. 67288
  misc_feature (16)..(16): n is a, c, t, g, unknown, or other
tttttttttttttttntttttttttttctactttgcagggaggaaaataaatcccaccctgaaagctggggctccccgcggtggcggccgctctagaactagtggatcccccgggctgcaggaattcgtctcacccctagaaaaatggtttcttggatccatgcatctctgcgtccacggatctcgccgtcgccgccgttgaccgggaatgggcggagagatcaccgaccgcatcacgtcaggcgtcctcgagcccctgtaggagcgcttcacggaggctctgacatggtggatgctatgctacgacgcgcaggtccggaagcgcctcgccccgctcctccgccgccacaggatggcgctgctcacggcgccggcggtggccgcgctgctgctgctcttctggtccgcggcgtacggcggtgacgcccagtgaccagggcgtgccgccgccgtaccaggacgccagcaaggacgtggaggtccgcgtcagggacctgctggcgcggatgacactggccgagaaagtcggccagatgacactcatcgagcggatcgtcgcgtcgccgcaagcgctcaaggacccctacattcggcagcctgaatcagcggcaggcagcaaccgtgcccgccgaaaccaggccgacggcgggagtaata

SEQ ID NO: 67288 - protein, 50 aa, Zea mays
  misc_feature: Ceres CLONE 1541300
MTLAEKVGQMTLIERIVASPQALKDPYIRQPESAAGSNRARRNQADGGSN

SEQ ID NO: 67289 - DNA, 657 bp, Zea mays
  misc_feature: Ceres CLONE 1541309
  misc_feature: Encodes the peptide sequence at SEQ ID NO. 67290
  misc_feature (507)..(507): n is a, c, t, g, unknown, or other
tggagctccccgcggtggcggccgctctagaactagtggatcccccgggctgcaggaattcgtctcacccctagaaaaaaaccccagcgcctcctgcctgcgcagtgcccacccacccgctcccactccaaaggctccaaagccaaagcaggcgcacgcgccacgcgcacctctgtctcgtctctcgcccgctctccactcttcctcccaaagcctgccgccgcgtgggggttgcttgctgcccgctcctctccctgctcctgtgtctgccgcccaccgcttccgggaacaagtccggttgccgccgccgccgccgccgccgccgtcactgctctgtccgagaggagggaggaacggagcgagatgggagggtccgggaagtgggtcaagtcgctgatagggctcaagaaacagcccgagaaggaagactgcaaagacaagctgcagctcacatcagtccacgggggaaggattgcaaggccaagggcgcaggtggaaagctgtgcngaacctcctccggcgaccagggctccatgtggcgcggctccagaagccggaagccaaggctcggaggcgtcggaagcctcggaataacgggtctcggggggccgccttccccggcgaacccgttaggggcctcctagcccccccttcccc

SEQ ID NO: 67290 - protein, 76 aa, Zea mays
  misc_feature: Ceres CLONE 1541309
MGGSGKWVKSLIGLKKQPEKEDCKDKLQLTSVHGGRIARPRAQVESCAEPPPATRAPCGAAPEAGSQGSEASEASE

SEQ ID NO: 67291 - DNA, 630 bp, Zea mays
  misc_feature: Ceres CLONE 1541313
  misc_feature: Encodes the peptide sequence at SEQ ID NO. 67292
ggagctccccgcggtggcggccgctctataactagtggatcccccgggctgcaggaattcgtctcacccctagaaaaaaggctcatcttatctcctgttgttcagaaggaaacatggcccggtctgcgatgtccgatgcccgatcccctcatcaatcagagatgcacatcttcctccagactctgactgtaaagactatcaccctcgacgtggagtcctatgtacctctttgaccacgccaaggtgtgcatctacgatcacgaacgcgttcactccgaccaccagcagttcatcttctttggcaactatctctaggacgggctcacacttgccgactacctcatctcgaacgagagcaccctccaccttgttctccgcctcatgggaggcatgcaaatgttcctctacaccctctctgtaaatactatcaccctccatgtggagtcttctgacaccatcgacaacgttctggacaccatccgagaccacgagggcatccctccagaccagcagcagctcatttttgctggtaagtaacttgatgacgggagcacgctagctgacttccacatccataatgatacgaccctccacttgatgttgcgtctcaagtgcggcatgcatatattc

SEQ ID NO: 67292 - protein, 51 aa, Zea mays
  misc_feature: Ceres CLONE 1541313
MGGMQMFLYTLSVNTITLHVESSDTIDNVLDTIRDHEGIPPDQQQLIFAGK

SEQ ID NO: 67293 - DNA, 638 bp, Zea mays
  misc_feature: Ceres CLONE 1541315
  misc_feature: Encodes the peptide sequence at SEQ ID NO. 67294
aagctggagctccccgcggtggcggccgctctagaactagtggatcccccgggctgcaggaattcgtctcacccctagaaaaagctcgcaccgcttaatcaacaacctgacaagttagctacccgcgcagcgccgcgcgccatggccacgatgacgaaccaccgcattgtgcccctcctgctggtcgcggccacactgctcgcgcaggccgcggcctgcccgtactgcccgacgccgaagccgccgccgcctccgccgccgtcgtcgtccacgccgtgccctcccccgccctactcgctgtcgccgtccacgccgacgggcaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccaccatcaaggccaaggcgctcagcgtcagcctcgtgctccccgtcgccatctcggtgctcgttaacgagtgcggcaagcacgtgccctccagcttccagtgcccgtaatctatagtacaacaatgaagcccatactgatcatcggctgcatatatgtgctagctact

SEQ ID NO: 67294 - protein, 145 aa, Zea mays
  misc_feature: Ceres CLONE 1541315
  misc_feature (62)..(144): Pfam Name: Tryp_alpha_amyl Pfam Description: Protease inhibitor/seed storage/LTP family
MATMTNHRIVPLLLVAATLLAQAAACPYCPTPKPPPPPPPSSSTPCPPPPYSLSPSTPTGKCPVNTLKLLACVDALNGLVHAVIGTKASDTCCPLLSGVADLDAALCLCTTIKAKALSVSLVLPVAISVLVNECGKHVPSSFQCP

SEQ ID NO: 67295 - DNA, 656 bp, Zea mays
  misc_feature: Ceres CLONE 1541316
  misc_feature: Encodes the peptide sequence at SEQ ID NO. 67296
aagctggagctccccgcggtggcggccgctctagaactagtggatcccccgggctgcaggaattcgtctcacccctagaaaaatcagagcaggcggtgctgctccagcggcaaccgccgccgtacgctaggcccgagcccgacacgcggagcgtcaagccggatcgcccggcgatgaggtttggtgccaagccgccgctccctcagccgggggcccaggtcggctgcaacaagctgctggctgggtacctggcgcacgagttcctgcggtgcggcacgctcctcggcgagcggaggctggagctgccccgtctgaaggagaaggatccctccgcctccacctccacccctgcgccggagccgagcaggcgctacgcggaggtttcgcggctgcttatggcgggcggggctcgcatacccggcgtcgtcaacccgtcgcagctcggacgctggctccggatcaattagtgaccgggtggccatgcgcccaggccgctggcagtcgggtgcatgcggagcatggccgcattgcctactgcttcgttccctcgtcagcggacgatcagaggaaccgttgtttttgaacagagcacgcacgtttctcatgtctcaatctttctttcccttcgaatttgtcgtgtagtagtagtaaatcaa

SEQ ID NO: 67296 - protein, 154 aa, Zea mays
  misc_feature: Ceres CLONE 1541316
AGAPRGGGRSRTSGSPGLQEFVSPLEKSEQAVLLQRQPPPYARPEPDTRSVKPDRPAMRFGAKPPLPQPGAQVGCNKLLAGYLAHEFLRCGTLLGERRLELPRLKEKDPSASTSTPAPEPSRRYAEVSRLLMAGGARIPGVVNPSQLGRWLRIN

SEQ ID NO: 67297 - DNA, 685 bp, Zea mays
  misc_feature: Ceres CLONE 1541323
  misc_feature: Encodes the peptide sequence at SEQ ID NO. 67298
ctggagctccccgcggtggcggccgctctagaactagtggatcccccgggctgcaggaattcgtctcacccctagaaaaaactcctccctcccctcctctgctttccccccatttcgcgtctcggggtttggaccagccacccggcggaggcggccgggcagactgggccgagcgaccggagcgccgccgccatcggcaaagccacgggacggcccatggagtcgcgagcgctcctgcacgcccggcccgccgccctccctcaccgcgccggcctgcgcctccatctcccgctcctgcgcccgcgggcagtctcccgctcccactccgccaagcccgcgctccagtccccgctcctcgcgtcgaggggccccttccttcaacggcacgatgcggttctgggcaacgggttcgtgaaacggagagcggccagcgctggcggtgatgtgtccttccgcgcccaggcggcggcctcagcggctgtgccagcgccgcatccggaggagtccacataacagctccttggcatcgacgtgaagacgactcagacgatcgtgccgttggggctcatgttcgtctagcatctctatcactacaccatcatgcgggacacaagggacgttcctggtggtcactgccaatggcagcagcgcctagatcatccctttctcaaagactgggttgacc

SEQ ID NO: 67298 - protein, 98 aa, Zea mays
  misc_feature: Ceres CLONE 1541323
MESRALLHARPAALPHRAGLRLHLPLLRPRAVSRSHSAKPALQSPLLASRGPFLQRHDAVLGNGFVKRRAASAGGDVSFRAQAAASAAVPAPHPEEST

SEQ ID NO: 67299 - DNA, 621 bp, Zea mays
  misc_feature: Ceres CLONE 1541331
  misc_feature: Encodes the peptide sequence at SEQ ID NO. 67300
agctccccgcggtggcggccgctctagaactagtggatcccccgggctgcaggaattcgtctcacccctagaaaaatctggcagcggtagacatctgttacttttcccgtcggcggctgtcccctcccgttctccgcctccggacatcccctcccgtcctccagcccctcctcgacttgagatggcagaagagatggccggacgatgggtgtatgggcccgccaatctgccatcgatatccgcacgacctattcttgcctcggtgcgtgggagatacacctcgtcgcgatcgtcgccgacgacctgtgtaacacgaggctgccactcgtgactgtctgcctgctgcgactcctagcgcctcatcggagatgcggccaatgaacgcggcggcatgaacgcgatcttcaatgtctttgatgccgagcgtctcatagacgcgtggttcagtgatgcctatgtccagagtgatatctacctgtgcacctgcttggtcactcctggacacggcgagcagcctgtgatagctgttaaccacaaggtgggaggagacaccgtttgcagacgaagagatctcatcgcggggttatgatcgaaacgcttgacatcgcttaaacttacctg

SEQ ID NO: 67300 - protein, 65 aa, Zea mays
  misc_feature: Ceres CLONE 1541331
MNAIFNVFDAERLIDAWFSDAYVQSDIYLCTCLVTPGHGEQPVIAVNHKVGGDTVCRRRDLIAGL

SEQ ID NO: 67301 - DNA, 715 bp, Zea mays
  misc_feature: Ceres CLONE 1541338
  misc_feature: Encodes the peptide sequence at SEQ ID NO. 67302
  misc_feature (512)..(512): n is a, c, t, g, unknown, or other
  misc_feature (667)..(667): n is a, c, t, g, unknown, or other
ctggagctccccgcggtggcggccgctctagaactagtggatcccccgggctgcaggaattcgtctcacccctagaaaaaggcttcgctcccttcccctccctgctccggctccggttcgcacacagtaagaaaagatggcgctgccatccatgagtcttgcggctaacggtgtgcttcccttctcagcacgtacctcgagtggtgtcacacaaaggccggtgtcagtgaccgcttccttggagcacaaaccagcgatgccagaaggaagttcctaaagcttgctcttgggaaacttggagttggactgccacctttgtgggggggctagaaacgctccccttgttgagcaaggcgtctcctcccccgagaatgtctttttgcaagggttcctttgggttttttgggcaaggcccccacctaaaaaaagtttttttctttttagaaagggggcaatttttcctttggggggaagggccttttttcccccaaagttgtggaaaccccatgtgnaaaaaaagtcccgggtgggagatttttttgtttcttcacacaagggagtttttccccaaaagtgtggggggaaagaaaaaaacctcgttttgtggggggcccccccggaaacccgggagaaaaatctggggtttcctccttttgtttccaccatntttttggaaaaatgttggggggcccccccctgatactcacaaaggggg

SEQ ID NO: 67302 - protein, 46 aa, Zea mays
  misc_feature: Ceres CLONE 1541338
MALPSMSLAANGVLPFSARTSSGVTQRPVSVTASLEHKPAMPEGSS

SEQ ID NO: 67303 - DNA, 678 bp, Zea mays
  misc_feature: Ceres CLONE 1541343
  misc_feature: Encodes the peptide sequence at SEQ ID NO. 67304
  misc_feature (215)..(215): n is a, c, t, g, unknown, or other
acaagctggagctccccgcggtggcggccgctctagaactagtggatcccccgggctgcaggaattcgtctcacccctagaaaaattagtagcgtccacctggtactagttcttttgcttgtgcttccgtccctgccagttccgatctatctctgtggtttcctctgtaacttggtctctccgctgtctatgccagcaccaagcgaggccggtgnctctgattctatgctgcgctgctctgctcgtatggatgagtcgcaaaggaaggcccgcccgaggaggaggaagaggaagaaggacttctctctgcacgtgctgctgatgtgcattagaggatccgtgctgataatatacagctgacacccacaagatcgactggataagttcgagcctgacggcatcatgggttccggcgatttgagctcggagatggagaggacggttcttggcctgacgctgtgggtctggattgccatcggcgtggtcgcgcttctcgtggcaatcctgctgatgatctgcattttgggtggcgtcccgcctgaggaccaagagaaccatggacagcctgaggcagacgcagatccccatctactccaaggagatccccatcgaccgggtcggcgggcgcagcctggcacagacaatgcatgagcgcgagcagccgagcttgccgccgcc

SEQ ID NO: 67304 - protein, 56 aa, Zea mays
  misc_feature: Ceres CLONE 1541343
  misc_feature (9)..(9): Xaa is any aa, unknown, or other
MPAPSEAGXSDSMLRCSARMDESQRKARPRRRKRKKDFSLHVLLMCIRGSVLIIYS

SEQ ID NO: 67305 - DNA, 652 bp, Zea mays
  misc_feature: Ceres CLONE 1541347
  misc_feature: Pfam Name: DUF300 Pfam Description: Domain of unknown function
ggagctccccgcggtggcggccgctctagaactagtggatcccccgggctgcaggaattcgtctcacccctagaaaaaaatcccgtaaccgcagcctcgccccgctcacatcttcctctccctctcagcgctggtgctcaatctataggtcgtcccactccctactcacccgccctccggtgtgaacctccatgacgtctgcaaccactcttcgatctgctgtcgtgacctcatccagccgtgctgtggcagtggatcggagttcgctccagctctgattggggggaaatgactagggtatcaagtggaaaaacataatggtccaggttctactgcacctctttcaggctaagcatctaaacaacaatatgtaaattatccttttccaataaaatacatgcttaaaccgtggctgctaggcaaatggtcctactttggtcatcaaatgcacgttagcttaactttttctaatgcattattatttgtggtttccatcacatgtacgtcagcttatcttttagcaaatgtgtagctgatgtcaattaactttttagtggaattttatctgctcattcttatattcaggaattccactactatatgtgccacttgaagttgttatgtcaaatattatgggtgaagcgagcgtctt

SEQ ID NO: 67306 - DNA, 631 bp, Zea mays
  misc_feature: Ceres CLONE 1541348
  misc_feature: Encodes the peptide sequence at SEQ ID NO. 67307
  misc_feature (436)..(436): n is a, c, t, g, unknown, or other
  misc_feature (439)..(439): n is a, c, t, g, unknown, or other
tccccgcggtggcggccgctctagaactagtggatcccccgggctgcaggaattcgtctcacccctagaaaaaaaaaaaaaggcctcgcccgtcgcccctctcgatcacttctctcccgacactctctcactcccgtgtcgtgtctagcgccgacggcgttgctaccggagccggccagcggccacgatgcctacaatgcacgcgcttcgcctatgcccgctgctctccaccatccgatccacaccaccgcgggccactgccgcagcccgccagggcgcgctcttcgtcgcccgctgctcccccgccgggacgccgtcagccgcccaggcgctcaagatcagttcaatcccgaccaagccagttgaggggcagaagactgggactagtggcctgaggaaaaaggtgaaagtattccagcaggagaactaccttgcntantggattcaggctctattcaattccttgccccctgaaagatatgtgggtgcaacccttgtacttgggggtgatggccggtacttttacaagggagctgctcagatcatcattaagattgcagctggaaatggagttcagaagatcatagttggcaggaatggtctactgtcaacccctgctgtatctgcctga

SEQ ID NO: 67307 - protein, 147 aa, Zea mays
  misc_feature: Ceres CLONE 1541348
  misc_feature (61)..(148): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
  misc_feature (84)..(84): Xaa is any aa, unknown, or other
MPTMHALRLCPLLSTIRSTPPRATAAARQGALFVARCSPAGTPSAAQALKISSIPTKPVEGQKTGTSGLRKKVKVFQQENYLAXWIQALFNSLPPERYVGATLVLGGDGRYFYKGAAQIIIKIAAGNGVQKIIVGRNGLLSTPAVSA

SEQ ID NO: 67308 - DNA, 672 bp, Zea mays
  misc_feature: Ceres CLONE 1541350
  misc_feature: Encodes the peptide sequence at SEQ ID NO. 67309
ctccccgcggtggcggccgctctagaactagtggatcccccgggctgcaggaattcgtctcacccctagaaaaatcatggccatcgccctcgccaacggcggcggcaagccccccgactgggaggacttcgtcggcatcatcgtgctcctggtcatcaactccaccatctccttcatcgaggagaacaatgccggcaacgccgcggccgcgctcatggccaaccttgctcccaagaccaaggttctgagagatggccgatggggcgagcaagaggctgcgatcttggttcctggtgacatcgtcagcatcaagctcggtgacatcgtccctgccgacgcgcgtctcctcgagggcgatcctctcaaggttgaccagtccgcgcttaccggagagtcgctcccggttaccaagggtcccggggacgaagtgttctcggggtccacctgcaagcagggcgagatcgaggccctggtgatcgccaccggagtgcaaaccttcttccggaagggccggtcacctcgggaaaagcaccaaccggtgggggcactttccgaaggtcctgaacggcaatggggaaatttcgcatttggccaaatccggggggggatctccccaaaaatcaccttagggttccccaatcccaaccccggtggtccccaccgggaataaaa

SEQ ID NO: 67309 - protein, 197 aa, Zea mays
  misc_feature: Ceres CLONE 1541350
  misc_feature (20)..(198): Pfam Name: E1-E2_ATPase Pfam Description: E1-E2 ATPase
  misc_feature: SWISSPROT Homolog: EC 3.6.3.6 Proton-exporting ATPase
MAIALANGGGKPPDWEDFVGIIVLLVINSTISFIEENNAGNAAAALMANLAPKTKVLRDGRWGEQEAAILVPGDIVSIKLGDIVPADARLLEGDPLKVDQSALTGESLPVTKGPGDEVFSGSTCKQGEIEALVIATGVQTFFRKGRSPREKHQPVGALSEGPERQWGNFAFGQIRGGISPKITLGFPNPNPGGPHRE

SEQ ID NO: 67310 - DNA, 660 bp, Zea mays
  misc_feature: Ceres CLONE 1541359
  misc_feature: Encodes the peptide sequence at SEQ ID NO. 67311
  misc_feature (411)..(411): n is a, c, t, g, unknown, or other
aaagctggagctccccgcggtggcggccgctctagaactagtggatcccccgggctgcaggaattcgtctcacccctagaaaaaaaaaaaaaagccacacacacacacacaccgcacctagccacctaccctgctgtcccccgtgccgtcgccgatggagtccttgggcgtgctgctgctccaccccttcaacgcgtacctggagcaggagctggaccgccgcttccgcctgtaccgcttctgggagacgccccgcgaggagttcctccgcgcgcacgcgggcgccgtgcgcgccgtcgtcggcaacgccagctacggcgccgacgccgcgctcatcgacgcgctcccggcgctcgagatcgttgcctccttctccgtcggcatcgaccgcgtcgacctcgccaagtgccnccaccgcgggatccgggtcaccaacacccccgacgtcctcaccgacgacgtcgccgacctcgccgtagggctcgccatcgccgtgctccgcaggatcccgcatgccgatcgatacgtccgcgcggggctctggaagtccaggggagactaccccctaaccacgcgggatgcgccgggttcttcaatttccttgtccttgttaataatcggtaattactaccgaatatcggctcctcccttgctggaaca

SEQ ID NO: 67311 - protein, 168 aa, Zea mays
  misc_feature: Ceres CLONE 1541359
  misc_feature (6)..(125): Pfam Name: 2-Hacid_dh Pfam Description: D-isomer specific 2-hydroxyacid dehydrogenase, catalytic domain
  misc_feature: SWISSPROT Homolog: EC 1.1.1.26 Glyoxylate reductase
  misc_feature (86)..(86): Xaa is any aa, unknown, or other
MESLGVLLLHPFNAYLEQELDRRFRLYRFWETPREEFLRAHAGAVRAVVGNASYGADAALIDALPALEIVASFSVGIDRVDLAKCXHRGIRVTNTPDVLTDDVADLAVGLAIAVLRRIPHADRYVRAGLWKSRGDYPLTTRDAPGSSISLSLLIIGNYYRISAPPLLE

SEQ ID NO: 67312 - DNA, 677 bp, Zea mays
  misc_feature: Ceres CLONE 1541361
  misc_feature: Encodes the peptide sequence at SEQ ID NO. 67313
tggagctccccgcggtggcggccgctctagaactagtggatcccccgggctgcaggaattcgtctcacccctagaaaactcagcgcgctcttgcaggccgatagtggcacgggttcgcgattgggcggcagcgtgctgcgacgacgggaggtagtgtgccgccagcacggtgaactgccgctcgttgttgcggtactctattgatccctagatttcacaacgaacatggcggaggcggctgccgattcctccaactcggccgtcgatggcggcggcagtaacgtccaaaacgactatcccaccattgaccccacctcgttcgacgtggtgctctgcggcacgggcctcccggaatctgtcctcccccccgcctgcgccgccgttggggagacggtcctccacgttgatcccagcccgttctacggcttcctctattcttccatccccctctcctccctaaccgtctttcttatcccctggaggcttcccctcccaccttgtccggcggggggcgcccgccttctggatttggggccccggccgttgaattttccccccgacgggacgggggatctcccaaatgttttaaaaccttggggggaagcggggcccaaaccccggtttggggggttccaccctttaaaatgggtgggaaccccccggtggcgtgggaccgg

SEQ ID NO: 67313 - protein, 150 aa, Zea mays
  misc_feature: Ceres CLONE 1541361
MAEAAADSSNSAVDGGGSNVQNDYPTIDPTSFDVVLCGTGLPESVLPPACAAVGETVLHVDPSPFYGFLYSSIPLSSLTVFLIPWRLPLPPCPAGGARLLDLGPRPLNFPPDGTGDLPNVLKPWGEAGPKPRFGGFHPLKWVGTPRWRGT

SEQ ID NO: 67314 - DNA, 627 bp, Zea mays
  misc_feature: Ceres CLONE 1541362
  misc_feature: Encodes the peptide sequence at SEQ ID NO. 67315
ctccccgcggtggcggccgctctagaactagtggatcccccgggctgcaggaattcgtctcacccctagaaaaaaaccgcgcccccacaccccgctcctctcgctcctcgctcccttttcaccttccccttcgcaggctccccctcccgtgccgtgctctctcaacaagggagaaggggaaaccaccaccaccaccacacttgataagaagggggccgcacgcgcctgcccgctcccgccgctactccatggacgcctgggaggccaccaaggcagtgttcgaccgggtgcgggcgctggacccggacaacgcgtccaagatcatgggcctgctgctcatccaggacaacagcgacaaggagctcatccgcctcgccttcggccccgaccacctcctccacgccttcgtctccgccgcgcgcgccgacctcgccgccaagcccgcgtcccctccgtcacccgtgctgggcccgatccaccagacctggggagcgccgccgcacccgagccctacggttggctccgaccacaaaaccagggccccttcgccgcaaacctcgcgctcgggtacgacttcaaccgggccaggcccggcgctgacgcattcttcccccaagactaaaaatg

SEQ ID NO: 67315 - protein, 126 aa, Zea mays
  misc_feature: Ceres CLONE 1541362
MDAWEATKAVFDRVRALDPDNASKIMGLLLIQDNSDKELIRLAFGPDHLLHAFVSAARADLAAKPASPPSPVLGPIHQTWGAPPHPSPTVGSDHKTRAPSPQTSRSGTTSTGPGPALTHSSPKTKN

SEQ ID NO: 67316 - DNA, 686 bp, Zea mays
  misc_feature: Ceres CLONE 1541363
  misc_feature: Encodes the peptide sequence at SEQ ID NO. 67317
  misc_feature (401)..(401): n is a, c, t, g, unknown, or other
gcggtggcggccgctctagaactagtggatcccccgggctgcaggaattcgtctcacccctagaaaaaaccgcgcccccacaccccgctcctctcgctcctcgctcccttttcaccttccccttcgcaggctccccctcccgtgccgtgctctctcaacaagggagaaggggaaaccaccaccaccaccacacttgataagaagggggccgcacgcgcctgcccgctcccgccgctacgccatggacgcctgggaggccaccaaggcggtgttcgaccgggtgcgggcgctggacccggacaacgcgtccaagatcatgggcctgctgctcatccaagacaacagcgacaaggagctcatccgcctcgccttcggccccgaccacctcctccacgccttcntctccgccgcgcgcgccgacctcgccgccaagcccgcgtccccgccgtcggccgtgctgggcccgctccaccaaacctgggggaggcgccccgcacccgaaccctaccggctggctccgacccacaaaaaccagcccccctttcgccgccaaccctcacgctcggcatccaacttcaaacggggcccggggcccgggtcttgaccgcttttctttccccaaagagcaacaaaatgggtggttaccccgtcccggggacccccccacacggcccggatgctttttc

SEQ ID NO: 67317 - protein, 120 aa, Zea mays
  misc_feature: Ceres CLONE 1541363
  misc_feature (54)..(54): Xaa is any aa, unknown, or other
MDAWEATKAVFDRVRALDPDNASKIMGLLLIQDNSDKELIRLAFGPDHLLHAFXSAARADLAAKPASPPSAVLGPLHQTWGRRPAPEPYRLAPTHKNQPPFRRQPSRSASNFKRGPGPGS

SEQ ID NO: 67318 - DNA, 728 bp, Zea mays
  misc_feature: Ceres CLONE 1541794
  misc_feature: Encodes the peptide sequence at SEQ ID NO. 67319
  misc_feature (382)..(382): n is a, c, t, g, unknown, or other
ccccgcggtggcggccgctctataactagtggatcccccgggctgcaggaattcgtctcacccctagaaaaagccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgactaaatcacctaccccctcttctcgggggggggggggcatcancacgctggtgtacccccccctggcggggtctcaggtgcgcatcttccagatggtggcgcgttccttgctcccccagttctatgcggtgtacttgcacccggagagctggagggcggtcctgctccttctccaggtgctccctcggcaccggcatgcccttaggtcctggttcatccctttctcctggggtcttccctaggcgcacaacaaggccgcccggtaccaaactcgatagtcccgtaggtagagccttggccattggtgttcttggtcctttcccgtcgtcccttcgccctgctatcaccctcttcgcaatgccgctcctctagttaacgtctgcccatcg

SEQ ID NO: 67319 - protein, 64 aa, Zea mays
  misc_feature: Ceres CLONE 1541794
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFD

SEQ ID NO: 67320 - DNA, 723 bp, Zea mays
  misc_feature: Ceres CLONE 1541803
  misc_feature: Encodes the peptide sequence at SEQ ID NO. 67321
ggcggccgctctagaactagtggatcccccgggctgcaggaattcgtctcacccctagaaaaagctcccatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcacgacaagaagattacaatagactgcgtccgttgagctatcgtggtgctgatgtttttctgctcgccctttctcttatcagcaaaacaagctatgagaatgtctctaagaaggcaatattctttccctgcccactttcttgccccggccccggtttattgcattcttttttattttagcttcttggatctgcatttccttgcatattacctggggcctgaccttttaatccacagtggttccctaaaataaagactctatggtccctgtgcttgctcccaaaccccttgtctgtggaattaaccttgatcccctgtgttgtgaacaagcattgtttattgttagaaaccc

SEQ ID NO: 67321 - protein, 120 aa, Zea mays
  misc_feature: Ceres CLONE 1541803
  misc_feature (8)..(120): Pfam Name: Ras Pfam Description: Ras family
MSASRFIKCVTVGDGAVGKTCMLISYTSNTFPTDYVPTVFDNFSANVVVDGSTVNLGLWDTARQEDYNRLRPLSYRGADVFLLALSLISKTSYENVSKKAIFFPCPLSCPGPGLLHSFLF

SEQ ID NO: 67322 - DNA, 916 bp, Zea mays
  misc_feature: Ceres CLONE 1541805
  misc_feature: SWISSPROT Homolog: EC 3.6.3.14 H(+)-transporting two-sector ATPase
  misc_feature (11)..(11): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (450)..(450): n is a, c, t, g, unknown, or other
  misc_feature (713)..(713): n is a, c, t, g, unknown, or other
  misc_feature (811)..(811): n is a, c, t, g, unknown, or other
  misc_feature (842)..(842): n is a, c, t, g, unknown, or other
  misc_feature (870)..(870): n is a, c, t, g, unknown, or other
  misc_feature (916)..(916): n is a, c, t, g, unknown, or other
tcctttccccnaaaaacaantattnntnnnnnnnnnccacccnnacacacagctgggctccccgcggtggcggccgctctagaactagtggatcccccgggctgcaggaattcttctcacccctagaaaagcatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcggcgccgcctgccgccctcgacttcccatgcatgggcgccgcgtacgggaccgcgaataagcggtgttggcgtggccgtcaatgggttgtgatccccgccggagcggggggggggagaccatcgtgccccgcggntcaagcgccgccccccctccggaattcacgggggtcccgtcatcgcccgacctccattagcgacggggaatcaaccccccaaccgcccaaacccccaacataaagacccgtttgtgggggatagcgctcctgcccgacgacgcgacagccgccatggaaccgggtgtcatcctccacctggggcctttaggcgagctatgggggtgggcggctgccgcgcgccatcagtatcgccgcgaatgcctctccacgcccaacgcctnatataaggcctgcaactctgcgccagagaccggatgcatgagcgagagagtggagcgtgagcgcagacagcccaggtgcagatcgactgaaagcgctncgtggttcgaccccacgcggccccacgcagncgatggtgtataacgactctctctctgntggtttcgacgccacggcgagcaactcgcacggggacgcggcttcn

SEQ ID NO: 67323 - DNA, 735 bp, Zea mays
  misc_feature: Ceres CLONE 1541810
  misc_feature: Encodes the peptide sequence at SEQ ID NO. 67324
tggcggccgctctataactagtggatcccccgggctgcaggaattcgtctcacccctagaaaaaaattccacactcaggcaacccagctttggctgcccttgcttgctgctcagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaatgacgacgacgaggatctctttaaggtgccccagttccctggcacgccctacagctacaagaattgccccccccccagtgaaaggggaaaaaggaaatgcttgtgcctcccggggccaagaaagcggagtaaagaacccccctccggaactaacaacaaatagtggcaaccctagggcacccagtggaaccaggaactacaacaaaaaattcccccacagctttctctgccgtgcggagtcaagcgaaggaccctgtgtatcccacatttggaaaccaccggattccctcattgggccctccttcacaatcactttcccagtaactcgactggtgctaaaacattttcctcccccggagctaaattgttatccaccccaccatttgtttaaaccacactccactaaatgaggaatacg

SEQ ID NO: 67324 - protein, 97 aa, Zea mays
  misc_feature: Ceres CLONE 1541810
MEAQDDCKWRQVPAFGDWNLWDDMPVTQYFQAGTFFFAAPTTENDDDEDLFKVPQFPGTPYSYKNCPPPSERGKRKCLCLPGPRKRSKEPPSGTNNK

SEQ ID NO: 67325 - DNA, 726 bp, Zea mays
  misc_feature: Ceres CLONE 1541811
  misc_feature: Encodes the peptide sequence at SEQ ID NO. 67326
  misc_feature (406)..(406): n is a, c, t, g, unknown, or other
acagctggagctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacgagccggtcaccgtctttggcatcangaaccctgaggaaatcccgtggggtgaggctggcgctgagtacgtcgtggagtccaccggcgtcttcactgacaaggacaaggctgctgcacatctcaagggtggtgccaagaaggttgttatctctgccccaagcaaagacgcacccatgtttgttgttgggtgtcaatgaggaacagtacacctcggatgttaccattgtttccaaggctagctgcaccccaactggccttgctccccttgccaagggcattcctgacaacttccggattgtttgaaggtttgatgaacactgttcatgccctcactgcccacccagg

SEQ ID NO: 67326 - protein, 138 aa, Zea mays
  misc_feature: Ceres CLONE 1541811
  misc_feature (4)..(137): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (82)..(82): Xaa is any aa, unknown, or other
MGKIKIGINGFGRIGRLVARVALQSEDVELVAVNDPFITTDYMTYMFKYDTVHGHWKHSDITLKDSKTLLFGDEPVTVFGIXNPEEIPWGEAGAEYVVESTGVFTDKDKAAAHLKGGAKKVVISAPSKDAPMFVVGCQ

SEQ ID NO: 67327 - DNA, 878 bp, Zea mays
  misc_feature: Ceres CLONE 1541812
  misc_feature: Encodes the peptide sequence at SEQ ID NO. 67328
  misc_feature (12)..(12): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (398)..(398): n is a, c, t, g, unknown, or other
gcgcggcgtcantttttccacaaaaaaacggccacacctccacacnnnaaactaaaaaacaaacgagggggggaggtcgacgatttagaatagtgcctcccccgggctgcaggaattcccctcacccctagaaaaaagcagccagctcccactgcgcaccgcccgtccgcccagaactatctcgctcgtccgcgttcagctcagctactccaatttcgcaacaagttgcaagcaataacccgaccaaggacgacgaacggggcgatggccacactctcctcctgcagccgcctgagtagcggcaccggcgccgcggccatccatcgggagccggtccgtgctggaaccgtcctcgtcgtcacctggaggcggagagtatacgcgagcgaccgcgccgnaaaccgtatgcacgacccgcggagccgtgttggccgtaaacactcccaaaacaaggggggtgccccccccccccccaccgggggggggaagatcccaggcctgggggggggccccccgggtcctattgtggagagaaccatccagacggggcttcccccggccccctctcccggggtcgaagggggctaataaaacctaggggttccaacaatacgcgggggggggcgcaacccaaataattggcccccccgaaaataggggggtgttcgcgccagggggcctgttcaccaggtgaggggtatctcgacctgtccctattttgtgtgtcggtgtgtggaaagcccggaggtcggaaggggcctctggttgagaataggggttcaaaaaaccggaagcgccgccgatggcgtaccgttgctaaggaaaaacaaggggcaccctatgcacgtcacaacaccccccgttttgttttggttggg

SEQ ID NO: 67328 - protein, 107 aa, Zea mays
  misc_feature: Ceres CLONE 1541812
  misc_feature (45)..(45): Xaa is any aa, unknown, or other
MATLSSCSRLSSGTGAAAIHREPVRAGTVLVVTWRRRVYASDRAXNRMHDPRSRVGRKHSQNKGGAPPPPTGGGKIPGLGGGPPGPIVERTIQTGLPPAPSPGVEGG

SEQ ID NO: 67329 - DNA, 743 bp, Zea mays
  misc_feature: Ceres CLONE 1541815
  misc_feature: Encodes the peptide sequence at SEQ ID NO. 67330
acagctggagctccccgcggtggcggccgctctagaactagtggatcccccgggctgcaggaattcgtctcacccctagaaaaaattcctagcaacctcccctccctctccacggccaccggcccgtatccacctggaaagccctaggggatcgtcgccatggccgcagatcgccctccttcaccgcctccccgctgaccgggcccatgtccaggccccggcattcatgggggagcgaacgatctccgactcctcggcagcgatcaccatcgagacatctgtcgctttaccctcccacctcgtcgacccaccctcgcgtgatgtcaccaccacccccgctgagctcatcaccttcttccgcgacaagtacctcaagcggcgcatggaaatcccgggccactcccactaccagaacaaggttatccgtgggttctgccacctctagaacggccaggataaccgtctgcaaaagggtggaggcctccttcaccctcttcgaatccaacatctccgccaacgcccaccactgtcacaaccccgtcccccggaagggatccccttcacgcctttctaataaatgtgggattccgtgcgcttgggggcctccgggggaaaggtgtggtctcttggaatttggcacaaagggatgccattttgtccgggtgtagacagggaccgctattgccataggggtggcccctagaaaggcggttcttttctttgcgtagaaaaaaacagtaagg

SEQ ID NO: 67330 - protein, 72 aa, Zea mays
  misc_feature: Ceres CLONE 1541815
  misc_feature: SWISSPROT Homolog: EC 1.2.4.1 Pyruvate dehydrogenase (acetyl-transferring)
MGERTISDSSAAITIETSVALPSHLVDPPSRDVTTTPAELITFFRDKYLKRRMEIPGHSHYQNKVIRGFCHL

SEQ ID NO: 67331 - DNA, 589 bp, Zea mays
  misc_feature: Ceres CLONE 1541816
  misc_feature (141)..(141): n is a, c, t, g, unknown, or other
  misc_feature (187)..(187): n is a, c, t, g, unknown, or other
  misc_feature (201)..(201): n is a, c, t, g, unknown, or other
  misc_feature (340)..(340): n is a, c, t, g, unknown, or other
  misc_feature (341)..(341): n is a, c, t, g, unknown, or other
gcggtggcggccgctctagaactagtggatcccccgggctgcaggaattcgtctcacccctagaaaaaaacgcagcccccattggatttggaagcttctccatgggacaccgagcctcgtagacgaagcagaggggaccangagaaacctgaggagctaagaagcaggggagctcatgggcgttccnttcctgccccaagnttccaaaaaggccgtctctggaaagttttgccccccgaaagccccctcttttttaaggccccaattttttccccccgggggggcccggggggggggggaaaaaaaataaagggccctctccccctcctccgcttttttnntttgggcgaaaaattgtggggccccgggaccttttatttttttttttttttgttggagaaccccctacaaaagggggggggggggcccccccccccccccttttttcccccccccccaaaaaataaccgcgggggggggggggggggggtctcccccagggggtttttttttttttttttttttcccccccccccccccccccccgggggggctccctttttttttaaaaaaacaatcatcccccctc

SEQ ID NO: 67332 - DNA, 700 bp, Zea mays
  misc_feature: Ceres CLONE 1541818
  misc_feature (163)..(163): n is a, c, t, g, unknown, or other
  misc_feature (164)..(164): n is a, c, t, g, unknown, or other
  misc_feature (259)..(259): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (304)..(304): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (475)..(475): n is a, c, t, g, unknown, or other
  misc_feature (482)..(482): n is a, c, t, g, unknown, or other
  misc_feature (485)..(485): n is a, c, t, g, unknown, or other
  misc_feature (518)..(518): n is a, c, t, g, unknown, or other
  misc_feature (520)..(520): n is a, c, t, g, unknown, or other
  misc_feature (550)..(550): n is a, c, t, g, unknown, or other
  misc_feature (614)..(614): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (700)..(700): n is a, c, t, g, unknown, or other
ccgcggtggcggccgctctagaactagtggatcccccgggctgcaggaattcgtctcacccctagaaaaactcgcagcgccggcgctccatcttccgctccctcccccaccttcgatcggcacgcagggctcggcgtcgttcgtcagtcggttcctccttccnngcctctcgccagtagcctcgtgccctcgccgactggcgaccctggctttggaggggctggcaagatgatccgcgtaagggaaggcccaaaacccntgcccccccaccnnncccttttggaaaaaaagccccccccctccnaaaaaaggtgggggggaaaaggtaatataaaaaaatatctcttcttttttttttttgtttnnnnggggggtgttgtttttgtatgtattgttttttggtgggtgctttttttttgatggagggagaggagcgtggtgcctccaacacaaacaaannnaacaataaggaaanctcctgnccntctcaccaaaaggagcgaggtgaggagtggtgngnagagaagaggaaggaaagaagagaaggggntgaaaggagttctacccccccccccgccctcttttttcgtgcgcgggcggagggaaggggaagnttttattatttattattctctgccctgcgcgcacaaaannnnngcggggagggtataggaagatgaagacaacgaccgcccccgcn

SEQ ID NO: 67333 - DNA, 656 bp, Zea mays
  misc_feature: Ceres CLONE 1541819
  misc_feature: Encodes the peptide sequence at SEQ ID NO. 67334
  misc_feature (377)..(377): n is a, c, t, g, unknown, or other
ctctagaactagtggatcccccgggctgcaggaattcgtctcacccctagaaaaaagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcgggagaggacgtgaagcggccggacacgctgcacgaggggacggtgctgatcccggggatggggcgctacgagatcggcagccactacatcccggacatcggcggnctggaccacagcatctccgccgccacccacggccagttcctccccggcgccgacgacacctgggtgcccaaccccggcttcgaggtcctcaaccccttcatgcccggcgcggccactccctgaacagtacccgcgctggcgaaagtggctctccggccatctgatcgtcgcggggccgccgccgccttgaaaaaataaactactagctactactcgctcctgctacgattaactagcccggcttgcctgctgatgtacccagggcttccgggggcccgg

SEQ ID NO: 67334 - protein, 110 aa, Zea mays
  misc_feature: Ceres CLONE 1541819
MARWSSSALVAVLVVLAAAVACSAARPVPAQQQQAGEDVKRPDTLHEGTVLIPGMGRYEIGSHYIPDIGGLDHSISAATHGQFLPGADDTWVPNPGFEVLNPFMPGAATP

SEQ ID NO: 67335 - DNA, 916 bp, Zea mays
  misc_feature: Ceres CLONE 1541821
  misc_feature: Encodes the peptide sequence at SEQ ID NO. 67336
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (243)..(243): n is a, c, t, g, unknown, or other
  misc_feature (253)..(253): n is a, c, t, g, unknown, or other
  misc_feature (456)..(456): n is a, c, t, g, unknown, or other
ggtgtggtctccaaaacaaannnaannnnnnnnnnnaaaccccnnccacactggagctccaccgcggtggcggccgctctagaactagtggatcccccgggctgcaggaattcctctcacccctagaaaaagagcagctcactcccgctgcccagtcctcgccaccgcccactccgtcgccaaccaatggcctccgccatggagctctcgctcctcaaaggcgccgcgacgcaccgccaccgnggcggcctcnccggcctgcccctcgcgcggcgctctctgatccgcttccgcgtgtccgcctccgccgcggccaccgcgccgtccatgtcctcgggccccaagaagcggggcaagacggacatccccgatactctggtccggccccgggtctacaccacgcacttttatttagaaggagtgtttatacaggcgggaaaatcaccaagcagaatnaaccctgtccccccccaaggagggtgtctgtcatggaagtttcgcgaagggacctccccccctcttcgcttttttctttgttccgatcccacccacgtacgacaggcacgcccctccccacacgggcacgccacgaggagcccgcgctcgctcgttgtatcctttcccccccgccccactcctctgtgagtgtcatctctgggcgcccttccctcaagtaccctgtcgggggcatccacctcacgttaccccacgtaagttgtggcggtcagttaggcagccctacgagatcccttcttcctcctttcgagaacgctccataaaacgcctgctgcgggcactaggcgcgagtggtcaccagcatccctccgcctctcgtcggcgtggcgaacggaaccacagcggcacttgatatccgcctcgtatattcctccatcccattggccactcggcatcctct

SEQ ID NO: 67336 - protein, 152 aa, Zea mays
  misc_feature: Ceres CLONE 1541821
  misc_feature: SWISSPROT Homolog: EC 1.14.13.81 Magnesium-protoporphyrin IX monomethyl ester (oxidative) cyclase
  misc_feature (23)..(23): Xaa is any aa, unknown, or other
  misc_feature (90)..(90): Xaa is any aa, unknown, or other
MASAMELSLLKGAATHRHRGGLXGLPLARRSLIRFRVSASAAATAPSMSSGPKKRGKTDIPDTLVRPRVYTTHFYLEGVFIQAGKSPSRXNPVPPQGGCLSWKFREGTSPPLRFFLCSDPTHVRQARPSPHGHATRSPRSLVVSFPPRPTPL

SEQ ID NO: 67337 - DNA, 791 bp, Zea mays
  misc_feature: Ceres CLONE 1541826
  misc_feature: Encodes the peptide sequence at SEQ ID NO. 67338
tggcggccgctctagaactagtggatcccccgggctgcaggaattcgtctcacccctagaaaaaattcccaagcaaacagccaaacacacgcgaagaaaaggaaccagcaagaccaacaaacccacttctgactgaccactgtgccgcgccgtggtcaccggacggacacacagaacgacgatggccgcgtcggcgctgcaccaaaccaccagcttcctcgggcaggccctggtctcccgcgccgccggcgtctatgccggcggccgcatcaccatgcgccgcaccgtcaagagcgttccccagagcatatggtacggccctgatcgccccaagtatcttggcccccctctccgagaggagggggggggaccctgatccggcaattccccccccttactacccggtgggacaccgcggggcctcccggcccaccccggaagactttctccgcgcaacctggccccttggaggttgatctccccccccggtgcggcgaagcctggggcccccctacacctcccgcgtttcccccgacacaccttggaccagaaaaggggtttataagccccggttcacgacgagtgggcgctccaatggccgccccccccctaattcttcccccataacccccggcgctgcaacctatcttaggcgtaacccctcaaccctggtagccccccactcgctgccatctttgtgtttatccttgcctccccacctcatagtttgcgctccccgccccccttctctatatacacctcctctctcgcactcctccgcgtgtccaccc

SEQ ID NO: 67338 - protein, 64 aa, Zea mays
  misc_feature: Ceres CLONE 1541826
MAASALHQTTSFLGQALVSRAAGVYAGGRITMRRTVKSVPQSIWYGPDRPKYLGPPLREEGGGP

SEQ ID NO: 67339 - DNA, 704 bp, Zea mays
  misc_feature: Ceres CLONE 1541830
  misc_feature: Encodes the peptide sequence at SEQ ID NO. 67340
agtggatcccccgggctgcaggaattcgtctcacccctagaaaaatgcactaaaaaaggaccatcacacaatcatgagatgggcagagattttaatagttcaagttctgttggcgaccatggagttgatgtctaagctaccatggtcattggcgaagacgagattgacggtgccaaatggacaatggataatgtcaaattttctgtcaaagaaccaatcgaggcgggtgcaacaaaagaagaactacagcaccttgtgatgctttgcagatctgaggctgatgcaatggggaggatcactgctggaattcttcgtctccttagacttgagaaatctcttgggcaaggaactatagaacaactacgtaagctaccaccccccccatggacaattatcttttcacccaggaggctcaacaggcagaacagttttggaagtatagggactcctcggactccacctatgcaagccattgcagacgtcatgggttcgaaaaccacactggaagcaactatttcctcattacagggcgagatttccgaatccaaggccaatgtatggcactgatttttcctgcgagcagcacgtgaggatcataaacgatgccgaggacatctggcatcttaccaaaaaagcccagaacatggaatccgttgctgaccccattgggaaactttgaatctttgaacctgacctacttgact

SEQ ID NO: 67340 - protein, 141 aa, Zea mays
  misc_feature: Ceres CLONE 1541830
MVIGEDEIDGAKWTMDNVKFSVKEPIEAGATKEELQHLVMLCRSEADAMGRITAGILRLLRLEKSLGQGTIEQLRKLPPPPWTIIFSPRRLNRQNSFGSIGTPRTPPMQAIADVMGSKTTLEATISSLQGEISESKANVWH

SEQ ID NO: 67341 - DNA, 682 bp, Zea mays
  misc_feature: Ceres CLONE 1541841
  misc_feature (417)..(417): n is a, c, t, g, unknown, or other
aagctggagctccccgcggtggcggccgctctagaactagtggatcccccgggctgcaggaattcgtctcacccctagaaaaagccttcagcccttcagtcttcaccagtcgcgcgccgccatgtcggagaccgaaatcggcggcagcggcgccggtggctgcggctgaatcgaagcctcggcgactgcgggggcacaagaagggcgccgtcacctgctgcgtcgcctcctccgcccgccccggcgtcgtcgcgtcctccggcgaggatggatgtctttgctggtttgatctgcgcaccaaagatgtacttttgaccatggaggcagcaaataaaccaatttcttcaatttgctttaaaccaggaaatgaagattttgtgtatatctctgctggaaatgaaatattgtcctttgatngtcgtatgggaactcaaacaagccattagagacatataactacaatagagatgaaaatcatcagattgctgtcagctctaaaggttttctcgctgctgcaaatgatagtggggatgttaagattggtcataccattcagaatggctgtataaaagataaagggagcccacccaagtatttgcagcagcgtggcatttcattcctgggaacctggaacgcattactggggggcctgactcaaacttgctgaagggattttccccaa

SEQ ID NO: 67342 - DNA, 683 bp, Zea mays
  misc_feature: Ceres CLONE 1541844
  misc_feature: Encodes the peptide sequence at SEQ ID NO. 67343
  misc_feature (683)..(683): n is a, c, t, g, unknown, or other
gggctgcaggaattcgtctcacccctaaaaaaaccgcgtgggttctgtcacttctgtgacttctgtctgcgtctcgctctccggcgagtggtgggccgccgccaccctaagccagttgcggaggtttacattggtctcttcggcggttacaagcacccgccaggagtctagacaagtttttccaatggaccacgtagcgaatggaaggcatcaaggtttcttttgcgaagccaagagtagttgtgctttccgattctgactctgactctaaaggttttgtagaatacctaactcctgttcactcaaggtcaaacgggaaggcttcatctgcgagcctaaaaacaggtggaaacgccccccccctttctaaaggtgaggcaagccaaggaaaagcatacagtaatgacaaaggtggaaagggttcttcatcacatgcactgcctaccaagtctgatgcagaactaaagctagagcttgatatccctccgaattctagaaatgcctaatgaattgtgaagcagctgaactattgccgcagattccccagcacctggcccttactactcgacgaacgccagatcaaaacttcctgagtcatttggacaaagcttttccctaatttcgaaggacggaaaatcatttctcccacttgccaagctctgctcaaacaaacccattttaan

SEQ ID NO: 67343 - protein, 101 aa, Zea mays
  misc_feature: Ceres CLONE 1541844
MEGIKVSFAKPRVVVLSDSDSDSKGFVEYLTPVHSRSNGKASSASLKTGGNAPPLSKGEASQGKAYSNDKGGKGSSSHALPTKSDAELKLELDIPPNSRNA

SEQ ID NO: 67344 - DNA, 790 bp, Zea mays
  misc_feature: Ceres CLONE 1541850
  misc_feature (216)..(216): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (571)..(571): n is a, c, t, g, unknown, or other
  misc_feature (582)..(582): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (615)..(615): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (679)..(679): n is a, c, t, g, unknown, or other
  misc_feature (680)..(680): n is a, c, t, g, unknown, or other
  misc_feature (688)..(688): n is a, c, t, g, unknown, or other
  misc_feature (731)..(731): n is a, c, t, g, unknown, or other
  misc_feature (766)..(766): n is a, c, t, g, unknown, or other
ccaccgcggtggcggccgctctagaactagtggatcccccgggctgcaggaattcgtctcacccctagaaaaaaaaaaaaaacaacgcctcctccagtccttcttcgtaagccttcaaaccgacgaatttgagcaactgcacccagagcgcgatccattgccggggaagaagcaacttgttgcgagcctcctctatggcgagctccgaccatggtntccaccaccgcccccaaggacgtgccgggcagctacggcctgccgctggtgggcgccgtgcgcgaccggcctcacttctactacttccagggcgcaggacaaggaattcaagtccccgggtggaagcgcttctcgctccccccgggggtggggggggggggggggcccccgggcccccttcctggnnnnccccaccccgctggggggggcgcgccggccctggaaccgcccaaaaagcctcccccggtggctccttcccaaattgggaccaatggggggaaaaaaaaaagcaaccccgtgtttacgcggcccgacctagacttggccggtaccaccctccctctccccacccggntgctcacccgntagccaccacccnnnnaaaagcggagacccggntacccaaccccccgccccaccccnnnngaggcgagacgagacccgcccccctaccacacccatnnagggacgntcccccacgcgcgcccgcacgcgggttcccccccgagtgagancgccaccgacaggttaccggcccgcacgcgcaggngagagccaagccggacacggacaa

SEQ ID NO: 67345 - DNA, 498 bp, Zea mays
  misc_feature: Ceres CLONE 1541855
  misc_feature: Encodes the peptide sequence at SEQ ID NO. 67346
  misc_feature (303)..(303): n is a, c, t, g, unknown, or other
  misc_feature (394)..(394): n is a, c, t, g, unknown, or other
  misc_feature (395)..(395): n is a, c, t, g, unknown, or other
tccccgcggtggcggccgctctgaatagtggatccccctgggctgcaggaattcgtctcacccctagaaaaatcacattatcttccctgtttcttatttcgccgccgtttgccgtcgaccgccgcgcggccgtcgagttgaaaagcgaggcaaggcaggagagcggcaggagaggaaagacgccatggcgaccgcttcagtgactttttcagtcaccggaggatcaccggaagcagctcgagcttgaggaggcccgcaaggcggggctttgcccctgcggaaggtccattaaggatgggaaanaagaatcattcccccaaatccccccagaaaatggcccccgccccctggggtatcttaaaggccgaaaaaacctaatttttaaaccctcccnnccgcggagtgggaatctcaatcccaattacccccaattcctggggataaaaaaggggggggaaaaatttttttccgggccccacaaaaaaacaggaaaagggg

SEQ ID NO: 67346 - protein, 66 aa, Zea mays
  misc_feature: Ceres CLONE 1541855
PAVAAALNSGSPWAAGIRLTPRKITLSSLFLISPPFAVDRRAAVELKSEARQESGRRGKTPWRPLQ

SEQ ID NO: 67347 - DNA, 711 bp, Zea mays
  misc_feature: Ceres CLONE 1541856
  misc_feature: Encodes the peptide sequence at SEQ ID NO. 67348
  misc_feature (604)..(604): n is a, c, t, g, unknown, or other
  misc_feature (675)..(675): n is a, c, t, g, unknown, or other
  misc_feature (679)..(679): n is a, c, t, g, unknown, or other
ctggagctccccgcggtggcggccgctctagaactagtggatcccccgggctgcaggaattcgtctcacccctagaaaaattgaagagctcttttctcttgtcaatatggatctttgttattcctgtgctgattggacttctttttgagctgctggtcattgtacccatgagggtgcctattgatgagagccctgtcttcttattgtaccaggattgggcactggggttaatattcttgaaaatatggactagactggttatgttggatcagatggcacctttggttgatgaaagctggaggtcaaagtttgagagagttagagacgatggcttctcccgtttaaggggtctgtgggtcctccatgaaattataatgccgattctcaccaaactccttaccgctctctgtgtcccatacgtccttgcaaggggcatcttcccggtgctgggttacccactcatcgtgaactcagcagtgtatcgctttgcctggcttggatgcctgatcttcagcgcactcttcttttgtggaaagaggttccatgtctggttcaccaacctccacaactccatcagggatgaccgctatctgattggccgaangctgcacaactttggtgaggacacacccgagccgagtgaatctggagcaactatagggtcagatgaccagnaccnagctcttgtcctgcgagatcaggaagaggaag

SEQ ID NO: 67348 - protein, 236 aa, Zea mays
  misc_feature: Ceres CLONE 1541856
  misc_feature (201)..(201): Xaa is any aa, unknown, or other
  misc_feature (225)..(225): Xaa is any aa, unknown, or other
  misc_feature (226)..(226): Xaa is any aa, unknown, or other
GAPRGGGRSRTSGSPGLQEFVSPLEKLKSSFLLSIWIFVIPVLIGLLFELLVIVPMRVPIDESPVFLLYQDWALGLIFLKIWTRLVMLDQMAPLVDESWRSKFERVRDDGFSRLRGLWVLHEIIMPILTKLLTALCVPYVLARGIFPVLGYPLIVNSAVYRFAWLGCLIFSALFFCGKRFHVWFTNLHNSIRDDRYLIGRXLHNFGEDTPEPSESGATIGSDDQXXALVLRDQEEE

SEQ ID NO: 67349 - DNA, 662 bp, Zea mays
  misc_feature: Ceres CLONE 1541857
  misc_feature: Encodes the peptide sequence at SEQ ID NO. 67350
  misc_feature (104)..(104): n is a, c, t, g, unknown, or other
  misc_feature (378)..(378): n is a, c, t, g, unknown, or other
ccgcggtggcggccgctctagaactagtggtcccccgggctgcaggaattcgtctcacccctagaaaaaaatccaatccatccaaacccatttccctcgctccncatcccgtcccgccccttgtctcttccgcttccgcccgaccccgcgcgccgcggaccagcagccatgtcgtgctcccacctctccaccgcctggtcctcctcggcgctcgccagcagcgcctccaccacccgtcggcgctcccccccgcgctcgggtctcctggtgcggtgttccctccgtgagctccgcacccgcatcgactccgtcaggaacacgcagaagatcacggaggccatgaagctggtgggcgccgccaaggtcccgcgcgcgcangaggccgtcgtctcctctcgccctttctcggaagcgctgggtggaggtgctctacaacatgaaccaggagattcagacggaagaaatggaactggcctttacccgaaccggccccgtaaagagggtgccttcctgttcctggacgggcaacgcggcttctgggggaacttcaaaaaaacttggtccaaaaaggggaaaaccgccatccttaaccctcagcacttgggcttccaataaaccgcccctcaccgtgggggaaaaaaggcaaccccctctttcccgcc

SEQ ID NO: 67350 - protein, 148 aa, Zea mays
  misc_feature: Ceres CLONE 1541857
  misc_feature: SWISSPROT Homolog: EC 3.6.3.14 H(+)-transporting two-sector ATPase
  misc_feature (70)..(70): Xaa is any aa, unknown, or other
MSCSHLSTAWSSSALASSASTTRRRSPPRSGLLVRCSLRELRTRIDSVRNTQKITEAMKLVGAAKVPRAXEAVVSSRPFSEALGGGALQHEPGDSDGRNGTGLYPNRPRKEGAFLFLDGQRGFWGNFKKTWSKKGKTAILNPQHLGFQ

SEQ ID NO: 67351 - DNA, 675 bp, Zea mays
  misc_feature: Ceres CLONE 1541858
  misc_feature: Encodes the peptide sequence at SEQ ID NO. 67352
ctacaactagtggatcccccgggctgcaggaattcgtctcacccctagaaaaaggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgcccgcgctggggctgtccgtcggggctgctgtccctcggccgcaacctccccttccgcccggggacggccaacattcccgggggtgacccccgtgcagaggagttttaaggcccttcccccaaaaacgcggagggaggaacttctcaattaaaaaatttttttccccccttcccccccaaaaaaataatcttcctccgaaaagggcgccccccccccgttttcgcccaaagaaggggtctcgccttttaggaaaaaaaaaccaaacgcgccccgccctccccaaaaaacttccgggccaaagttcccgggggtgctcgggtctgcgcaggcccaccaagagcttcttcccctcaatccctcccttttccgcagagtctcagccttatggtagctttggggcgcgcacaagttttttcccctcccgcgggcctagctttctgacctccccc

SEQ ID NO: 67352 - protein, 94 aa, Zea mays
  misc_feature: Ceres CLONE 1541858
MAALAAASTAAFAAKPRARLSVACSAATGDSSSVSLASSVKTFSARAGAVRRGCCPSAATSPSARGRPTFPGVTPVQRSFKALPPKTRREELLN

SEQ ID NO: 67353 - DNA, 611 bp, Zea mays
  misc_feature: Ceres CLONE 1541861
  misc_feature: Encodes the peptide sequence at SEQ ID NO. 67354
tccccgcggtggcggccgctctacaactagtggatcccccgggctgcaggaattcgtctcacccctagaaaaaaaggtcggttaagccgtaacagtcgttgatgtcgccgccgccgtcgtccctcgtggtgctcccgctcctcctccccctcctcctcgccgctgtatcccacgctacggctaatgcggccggtgccggcgcccctcccccagtgccgacgccgtggccggagcagttccacgcggtggtcttcaccaatctcaccgaaagccggcgggccggcttgcaactgatcgacctgttcctaccaattggggcccgggggcccctcaaacttttaaacttttttcggggaaccagctcccccacaggcgggggtggggattttaaagggcacccacccccctccccccctttttttttttttcggggtttttgcccaaacaagagtttttccccggggggggaaacccctccccccacggaagagggggcccgcccgcgggggggggcctctttttttttttttcccggggagaagaattctataggagttgttttatatagacgccccccctgggtggggaccaaagaaaacgagacccccttc

SEQ ID NO: 67354 - protein, 36 aa, Zea mays
  misc_feature: Ceres CLONE 1541861
MRPVPAPLPQCRRRGRSSSTRWSSPISPKAGGPACN

SEQ ID NO: 67355 - DNA, 671 bp, Zea mays
  misc_feature: Ceres CLONE 1541862
  misc_feature: Encodes the peptide sequence at SEQ ID NO. 67356
  misc_feature (522)..(522): n is a, c, t, g, unknown, or other
  misc_feature (529)..(529): n is a, c, t, g, unknown, or other
  misc_feature (530)..(530): n is a, c, t, g, unknown, or other
  misc_feature (614)..(614): n is a, c, t, g, unknown, or other
tccccgcggtggcggccgctctagaactagtggatcccccgggctgcaggaattcgtctcacccctagaaaaaacgctccggcagcgaagctcccccctccctgcctccttccccggcgccctgctcttcctccttccgctccggcgatgggcactggccgcggctgcggcgggggcgtgctccaccgcctcctcgccctctcgtcgctgctgctcctcgcttccggcgaggtcgtcttcgaggagcgcttcgaagatggttgggagactcggtgggtagaatccgactggaaaaggagtgaagggaaagcaggaaggttcaagcacacagcgggaagatactctgcagatcctgatgacaaaggaattcaaacaacaatagatgccagacattttgctatctcagccaagttcccggaattcagtaacaagaaccggacgcttgtggtccagtactcccattagtttgagcaggatattgaaatgtgcggtggctatattaagcttatgtccggttatgtncaccaannaaattagtggggacactccatacagcttgatgtttggacagatatatgtggtactcaaacaaagaaactccatcttatactctnctaccaggggcagaactatcccatcaaaaagatctaaaatgtgagacggacagttta

SEQ ID NO: 67356 - protein, 105 aa, Zea mays
  misc_feature: Ceres CLONE 1541862
MGTGRGCGGGVLHRLLALSSLLLLASGEVVFEERFEDGWETRWVESDWKRSEGKAGRFKHTAGRYSADPDDKGIQTTIDARHFAISAKFPEFSNKNRTLVVQYSH

SEQ ID NO: 67357 - DNA, 740 bp, Zea mays
  misc_feature: Ceres CLONE 1541865
  misc_feature: Encodes the peptide sequence at SEQ ID NO. 67358
  misc_feature (382)..(382): n is a, c, t, g, unknown, or other
  misc_feature (384)..(384): n is a, c, t, g, unknown, or other
  misc_feature (547)..(547): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (638)..(638): n is a, c, t, g, unknown, or other
  misc_feature (640)..(640): n is a, c, t, g, unknown, or other
  misc_feature (642)..(642): n is a, c, t, g, unknown, or other
  misc_feature (668)..(668): n is a, c, t, g, unknown, or other
  misc_feature (704)..(704): n is a, c, t, g, unknown, or other
aagctggagctccccgcggtggcggccgctctagaactagtggatcccccgggctgcaggaattcgtctcacccctagaaaaaacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgccagtggtggagaccccgccgccggccgtcgtgcccgaggagtctgcccccgccgaggccgaggctgatgctgaggctgacgctgctgctggtggtgagtccnangaacttccctcggcccaacaacacgcagcctccaagcccaaagccgctgctcctgcctgggcccaagaagcccccggcggccaaaatcgggcctgctaaagcggaaggctgccggttccggccagggcccgaagaaaactcctggcggtctaagcaagagagnaacccccccgaagaagaacgctgctttccgccccccccnnnnctcccacccaagaaagcgacgaccgggctcaaaacatagtcccccaaantnanaaggctgcgaactctcccaaacaaanccccccccacaaaaaaaacgcgaaaggggtcccggnggcccagcggccagacggggaggccctatttaaacg

SEQ ID NO: 67358 - protein, 84 aa, Zea mays
  misc_feature: Ceres CLONE 1541865
  misc_feature (52)..(52): Xaa is any aa, unknown, or other
MATAEVQTPTVVAAEEAPVVETPPPAVVPEESAPAEAEADAEADAAAGGESXELPSAQQHAASKPKAAAPAWAQEAPGGQNRAC

SEQ ID NO: 67359 - DNA, 717 bp, Zea mays
  misc_feature: Ceres CLONE 1541867
  misc_feature: Encodes the peptide sequence at SEQ ID NO. 67360
  misc_feature (637)..(637): n is a, c, t, g, unknown, or other
tggagctccccgcggtggcggccgctctagaactagtggatcccccgggctgcaggaattcgtctcacccctagaaaaacaatgtcatcaagctcgacgggctcgtcacctcccgcatgtcctgcagcctctacctcgtcttcgactacatggtccacgacctcgccggcctcgccgccagccccgacatcaagttcacgctgccccaggtcaagtgctatgtgcgtcagctcttgtcagggctggagcactgccacaaccggggagtgcttcaccgcgacatcaaggggtcaaacctgcttttggacaacaacggtgtgctgaagattggcgatttcggtctggcgtccttcttcgaccccaaccataaacagccaatgactagtcgggtggtgacactccggcaccgccctccagagttgctgctgggtgcgacggattatggagttggcgtcgacttgtggagtgcaggatgtatactggctgaattgctggctggaaagcctattatgcctggacggactgaggtggaacagctgcataaaatttttaagctatgtggctctccaacggaagaatattggaaaaaatcagagttgccccatgcaactatattttagccctccacagccatacnaaaaggcgaatagcagatacatttcaaggatttccctcaatcagcacttccgactgaacgagacactacttgcaatcgac

SEQ ID NO: 67360 - protein, 167 aa, Zea mays
  misc_feature: Ceres CLONE 1541867
  misc_feature (1)..(167): Pfam Name: Pkinase Pfam Description: Protein kinase domain
  misc_feature: SWISSPROT Homolog: EC 2.7.11.1 Non-specific serine/threonine protein kinase
MSCSLYLVFDYMVHDLAGLAASPDIKFTLPQVKCYVRQLLSGLEHCHNRGVLHRDIKGSNLLLDNNGVLKIGDFGLASFFDPNHKQPMTSRVVTLRHRPPELLLGATDYGVGVDLWSAGCILAELLAGKPIMPGRTEVEQLHKIFKLCGSPTEEYWKKSELPHATIF

SEQ ID NO: 67361 - DNA, 670 bp, Zea mays
  misc_feature: Ceres CLONE 1541871
  misc_feature: Encodes the peptide sequence at SEQ ID NO. 67362
  misc_feature (521)..(521): n is a, c, t, g, unknown, or other
  misc_feature (562)..(562): n is a, c, t, g, unknown, or other
ctggagctccccgcggtggcggccgctctagaactagtggatcccccgggctgcaggaattcgtctcacccctagaaaaaggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtggaagagcgggaggcaggcatgtgtgatctggtggcccgcacgggccggcacctgcagcgctacgagaacggccatcgccttgtggccgggtgcataccattcagatatagggatattaatgatggagcttctgatgatgaacaacagaaacttgttgaagttctcatgatcagctcccagagtggaccgggtcttctatttccaaagggaggctgggagaatgatgaaactgttgaagaggcagctgcnagggaagctatcgaagaagctggagtgcgaagagatttagntgcactgctgggggtctacgatttcaagagcagcagcccgaagcacgtgcaggccgcaatcttcgccctcacgtgtaagagagctagcctctggccagaacgaacacc

SEQ ID NO: 67362 - protein, 126 aa, Zea mays
  misc_feature: Ceres CLONE 1541871
  misc_feature: SWISSPROT Homolog: EC 3.6.1.52 Diphosphoinositol-polyphosphate diphosphatase
  misc_feature (91)..(91): Xaa is any aa, unknown, or other
MCDLVARTGRHLQRYENGHRLVAGCIPFRYRDINDGASDDEQQKLVEVLMISSQSGPGLLFPKGGWENDETVEEAAAREAIEEAGVRRDLXALLGVYDFKSSSPKHVQAAIFALTCKRASLWPERT

SEQ ID NO: 67363 - DNA, 725 bp, Zea mays
  misc_feature: Ceres CLONE 1541872
  misc_feature (177)..(177): n is a, c, t, g, unknown, or other
  misc_feature (196)..(196): n is a, c, t, g, unknown, or other
  misc_feature (197)..(197): n is a, c, t, g, unknown, or other
  misc_feature (211)..(211): n is a, c, t, g, unknown, or other
  misc_feature (228)..(228): n is a, c, t, g, unknown, or other
  misc_feature (408)..(408): n is a, c, t, g, unknown, or other
  misc_feature (414)..(414): n is a, c, t, g, unknown, or other
  misc_feature (416)..(416): n is a, c, t, g, unknown, or other
  misc_feature (725)..(725): n is a, c, t, g, unknown, or other
attgctggagctccaccgcggtgggcggccgctctagaactagtggatcccccgggctgcaggaattcctctcacccctagaaaaaaaccaggccggtccacctgcaaccgtgacggttcttgttcttcttcccacccagcgtgcgctccctcttcctcttccccttcgctctcggngacgactgggtggccgtannctgcctccatacgncctgggggcccctgggnctttctttcggggccatttgccggccgggagcaccccccaaagggaaagctttccccggagagaaacacgtttctccgcaccctaacaaaagggcagggtttaatcccaaaccaattggtaaatcccaaacaaaaactttttttttccccccctccaaagggggggggggggggggatcncccccntngaaaccttaattccccccccccgggggtggggcgacaaccctccagggggccccccccgggccgtgggggggcttcaaagggtttctatcccagaaatttttgaaagtggagggcgttctcggaacctctcacttgttttttttgggcaaaaccccggggatgttctcgagaattttgactcgggtgccccatgaaacgggggccaggttagagccccgccacacagagcccgttctttttcttatagaggaattttttgctggtggctccttcttggcggactgcttggcataaacacatgttccacn

SEQ ID NO: 67364 - DNA, 598 bp, Zea mays
  misc_feature: Ceres CLONE 1541875
  misc_feature: Encodes the peptide sequence at SEQ ID NO. 67365
  misc_feature (135)..(135): n is a, c, t, g, unknown, or other
  misc_feature (287)..(287): n is a, c, t, g, unknown, or other
  misc_feature (289)..(289): n is a, c, t, g, unknown, or other
acccgcggtggcggccgctctagaactagtggatcccccgggctgcaggaattcgtctcacccctagaaaaagcattgtggctcctcacttccgcgccgccacccccttcaggtaaggaagaggaggagggcagngatgtcgcaccgtaagttcgagcacccgaggcacggctccctcggcttccttcccaggaagcgctcctcccgccaccgcggcaaggtggaaagtcattccccagggatgaccccaagaaagctttgcatctcactgcctttccttggctacnanggctggggatggactcacattgttccgtgaaggtttgaaaaaagcagggtcccaactccataaaaaggaaactggtgaggctgttaccttcattgaaacccccccccccctgggccattgggggggggggccccgggggaattggtaaaaaaatccctgggggcctcccaccaccaaaattttgtgttggggccccccttttttcggaaaaaaaggggggaaaggggttttttaaaaaatgggggggaaaaaaaaaaaaaaaagggttttccaaaaaaggggcccccaaaaaaaaaaaaaagggggcgg

SEQ ID NO: 67365 - protein, 60 aa, Zea mays
  misc_feature: Ceres CLONE 1541875
  misc_feature (51)..(51): Xaa is any aa, unknown, or other
MSHRKFEHPRHGSLGFLPRKRSSRHRGKVESHSPGMTPRKLCISLPFLGYXGWGWTHIVP

SEQ ID NO: 67366 - DNA, 704 bp, Zea mays
  misc_feature: Ceres CLONE 1541877
  misc_feature: Encodes the peptide sequence at SEQ ID NO. 67367
aaagctggagctccccgcggtggcggccgctctagaactagtggatcccccgggctgcaggaattcgtctcacccctagaaaaacttcatcatccaccagccacaatgtgtaagtctataagtcatccaattgaaacactcctccatcaatgccagcaggtctgcagatgttcggacagccgacgtccaccgacctttccagggtgctgacctgcctcttccacaacaaactcgagttcgagctcatccgcaccgacaccttcaagaagtcccacaagctccccgagttcatcaagctcaggtatcctactgggcacgtgactttcaagctctgtgacaaaacaatccttgattccttcgtcatttgccggtaccagtgcaagctcttcccggacgacgggtacaaaaacctgtactgcaacgagtcactggattcatcgtccatataccagaggctgcatgctgaggtccagagcttcaacgcttctacctcggatctggcattacatctggcgttcgcgccgaacctcaagaacgtgcggcccgactatgtccgcaccgcatagaactatatgaagctgcacagcatgctgggcgtctacgactacatcctctccaagaacgagtacctcgccggagacaacttcacccatggcgacctcacccacctgcccaactctcactacatcgactactcctccaag

SEQ ID NO: 67367 - protein, 138 aa, Zea mays
  misc_feature: Ceres CLONE 1541877
  misc_feature: SWISSPROT Homolog: EC 2.5.1.18 Glutathione transferase
MPAGLQMFGQPTSTDLSRVLTCLFHNKLEFELIRTDTFKKSHKLPEFIKLRYPTGHVTFKLCDKTILDSFVICRYQCKLFPDDGYKNLYCNESLDSSSIYQRLHAEVQSFNASTSDLALHLAFAPNLKNVRPDYVRTA

SEQ ID NO: 67368 - DNA, 726 bp, Zea mays
  misc_feature: Ceres CLONE 1541878
ggagctccccgcggtggcggccgctctagaactagtggatcccccgggctgcaggaattcgtctcacccctagaaaaaatcccaacttggtccacttgggcttgtatcgtactcctctatctttttatattgtttgattagatgcctacctcctcacctcaccgtcaacgtcagcaatgtcttggacggtctccagttgcagttctggtgactctgacaccaactactcttaaatacaaacgccttcttattatctctccctcgtctactgcgtctgagactcctgactctcaccccgcgagtgcgaccaacaacatcgcctcaccgtactcccaggactccacctcgaacggagaagggcacacgaccggtttcatgagcctctcacacaacgatgttgtcccaggagtagtataccaccataactatcgacaacatcgtggcgccggccagcactattccaaaactgcaatctgattataccgatctggttgagcaccaagctcctcacgctatctatgtctcttctactcgtactcaccacaaccatgtgcgtgcgttctccgcgatatcgacttacttccaggacgtcatcaccaaagtcgtactacccattgatcttaatagctactaagactactacatagtacccctactgcatgctgccgccacagaagacgcctatatatccacaacaatttctcgttccgttctactctacaccat

SEQ ID NO: 67369 - DNA, 701 bp, Zea mays
  misc_feature: Ceres CLONE 1541888
  misc_feature: Encodes the peptide sequence at SEQ ID NO. 67370
ccgcggtggcggccgctctagaactagtggatcccccgggctgcaggaattcgtctcacccctagaaaaatcttgtcttgatcctctggtccgtggccatggcgtcgtccatgctctccgctgccaccgtgccactccagcaagggggcggcctgtccgagttctccgggctcatgagctccgcgtctctgcccatgctccggaatgccacctccgacgacttcgtgtccgccgtctccttcatgacccacgcggtcggttcgagcggagggccgcggcgggagccgacggaggccaatctgaacgtggccatcattgggttcggccgcatccggcgcaacttcctgcagtgctggcacgggcgcggcgacgcctctcccctcgacgtcatcgccatccacgacaccggaggcgtcgagcatgcgtcccacctgctcaagtacgactccacgctcggcatcttcgatgccgacgtcaagcccgtcggcgactacgccatctccgtcgacggcaaggacatcaatgtcgtgtccgaccgcaaccccagcaacctgccgtggggcgagctcggtatcgacctcgtcatctagggcaccggcgtcttcctccaccgccaaggcgcggtgaagcacatccagacgtgggccaagaaggtgctcatcacggggcccggcaagggtgaaatcccacctacgtcggag

SEQ ID NO: 67370 - protein, 163 aa, Zea mays
  misc_feature: Ceres CLONE 1541888
  misc_feature (68)..(163): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSAATVPLQQGGGLSEFSGLMSSASLPMLRNATSDDFVSAVSFMTHAVGSSGGPRREPTEANLNVAIIGFGRIRRNFLQCWHGRGDASPLDVIAIHDTGGVEHASHLLKYDSTLGIFDADVKPVGDYAISVDGKDINVVSDRNPSNLPWGELGIDLVI

SEQ ID NO: 67371 - DNA, 699 bp, Zea mays
  misc_feature: Ceres CLONE 1541890
  misc_feature: Encodes the peptide sequence at SEQ ID NO. 67372
ccccgcggtggcggccgctctagaactagtggatcccccgggctgcaggaattcgtctcacccctagaaaaactaataattgctacatgtttcttccccaaacttacagcaacctctccataaactgcaagatgttgctcctcctcccgagctaccaattctccgtcgatctcctccaagctgtagcgcgctgccactcccgacccatggcctcgggatccaaaccggacagcgtgcatatcgattatcctggcggaggcctctccatcaccgaccaccacaacccaccggaatcgcgcctgcagcagaacggcgtcacgtcctggaacaggagcccctgcaacccggcgaagttcccggtgaacttcgacgcgcggcaaaagtgctacctgctcaagggcgaggtgcgggcccacatcaaggcgaagtcagagagggtggagttcggcgccagagacctcgtcatcttcgccaagggtctcacctgcacctgaaacgacaacgccgccgccgaaaggaatacaaattcgactcgtcctgactgctgagggacatcggtccgggacaggctcccctgatttggaaccgattattggttctgctgctcgcttaatcgtcaagagtaccttagcttggtagctaatctggttacatatagaccgtagccatcgctgtcttgtaagtgatataacagatctt

SEQ ID NO: 67372 - protein, 95 aa, Zea mays
  misc_feature: Ceres CLONE 1541890
MASGSKPDSVHIDYPGGGLSITDHHNPPESRLQQNGVTSWNRSPCNPAKFPVNFDARQKCYLLKGEVRAHIKAKSERVEFGARDLVIFAKGLTCT

SEQ ID NO: 67373 - DNA, 723 bp, Zea mays
  misc_feature: Ceres CLONE 1541898
  misc_feature: Encodes the peptide sequence at SEQ ID NO. 67374
  misc_feature (355)..(355): n is a, c, t, g, unknown, or other
  misc_feature (427)..(427): n is a, c, t, g, unknown, or other
  misc_feature (473)..(473): n is a, c, t, g, unknown, or other
  misc_feature (502)..(502): n is a, c, t, g, unknown, or other
  misc_feature (519)..(519): n is a, c, t, g, unknown, or other
  misc_feature (555)..(555): n is a, c, t, g, unknown, or other
aaagctggagctccccgcggtggcggccgctctagaactagtggatcccccgggctgcaggaattcgtctcacccctagaaaaaactcaaacaaactcaagcctgccctgccctgccttgttaagcaaagcaacccagctgcgagacacgagagctagctagagagagatggcggccacggtttcgtccttcccggtggtgaacatggagaagctggagaccgaggagagggccacggccatggaggtcatccgcgacggctgcgagaactggggcttcttcgagctgctgaaccacggcatctcgcacgagctgatggacgaggtggagcggctgaccaaggcgcactacgccnccttccgggaggccaagttccatgagttcgcggcccggacgctggaggccggcgagaagggcgccgacgtcnaggacgtggactgggagagcaccttcttcgtccgccacctcccggnctccaacctcgccgacctccccgatgtcnacaaccgctacaggcangtgatggagcatttctcatctcatatccaagaaacngtctgaaaggctgctggacctgctgtgcaagaacctggccctggagcccgggtacctgaaggcggccttccccgggccagaaggcccgaccttccccaccaggtgatcgcgtacccaccgtgcccgcgcccggaactcgtcaacagccttcgatgggtcttttgatag

SEQ ID NO: 67374 - protein, 130 aa, Zea mays
  misc_feature: Ceres CLONE 1541898
  misc_feature: SWISSPROT Homolog: EC 1.14.17.4 Aminocyclopropanecarboxylate oxidase
  misc_feature (63)..(63): Xaa is any aa, unknown, or other
  misc_feature (87)..(87): Xaa is any aa, unknown, or other
  misc_feature (102)..(102): Xaa is any aa, unknown, or other
  misc_feature (112)..(112): Xaa is any aa, unknown, or other
  misc_feature (117)..(117): Xaa is any aa, unknown, or other
MAATVSSFPVVNMEKLETEERATAMEVIRDGCENWGFFELLNHGISHELMDEVERLTKAHYAXFREAKFHEFAARTLEAGEKGADVXDVDWESTFFVRHLPXSNLADLPDVXNRYRXVMEHFSSHIQETV

SEQ ID NO: 67375 - DNA, 1034 bp, Zea mays
  misc_feature: Ceres CLONE 1541903
  misc_feature: Encodes the peptide sequence at SEQ ID NO. 67376
ggaagcttctcccaccgccaccggagccccacacgcccctcgtcctcggatcccatcccgtcgccgcactggtcggacgaacagaagcggaggtctcgacgaatccgtgacgccgacgtgggtttgcctctgtacttctggaatcggaaagaggtgtgtcgtgcggtgcgtgtccaattctaaccccttcctatcgaccatcattctcccctctgcctgcgtcgtcctcgccgccatggaccttgcggacgggcgatacgacgccctgaatggaggcgtcggcgtcggcgtggaggagacaaggagaaggaggaaggtggagctggtgcaggaggccatccgtggcttcctggaagagaagaggagcgatggccagggaggaggagaggagcgcttgacggccaggctcagggaggaggagcaggagctcctgttgtcgttgctctccaagttgggcgagctaaaaaccgaccccgatccagacatcttggaagaaccgagctcctcccgcccggaccacggccaccagcctgcaggaggaggagaacgcagcaaggaggtggagccagctgacatcgccaaggacctgagcaagatcaagaggcagaacacgatcacccacctcctcctcggcgccgtcatcgtcctgaccgccgtgtggcaggtcaacgaggtgtcgttcctcctctggctgcagagcaagctgagcaaccccttcaagtccctcggggacatggtcaaggcctccctcctcaagcttagagggaggaggccggtgctccagtcgtcgccgctgccgctggccggcgtccccgacgtcagccgggctgatctgccgacgcttgtcatcggcggcaccgagcacgtaggtaaatgagctagctgtgtggtgatccgaggattgattaaaatgtccagcatctgtttgttgcgattaatttatgaactgggattgattcttgaattatgaactgacacaccaacatttccaggaggcatataatgcctgggagccaagtatttctagattctct

SEQ ID NO: 67376 - protein, 213 aa, Zea mays
  misc_feature: Ceres CLONE 1541903
MDLADGRYDALNGGVGVGVEETRRRRKVELVQEAIRGFLEEKRSDGQGGGEERLTARLREEEQELLLSLLSKLGELKTDPDPDILEEPSSSRPDHGHQPAGGGERSKEVEPADIAKDLSKIKRQNTITHLLLGAVIVLTAVWQVNEVSFLLWLQSKLSNPFKSLGDMVKASLLKLRGRRPVLQSSPLPLAGVPDVSRADLPTLVIGGTEHVGK

SEQ ID NO: 67377 - DNA, 636 bp, Zea mays
  misc_feature: Ceres CLONE 1541904
  misc_feature (141)..(141): n is a, c, t, g, unknown, or other
  misc_feature (146)..(146): n is a, c, t, g, unknown, or other
  misc_feature (267)..(267): n is a, c, t, g, unknown, or other
  misc_feature (269)..(269): n is a, c, t, g, unknown, or other
  misc_feature (391)..(391): n is a, c, t, g, unknown, or other
  misc_feature (431)..(431): n is a, c, t, g, unknown, or other
  misc_feature (482)..(482): n is a, c, t, g, unknown, or other
gtctgaatagtggatcccccgggctgcaggaattctctccccctagaaaaagtccacctgcacgccgcggcagcagccaagcctctctcgtctcgtgcggcaagcgccacacagacacccgatggcgctcctgctgctggngcggnttgcgccgcacgccagccgcccaccggccccggggggtccccgctgctcccctccgcgctgcccggggggggattcttgccccctcccccctcttcgggcctttctcccgggctcccgggnanaaaaaaaagggggggaggtccctccccgatgaacggccgcgttgaacgggaccaggggggggggacccatttttttctttcgcctcccctcccgggggggggggggggggaggaaatgtggnggggggagggggtgtgtggcccccccctggtgggggaaanaaaattaataaataattgtctcttggtcgtgatttagtctttttcctgagnagtttgaacgctcggcggagcgcagatgggttgtccccaactccttcctgctcgtcgtatccgccgggaggcacacccgcctcgacccttccaatagagtcatcccgggggcgtgtccagctctaacctgcaggtatccccccgggcctccccg

SEQ ID NO: 67378 - DNA, 515 bp, Zea mays
  misc_feature: Ceres CLONE 1541907
  misc_feature: Encodes the peptide sequence at SEQ ID NO. 67379
  misc_feature (241)..(241): n is a, c, t, g, unknown, or other
  misc_feature (277)..(277): n is a, c, t, g, unknown, or other
aaagctggagctccccgcggtggcggccgctctagaactagtggatcccccgggctgcaggaattcgtctcacccctagaaaaagcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggccgagctcgctgagcaggcngagaagtaccaagagatgggtgagttcatggaaaanggtacccagactggtgactcggaaggactccctgggggaggacgaaacctccttgcctgtttgcatacaaaaacgtccttgggaccccgccgggcctcaggggcaaccatctccccccatttaaaaaaaaggggaggggcccaagggccttggggccccaataaccccctcccggggattttccgggggcaaatttggacacgggcctttccccaaaaatttggggggggcggccccc

SEQ ID NO: 67379 - protein, 112 aa, Zea mays
  misc_feature: Ceres CLONE 1541907
  misc_feature (33)..(33): Xaa is any aa, unknown, or other
MASAELSREENVYMAELAEQAEKYQEMGEFMEXGTQTGDSEGLPGGGRNLLACLHTKTSLGPRRASGATISPHLKKRGGAQGPWGPNNPLPGIFRGQIWTRAFPQKFGGGGP

SEQ ID NO: 67380 - DNA, 803 bp, Zea mays
  misc_feature: Ceres CLONE 1541921
  misc_feature: Encodes the peptide sequence at SEQ ID NO. 67381
  misc_feature (22)..(22): n is a, c, t, g, unknown, or other
  misc_feature (803)..(803): n is a, c, t, g, unknown, or other
ttcttatttctaacaaaaaccncaacgtaggaaaatctaaataaaaacaggaactccccgcggtggcggccgctctagaatagtggatcccccgggctgcaggaattcgtctcacccctagaaaaaaagcacagcacacacaccccgcacaccgcaccagctcagctcagctcaccaagacaatcaatcatggctcgtccgcgcagtgtcgctgccgctgcccccctcctcctgctgctcgccgccgccgcagcggggctcgtgtccgccgcgtcgccggcagccagcgacttcgtccgcaagacgtgccgcacgacgcaatacccttcggtgtgcgagcacaccctggcgtcgtacggcgggtcgccgccgccacggagcccgcgagagctggcgcgcgccgcgctgtctgtgagcgcggaccgctcgcgcgccgcgacagcgtacctgggccgccccccccgcgccagctacggcaaaggcgcgaagaaggggtcgagatcagcgtcggcgtcggcaagtcccgtgcgcgactgcctgtacaatctgggggacagcgagggccacctccacgacgcggcacatgatatgggcggctccagaatgaggtcgcgcggggacccccgagttctacgaggtaccttcatcaaagtgtcaagacctggttgcagcgctcgcgcttcaccgacgaaggacaacctgccttcgaaaaggcttctcagccacccgagacgtccgaagcctgggaacggcgacgccagcctatacacggggacaagggtccattcttagggatcgacggn

SEQ ID NO: 67381 - protein, 200 aa, Zea mays
  misc_feature: Ceres CLONE 1541921
  misc_feature (30)..(183): Pfam Name: PMEI Pfam Description: Plant invertase/pectin methylesterase inhibitor
MARPRSVAAAAPLLLLLAAAAAGLVSAASPAASDFVRKTCRTTQYPSVCEHTLASYGGSPPPRSPRELARAALSVSADRSRAATAYLGRPPRASYGKGAKKGSRSASASASPVRDCLYNLGDSEGHLHDAAHDMGGSRMRSRGDPRVLRGTFIKVSRPGCSARASPTKDNLPSKRLLSHPRRPKPGNGDASLYTGTRVHS

SEQ ID NO: 67382 - DNA, 765 bp, Zea mays
  misc_feature: Ceres CLONE 1541923
  misc_feature: Encodes the peptide sequence at SEQ ID NO. 67383
  misc_feature (24)..(24): n is a, c, t, g, unknown, or other
  misc_feature (56)..(56): n is a, c, t, g, unknown, or other
  misc_feature (386)..(386): n is a, c, t, g, unknown, or other
tccccgcggtggcggccgctctanaactagtggatcccccgggctgcaggaattcntctcacccctagaaaaaaaggcttggcttggtgggaagaagacaacgccggcacgcgcacgcagacacgatggcgatctgcagcgcgcacactaccacctccctgcgctccccatgcacaaccgtctcgaacgcaggtctgaggcagaagcaagtcatcttcgtcaccagcaacaggaggagcggcggcggcaggaggcacggaggggcaaggagcttccaggtctcgtgctccgtcaacaagccggtggtgattggcctggccgcagactcagggtgcggcaagagcacctttatgcgcccccctcggcgggggggggggggggcccanccaaacctcccccaggcccccccacccttgactccaacgacgctcctcagtgacaccgccgacggggatatcccctccaccactaacctttcccctgggacgggaacggacccgaacggaaaaacggcgtcaacccgcccccccacccaaggggccaaacacctttcgtctctcgggcttaaaactgctggaaagcgaatcccagcggagccctgcctgccttaaaaatgcccatctaacgagcttcggccctacgcctcctacccccctggaggaaggtaaaccctccccccctgagttgctttcgcactatgaacgctcctcttcctgaaggtgcccgaaacgcagcggcgaggtcccgcccggatttccaatagtc

SEQ ID NO: 67383 - protein, 161 aa, Zea mays
  misc_feature: Ceres CLONE 1541923
  misc_feature: SWISSPROT Homolog: EC 2.7.1.19 Phosphoribulokinase
  misc_feature (87)..(87): Xaa is any aa, unknown, or other
MAICSAHTTTSLRSPCTTVSNAGLRQKQVIFVTSNRRSGGGRRHGGARSFQVSCSVNKPVVIGLAADSGCGKSTFMRPPRRGGGGAXPNLPQAPPPLTPTTLLSDTADGDIPSTTNLSPGTGTDPNGKTASTRPPTQGAKHLSSLGLKTAGKRIPAEPCLP

SEQ ID NO: 67384 - DNA, 752 bp, Zea mays
  misc_feature: Ceres CLONE 1541924
  misc_feature (752)..(752): n is a, c, t, g, unknown, or other
gtggatcccccgggctgcaggaattcgtctcacccctagaaaaaaacacgcctctccagctctcctctactagacttgttttttccgtccatcgtttcgtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctggagctccagctccgggggggtggtggtcactagcttgcctggtttcgagggcgacctcaccttcggcctcgttaacagggaacgtggtagtgctatacccccccccgccaggagcctcttcatctacttcctgcccgccgaaatctgccgcccgcgggctaccgcggatggacacccctttgccttccctggactaaccggggggaaacggtgtgcagcgtactttgtgcggcgctcggcttatcagaatccagccctaatccgaaatacgccgcgggaaacatggcaccctctcccctatggccctgtgtctgagtttggattccacagtctccaggcctccatatgttgcctacgatgtattgtcttgtcggccactctacgcgttggggcatgtgcttttagttggtgtacctcgggtctcattgtagtagggtttagccctctgtcttgaaagtatcttcgctgctgcctctacn

SEQ ID NO: 67385 - DNA, 735 bp, Zea mays
  misc_feature: Ceres CLONE 1541926
  misc_feature: Encodes the peptide sequence at SEQ ID NO. 67386
  misc_feature (413)..(413): n is a, c, t, g, unknown, or other
  misc_feature (415)..(415): n is a, c, t, g, unknown, or other
atccctggagctccccgcggtggcggccgctctagaactagtggatcccccgggctgcaggaattcgtctcacccctagaaaaaaatccagcacaacagcatcatggcgctcaccacgagcactaacaaccaagccttgcttgacgctcagctagagctctggcacacatcctttgctttcatcaagtccatggctctcaagtctgcagtggaccttggcatagccgacgccatccacagccacggtagcaacgccaccctgccccagatagtttccagggccgcgctccacccgtccaagatcccctgcctgcgtcgcctcatgcgggtgctcacagccgccggcatcttcagcgccgcccaccgctcgccggacgagggggggggcgagctcgtctatggactcacaccgncntctcagctcttggttggcggctcttcaagcctggctcccttcatgtccctggtgttacaccaggtctacgtgtcgcctttccttggcctcggcacatggttacagcacaagcgctcaaacccgaccctgtttgaaaagacgcatgggctcactgcctgggacttgaatgaccccaaacccgccttcggggagcttctttcaccaaggtatgggcctgcgaaaacaacttcttcatggaaattgtcgtcaaggagggcgggaacctccttctggggtctgaactcccctgtgcaacatctccggaaggtatgggttccgcg

SEQ ID NO: 67386 - protein, 210 aa, Zea mays
  misc_feature: Ceres CLONE 1541926
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
  misc_feature (104)..(104): Xaa is any aa, unknown, or other
MALTTSTNNQALLDAQLELWHTSFAFIKSMALKSAVDLGIADAIHSHGSNATLPQIVSRAALHPSKIPCLRRLMRVLTAAGIFSAAHRSPDEGGGELVYGLTPXSQLLVGGSSSLAPFMSLVLHQVYVSPFLGLGTWLQHKRSNPTLFEKTHGLTAWDLNDPKPAFGELLSPRYGPAKTTSSWKLSSRRAGTSFWGLNSPVQHLRKVWVP

SEQ ID NO: 67387 - DNA, 733 bp, Zea mays
  misc_feature: Ceres CLONE 1541927
  misc_feature: Translation starting site: 149
  misc_feature (340)..(340): n is a, c, t, g, unknown, or other
  misc_feature (366)..(366): n is a, c, t, g, unknown, or other
  misc_feature (403)..(403): n is a, c, t, g, unknown, or other
  misc_feature (404)..(404): n is a, c, t, g, unknown, or other
  misc_feature (428)..(428): n is a, c, t, g, unknown, or other
  misc_feature (434)..(434): n is a, c, t, g, unknown, or other
  misc_feature (459)..(459): n is a, c, t, g, unknown, or other
  misc_feature (487)..(487): n is a, c, t, g, unknown, or other
  misc_feature (504)..(504): n is a, c, t, g, unknown, or other
  misc_feature (510)..(510): n is a, c, t, g, unknown, or other
  misc_feature (551)..(551): n is a, c, t, g, unknown, or other
  misc_feature (552)..(552): n is a, c, t, g, unknown, or other
  misc_feature (573)..(573): n is a, c, t, g, unknown, or other
  misc_feature (602)..(602): n is a, c, t, g, unknown, or other
  misc_feature (604)..(604): n is a, c, t, g, unknown, or other
  misc_feature (611)..(611): n is a, c, t, g, unknown, or other
  misc_feature (612)..(612): n is a, c, t, g, unknown, or other
  misc_feature (632)..(632): n is a, c, t, g, unknown, or other
  misc_feature (633)..(633): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (659)..(659): n is a, c, t, g, unknown, or other
  misc_feature (668)..(668): n is a, c, t, g, unknown, or other
  misc_feature (686)..(686): n is a, c, t, g, unknown, or other
  misc_feature (713)..(713): n is a, c, t, g, unknown, or other
  misc_feature (716)..(716): n is a, c, t, g, unknown, or other
  misc_feature (730)..(730): n is a, c, t, g, unknown, or other
  misc_feature (733)..(733): n is a, c, t, g, unknown, or other
ccccgcggtggcggccgctctagaactagtggatcccccgggctgcaggaattcgtctcacccctagaaaaaaaaaaaccaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggctgaggccaagggcgagtggttccccgggcttccctccccctcctacctcgacggnagcctggcgggtgacaatggctctcnacccgttgggcctggcggaggatcccgataacctccnntggttcgtgcacgccgagctggtngaaggncggtgggccatgcttggcagtggcngggacgcccatcccggaggtgccgaccnaagccgggctgattaanttccgnagcgctacgacgccggctagtcggagtacttcccgtccccnntccaccctcctcgtgcgccanttcatccggttcacctaaccgaacctccngnaggcgcnngtccatcagaaaacagcggnncgcgnnncccagggaccccctcttcnagaaccacnagcccgggcgcacccccnattcgcgccccccccggggaaacggtnttngaaatcgccccaanttn

SEQ ID NO: 67388 - DNA, 624 bp, Zea mays
  misc_feature: Ceres CLONE 1541929
  misc_feature: Encodes the peptide sequence at SEQ ID NO. 67389
  misc_feature (30)..(30): n is a, c, t, g, unknown, or other
  misc_feature (51)..(51): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (182)..(182): n is a, c, t, g, unknown, or other
  misc_feature (195)..(195): n is a, c, t, g, unknown, or other
  misc_feature (201)..(201): n is a, c, t, g, unknown, or other
  misc_feature (261)..(261): n is a, c, t, g, unknown, or other
  misc_feature (294)..(294): n is a, c, t, g, unknown, or other
ggagctccccgcggtgggcggccgcttcantagaactagtgggattccccnccgggctggcagnngnnnaattcgtctcacccctagaaaaaaaggtcttcctccccgcgctcccgccgccgcccctcctcactgcccccgtcttctcgcggtagccggccgacgaaatcgggtgccggcgncgcggcgatgtcngctgcngcggcagcgccagcgcaggctcccagggaagtgggagggactagtggaaccaagtgctcnaaagggaagtgctgggcaacgtgcctgaaccangcccccgagcgccgccgaatccgggaaggctttaaggaagttcagctcagaatgaacattggccctttaaggggaaaattagggggctccaaacaagggtgcctgggggcctaacccttggggggggggaaattttccaaaaaggggggtttcccgaaaatccccaaaaaagaacaattttgtctttttccccgggtttaagaaaaacattgcccctttttttttttggggggggtcccaaaaaaaaaatcctcccccgggagaagagggaaattttttgggggggaccacccccgggttttgtgttctttaaaaaaaaatttttttggg

SEQ ID NO: 67389 - protein, 50 aa, Zea mays
  misc_feature: Ceres CLONE 1541929
  misc_feature (10)..(10): Xaa is any aa, unknown, or other
  misc_feature (17)..(17): Xaa is any aa, unknown, or other
  misc_feature (21)..(21): Xaa is any aa, unknown, or other
  misc_feature (22)..(22): Xaa is any aa, unknown, or other
  misc_feature (23)..(23): Xaa is any aa, unknown, or other
SSPRWAAASXELVGFPXGLAXXXFVSPLEKKVFLPALPPPPLLTAPVFSR

SEQ ID NO: 67390 - DNA, 694 bp, Zea mays
  misc_feature: Ceres CLONE 1541930
tggagctccccgcggtggcggccgctctatactagtggatcccccgggctgcaggaattcgtctcacccctagaaaaaagcaaatgaaccagccacaataatcctgatcctcgatcttgcgttgtcgtcgtcaaagagacgactcgatcatcatctcatctcagagcacgcaagccaacatggttactagcatccgcgtcataattgggaatcataggatctgtagtctgtgtgctcttcctacccggttccgtggctgacctttttaaaaaaattggtgaaaagagaggccaccctttggggaagttttccgggggtgggccattaatccctcccccccttttttaagccccttcccccggggggtggggaggggttccccccccctcccggtggcgggtggggaaaaaaattttttttttttttgaaaagttgcccccctcaaaaagctcttcttttaaaaaattttttttgcccccccctaaaaaacatttgggtttttccccccaaaaaaaaaaaaaaaaaaaaccctccccccccccacaaagaggtctcccccctggggggggaaacacccccggggccctgcatatttttttttgagagttttttttttttccccccccccattcagagaaaaaattttttttgggtgcggttgttgttatataccccccctcccatttgtgggcgg

SEQ ID NO: 67391 - DNA, 787 bp, Zea mays
  misc_feature: Ceres CLONE 1541931
  misc_feature: Encodes the peptide sequence at SEQ ID NO. 67392
  misc_feature (787)..(787): n is a, c, t, g, unknown, or other
tatttctaatccaacacacacactaacccccccatttttatattataaaagctggactccccgcggtggcggccgctctagaactagtggatcccccgggctgcaggaattcgtctcacccctagaaaaaagccacgcgctcaactccacgggccttgagctagggttttcttcgccgctacctccctacgaggcgggcgtgcagccatggcgctggtgcaggcgggcatgggccttacccgggtcgttatcctcgtcggcgccggcgttgccggctccgtcgtcctccgcaacggccgcctcgccgagatcctcggcgagctccaggagatactcgacaaggggaagaaggtgaaggatggaggagggggagacggggaaaccgatctcaacgaggctcttacctcgcaggtgcgtcgccttgccatggaggtccggcaacttggtaattcacgttcaataaatgttctcaatggaggttctgcacaatcaggagtatcaggcctgatagaacctgcagcaactgtaggagcactgggttacggttatatgtggaggaaggggatctcgttctcagaacccatgtatggcaccaagcgcaaacatggcaaatgctcgtttcaaggcatgactaaaacattttggagccaagtgcaaaagttccccttggctgctggataaacaggcatctttaaaaaaacaccatctgaaaaagtttgtgacgataatacttgggaatctagccaaaaaggcctccttatcttgggacctaaagtcaagaaaattn

SEQ ID NO: 67392 - protein, 157 aa, Zea mays
  misc_feature: Ceres CLONE 1541931
MALVQAGMGLTRVVILVGAGVAGSVVLRNGRLAEILGELQEILDKGKKVKDGGGGDGETDLNEALTSQVRRLAMEVRQLGNSRSINVLNGGSAQSGVSGLIEPAATVGALGYGYMWRKGISFSEPMYGTKRKHGKCSFQGMTKTFWSQVQKFPLAAG

SEQ ID NO: 67393 - DNA, 712 bp, Zea mays
  misc_feature: Ceres CLONE 1541935
  misc_feature: Encodes the peptide sequence at SEQ ID NO. 67394
  misc_feature (284)..(284): n is a, c, t, g, unknown, or other
  misc_feature (695)..(695): n is a, c, t, g, unknown, or other
tcccccgggctgcaggaattcgtctcacccctagaaaaagaaggccgagctcatccaatccagtcgcctgattgcattgggatcccatggccaagctcgccgtcctcctcctcctcctcgccgtggccgcgtccgccacagtgccggcgcacggccgcgataccccgactgagatcaagctcatcaaaggcacggacgcctccggcgtgggcgacgacagcatggagtgcgtgtacacggtgttcatccggacggggtcgatcttgaaggccgggacggacgcnaacgtcacgctggagctggccgccgcggacggcaacggcgtggggatctcgaacctgcccgcctggggcgggctcgtggggcagggctactcctacttcgagcgcagcaacctggacatcttcagcggccgcggggccctgcatggccaaagcgccgtgctggatgcggttggccacccacggctccggcgaacacccacgggggggaatgcaactaccgtggaagtcaccaccaaggggcccgcacaaaggggtgtgggtgaacagctgagtcaccggacaaggaaatgggttccgcagtgaagagccccgccctttcaaggctcaaagggctatccccgaactaccgaaacacgcgtacccccctaagagcgacctaaggagggtaatgaaactcgcattcggagactngagtaagacgaaacccc

SEQ ID NO: 67394 - protein, 166 aa, Zea mays
  misc_feature: Ceres CLONE 1541935
MAKLAVLLLLLAVAASATVPAHGRDTPTEIKLIKGTDASGVGDDSMECVYTVFIRTGSILKAGTDANVTLELAAADGNGVGISNLPAWGGLVGQGYSYFERSNLDIFSGRGALHGQSAVLDAVGHPRLRRTPTGGNATTVEVTTKGPAQRGVGEQLSHRTRKWVPQ

SEQ ID NO: 67395 - DNA, 817 bp, Zea mays
  misc_feature: Ceres CLONE 1541939
  misc_feature: Encodes the peptide sequence at SEQ ID NO. 67396
tccctttccccactatatggcggggagtacaacacacataattaaataattgggactccaccgcggtggcggccgctctagaactagtggatcccccgggctgcaggaattcgtctcacccctagaaaaagcacacaagcacaccgctccgcacttctccctgtcgtctcgcccgcccgcgcgcgcggtcgtttaaccttttttctcccaccgctcgccccgtcccgctttccccccggcagcgacgactcctgcggaggtacagagagatgaggacgaggagcgggtcccggtattccaacggcggcgaggtggttgccttggtgggtcagaagaggaagaggtcgccgtcggccgtctccggagagtgcgactgcggcgggcgcaggaagcggcctgccggcgagccggactacctggacgcgcttcccgatgaccttatcctctccatcctgtccaagctcgccgccgcctccttagcgccgtccgacctgctctcggtccacctcacgtgcaagaggctgaacgagctcggcagccctgaaatggtgttccccaagggcctcgccggcttctctgggcttccaggcgggcggcgtggtcccaagcccggccaaagagttcctccagccgcttgcgccaacgccaggaaaacttcgaagggactggctaccaaccctgggacatagatccgccattctaattgcttgggcaatatccctaacaggcaggcaccgggccactgccaggactcgggggcgaggccggcgtgcgtgagccagacgggagaggaccacttatctaggcggtgggaggg

SEQ ID NO: 67396 - protein, 139 aa, Zea mays
  misc_feature: Ceres CLONE 1541939
MRTRSGSRYSNGGEVVALVGQKRKRSPSAVSGECDCGGRRKRPAGEPDYLDALPDDLILSILSKLAAASLAPSDLLSVHLTCKRLNELGSPEMVFPKGLAGFSGLPGGRRGPKPGQRVPPAACANARKTSKGLATNPGT

SEQ ID NO: 67397 - DNA, 708 bp, Zea mays
  misc_feature: Ceres CLONE 1541941
  misc_feature: Encodes the peptide sequence at SEQ ID NO. 67398
gctctgtactagtggatcccccgggctgcaggaattcgtctcacccctagaaaaactagaaaaaataacgctcgcacggccgagccccgacattctaccgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctgttatttttcttaacccggctttctctcgattgctgcgtaaagttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctttcagaatccggatgacagacttgattctcgataagctggataatatgggtgtaatttcaacaaaagagagcttgttaaagtgtgagaaactgtcagtgagcgccttctgcaggcggagacttgcaacaggtatggtgaagctcaagtttgcagagcaccttaaggaggctgtgacgtacatcgaacaggggacgtgcgtgt

SEQ ID NO: 67398 - protein, 135 aa, Zea mays
  misc_feature: Ceres CLONE 1541941
  misc_feature (1)..(106): Pfam Name: Ribosomal_S4 Pfam Description: Ribosomal protein S4/S9 N-terminal domain
MRKLKFHEQKLLKRHNFLEYKREGGHREALVTQRYRLVERDDYKKYNGICLMVQKLVNIIKQMDPRDPFRIRMTDLILDKLDNMGVISTKESLLKCEKLSVSAFCRRRLATGMVKLKFAEHLKEAVTYIEQGTCV

SEQ ID NO: 67399 - DNA, 722 bp, Zea mays
  misc_feature: Ceres CLONE 1541944
  misc_feature: Translation starting site: 166
  misc_feature: SWISSPROT Homolog: EC 1.11.1.7 Peroxidase
aaactggagctccccgcggtggcggccgctctagaactagtggatcccccgggctgcaggaattcgtctcacccctagaaaaagctcaccgagttcgtcggcactcacttgatgttttatccgaaggatcaccggaatctatactggcaatggcatctacgaatgatggcttccatgctacacctccgcgtgcatgcggagcctgctgctcccgtctgctcctgctggccgctggcgccctgtgctcgtgcggcgcactggctcaggctgacctccgactactacgactgcgcatgccctgacacctaccacctgctaaagcaggtcctgattcacgcgcacaattccgatatgatcatctacgcctgcctcccccgcctgaaatttcacgactgcttagtccagacacaaccatagcatcagtgcttctgcactgctttccgggcctggcaaactccagtgagaagctcgcgcccgacaacaacaactgaacgcgatggttcccggtggtgtacaaagtgaacgcggcactggacgacacctgccccggcatcgtctcctgctgctacatcctctgcctcgcggaatagatctcagtcgaactgtcgagaagaccaacgtgcgcaatgattcctaggaggctagaaagcaacactgcggacttctagaccgcgtagaatttgccatcgacctttcgaaagctgaaggtgctggatcataga

SEQ ID NO: 67400 - DNA, 714 bp, Zea mays
  misc_feature: Ceres CLONE 1541945
  misc_feature: Encodes the peptide sequence at SEQ ID NO. 67401
  misc_feature (223)..(223): n is a, c, t, g, unknown, or other
  misc_feature (391)..(391): n is a, c, t, g, unknown, or other
  misc_feature (461)..(461): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (667)..(667): n is a, c, t, g, unknown, or other
  misc_feature (691)..(691): n is a, c, t, g, unknown, or other
aagctggagctccccgcggtggcggccgctctataactagtggatcccccgggctgcaggaattcgtctcacccctagaaaaaccggtcactgaagaaggccagcgaggcacgcgcttggaggctcaccgcgttccagcgcctcgagttcacctgcgacgacgtgctagacagtctgaaggaggagaacatcatcggcaaaggtggagccgggattgtgtacnaggggacgatgccggacggtgagcatgtcgcagtgaagcggcctttcgtcgatgagcccgtggctcgtcgcacgacccacgggttctctggcaaagataccaaaccctccgggagggattccgggccccgctacatccgggagggttgcttcgggtttcttggtctgnaaaaaaaccgaggccccaaaattctccccttgggggggttaccaaaatttttccctctcgcccccccaanggcggggaaacccccccccgcgggggggaagaaatgtgtggtnnntttttttttttnnnnnnaaaaaaaaaaagggggggggtctctctcccggggggggagaaaacctcttataaaataaaacaccccccccacggcnnnncccccccccagaggggggggggggattnnnnntttttttttcataacaaaaatattattatttncacaccccttttattcccccccgngaggggatattaaaaaaaaaaaa

SEQ ID NO: 67401 - protein, 116 aa, Zea mays
  misc_feature: Ceres CLONE 1541945
  misc_feature (54)..(54): Xaa is any aa, unknown, or other
  misc_feature (77)..(77): Xaa is any aa, unknown, or other
  misc_feature (92)..(92): Xaa is any aa, unknown, or other
  misc_feature (96)..(96): Xaa is any aa, unknown, or other
  misc_feature (97)..(97): Xaa is any aa, unknown, or other
  misc_feature (98)..(98): Xaa is any aa, unknown, or other
MPDGEHVAVKRPFVDEPVARRTTHGFSGKDTKPSGRDSGPRYIREGCFGFLGLXKNRGPKILPLGGLPKFFPLAPPXAGKPPPAGGKKCVVXFFFXXXKKKGGGSLSRGGRKPLIK

SEQ ID NO: 67402 - DNA, 783 bp, Zea mays
  misc_feature: Ceres CLONE 1541950
  misc_feature: Translation starting site: 187
  misc_feature (1)..(1): n is a, c, t, g, unknown, or other
  misc_feature (38)..(38): n is a, c, t, g, unknown, or other
nataataaatttctcttttctcaaatgaacattcctanaatgacataataaaaaatggaactccaccgcggtggcggccgctttagaatagtggatcccccaggctgcatgaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccaaccccgagaccttcgccaagaaccacgagctggaggtgatccactcccccttgggccatgctcggtgcgatacggctgcgtcttcccccaacagctctcccgcaacggcgtcaagtatcgcgaggcccgtactggttcaaggccaggttcccaaatctttcagcgagggcgcggctggaactaccccgggcaacacccagccctgaaaccacgctgaaaaaagataccatctccaatcagagcgcctgccaaggtctaaagctcaaggagttgctctatcctaggggctttccggtattttgacaggtagggagcacgtctccggctgaatgactctttctaactac

SEQ ID NO: 67403 - DNA, 907 bp, Zea mays
  misc_feature: Ceres CLONE 1541960
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (835)..(835): n is a, c, t, g, unknown, or other
ctctctccgccccgtccggcttgaatnnntcttcannnnncaataactggactccccgcggtggcggccgctctatactagtggatcccccgggctgcaggaattcgtctcacccctagaaaaactctcccatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcggctagggcccctccgggctcgagaagggggggttttctggggctcggaactgctgtgccccaatttatctttaggggaggtcaagtctacttcatggaaggatgggccccgcgggaaaagctgggcttgcgcctcaggaagcgaaggctaatctttcagaccttcccaaaagccgaatgccgcggggtggcggctaactaaggccttgccgtgtctccgtcgttattagggccccctgatgtggaatactcttggttattggaggcctggttagttccgtcttaggtagcaccttgagttgtgtggagctgctggggagagtgaaatgtcctgcggcagcggtatacagagcaaacggcggcggcgccctggacaaggtgcatgtaggcgtgtgacagggggtggtcggacgcggctctgtatgttgcgtgagttggtagagttggcgaggaccgcccgcgcatctagaaacgaagctcctgaggattncgtatgagcggctgggaggagcatccgatgaggactgacgtgagcgcggggtctaataatgaaaggattaga

SEQ ID NO: 67404 - DNA, 937 bp, Zea mays
  misc_feature: Ceres CLONE 1541964
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (676)..(676): n is a, c, t, g, unknown, or other
aggcgtggtgtcactcttcggatcggcgacccagcaaagnnnanaagcgggtatctccactcgcggcggccgctctataactagtggatcccccgggctgcaggaattcgtctcacccctagaaaaagtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctaggctagccgcgactctgttggctagaccatttaagcccgcagcgcaggaatgggtggcaccccgtggttgaaccgccccctcccggggcggggggggggcaggactcgttatgacataatggtcattttctccccaccccggggaaacggggcctacccgggccgggctcttcctacgatgggagaccgcgtgcggtcctgctggctgtcggacgcagttgggatggatttgttttccccggctccacggcatgaagatcggcagctttccggaagacacgcgtgatgggtacccgaaagtggaggtagacccgtctcgtctgagccccgtantcacttgaggctacggcgggcagggtggaagagaaatctatctgcgccagcagatcgagcggcgtggtgtctcccggactatgatgtcgcaaacaccgatcttgtttgccacgcttattgatcaattccgtcgaccgtgagacaaacggtcgagtttgcggtgtgctcgctgcctgtgccacccgtcattcataaccagcgcggcattagattactgaattgtggacttgctggccatgtgtgtgatcactacgctcgtgg

SEQ ID NO: 67405 - DNA, 829 bp, Zea mays
  misc_feature: Ceres CLONE 1541965
  misc_feature: Encodes the peptide sequence at SEQ ID NO. 67406
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (555)..(555): n is a, c, t, g, unknown, or other
  misc_feature (829)..(829): n is a, c, t, g, unknown, or other
catttaactacccacaggaggtgctggnnnnnnntttnnnnnnatatactggaactccccgcggtggcggccgctctataactagtggatcccccgggctgcaggaattcgtctcacccctagaaaaaaggagaacataccaacagacatcctcaggaaccgttgacgtggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgagctaggagaagtgttgatttggatattcgtggagtgtgcaatggtggactttgttcgacggctcgcctctgccctgctcaagtgctgcgaccttgacatacccaatcggccaaagggtctcgaggaccccgaacgcctgggctagagaaactgttttttaatgtgaatgaaatcgaggctctgtatgagctgttccagaagattagcagtgctggtggttgatgnatggcttggattaacaaggcatgaattccaattaagccttggtttaagaccaaccggaaaaggataagcttggtttgcttgaaccgggtatttagaacttggtttgacccctaaacacaattgggactttcccggagttttgagagaattttgcttcaagcccctttgccggggtttccgagccggagatggcaccagatcgcgagggagaaaaaagtttgatttttggcttttccaaaagcgatgtgggatctcgaagcctacgtagggtttn

SEQ ID NO: 67406 - protein, 34 aa, Zea mays
  misc_feature: Ceres CLONE 1541965
MVDFVRRLASALLKCCDLDIPNRPKGLEDPERLG

SEQ ID NO: 67407 - DNA, 670 bp, Zea mays
  misc_feature: Ceres CLONE 1541968
  misc_feature: Encodes the peptide sequence at SEQ ID NO. 67408
ttgtggatcccccgggctgcaggaattcgtctcacccctagaaaaaaacacgtccacccctatccaattacccggctcccgtctcgctgtacgagcacttctgatgaccccgctcctgcttgcatcctcctccggtggtctcgcgcctgagtacctcctccggcacccacgccaaacgctccccgtctctcgcacaggacggaaatgatgccttgtcctttttgtcaggtgagtctgatgagactggttagttcgatacacaatatccgtgatattttgctgccccaactgcaacttcgactgattgcatgacgtgaccactaacacccaccctggggaggaaatcgcagcagaaatctcgaagaaagagggcgacagaagccacatgagagaagcataagctgccatttctttcttgggttgggcatcagggagtaagatacaacaagccgtcaatgacagtactagagccgagttcggttgacgagaacccaaacaaagagcctgatggcgtgatgacgaagaggagaaacatggaagcaaatggtaagcggaagcccaggtccaacttccaggaatatctagagatggacattgttggacctgaaagcatggatgaagatctctagatgcacaggaaacttgcataaaacctctagttgaagatagg

SEQ ID NO: 67408 - protein, 57 aa, Zea mays
  misc_feature: Ceres CLONE 1541968
MTVLEPSSVDENPNKEPDGVMTKRRNMEANGKRKPRSNFQEYLEMDIVGPESMDEDL

SEQ ID NO: 67409 - DNA, 682 bp, Zea mays
  misc_feature: Ceres CLONE 1541969
  misc_feature: Translation starting site: 392
  misc_feature: SWISSPROT Homolog: EC 2.7.7.6 DNA-directed RNA polymerase
gctctagaactagtggatcccccgggctgcaggaattcgtctcacccctagaaaaaagtttcctaccttcctctcgtcccgtcagccgcttgccacaaaccctagcaagcaaaccaccggagccgcggcgctcgcgcgggcggagccatggcggaccaccattaccccaacgtcgacatgggctatgaggatgagcctcctcaacctgagatggaggaaggggcctaagaagagcttgagaacaacgaagatgcccctgatgatgtcatacgtggagagggtgaagataaggaacaggaaaagaccaagcgtgagcgcaaaacaacaaactatatgacgaagtatgaacgtgcgcgcattcttggtacacgagccttgctcatcaccatgaatgctccagtacatggttgagcttgagggagaaactgaccctcttgagattgcgatgatcgagcttatagcgcgcatgatacccttctcgatcagacggtacctacctgatggaagttatgaatactggggagtagacgagctcattgtggaggactcctggaaacgcctggttggtggagactgaggatgctgaactacttggcatggaaaggatgtggaattacaggtcttccgttgcctctgagtggatcctgaccctggagtgaaccaagaccgaaacgatgctttg

SEQ ID NO: 67410 - DNA, 902 bp, Zea mays
  misc_feature: Ceres CLONE 1541970
  misc_feature: Encodes the peptide sequence at SEQ ID NO. 67411
  misc_feature (18)..(18): n is a, c, t, g, unknown, or other
  misc_feature (28)..(28): n is a, c, t, g, unknown, or other
  misc_feature (37)..(37): n is a, c, t, g, unknown, or other
  misc_feature (39)..(39): n is a, c, t, g, unknown, or other
  misc_feature (876)..(876): n is a, c, t, g, unknown, or other
  misc_feature (901)..(901): n is a, c, t, g, unknown, or other
tttggcgttctctcgtgncacacaaaanaaaccaaananggaatatctagactccacctggtggcggccgctctacactagtggatcccccgggctgcaggaattcgtctcacccctagaaaaaagtagtcctctcctcccatccatctcatgcttcggtccacgcacccacccagccccaccagcggcagctccgcggcgccggcgtccagctccgacgccgcggcgatggtcgggggcggcgcggcagcgggcagcggcggcgcaccgagcggcgccaagctgctgcagatcctcaatgtgcgggtcgtgtgcagctgcaaccgcttggtggtgctgtcccacgggctacggcacggaacattcggcgaggaagccgtgagttccactaccataattcgtaacccccccccgggggggggggggggggggggctgctcaatacttaaaacactggcccccccctttgagctttctgcatcggatgtaaatgcttaaaacatgcgacgcggtgaaacgaacctcccgacgccagagagacgagccagattcccgccatagcagcgctttcttcggggttgctagaggacatctctcagctttatgccgcttaagagcattggcaacaactacgctcttgcgatgtccctgcgtagcacgaaggactgtgcgaacacaacttgcggtatctgtaatgctgctgttactctccgatcgcgtatttcgcagataaagataatctcgactatatatattgcgggtgagtcctcgaccgtcggcactaatgcacctcgaggaatgcagtcatgctactctaaataaggtggaccgattatcaatcgaccgttgctgaatcgcccatgtacggtatgctcngtcgattccgtggatcagcgatcana

SEQ ID NO: 67411 - protein, 115 aa, Zea mays
  misc_feature: Ceres CLONE 1541970
MLRSTHPPSPTSGSSAAPASSSDAAAMVGGGAAAGSGGAPSGAKLLQILNVRVVCSCNRLVVLSHGLRHGTFGEEAVSSTTIIRNPPPGGGGGGGCSILKTLAPPFELSASDVNA

SEQ ID NO: 67412 - DNA, 936 bp, Zea mays
  misc_feature: Ceres CLONE 1541976
  misc_feature: Encodes the peptide sequence at SEQ ID NO. 67413
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tcgttgttgttctcatcttcccccaaggngaannnntcgcgcgnnnncggcgcctacacttcttcccgggggggggccgctctacaactagtggatcccccgggctgcaggaattcgtctcacccctagaaaaaagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcccaggtgaacctcgagggccacgggtgcgggcgggcgctgccgccgccagccaaccgtgaaggggtactgtttttgccccccccccctaggggggggggggggccctctacagtaaaggtggtgcttgttcccctcgctaaccccccagggaccaattcccagttatcttgggatccaggggagctggccggtgttaaatcctccagccatcgtaggtgagccagttgagtgttccccccctggtctattttctcctccttccggtcgactgtagacggcgtaacccctggtagaggcaacaattctcagatacatctccctcgatgagtacgaatttccgcaagcctcacgcgtaacggctcctcggtcactccctagccgtgacccttgatgattatcgacggttgagaatttcgacgtccgtgtatcgtcactggacaagctcgccccgcgaggcatacaacatttggtggcgcttcccgcgcgtcagtactcctctactccggccgatctagcagtatgaacaccgggtgaatatagaagtgggtccttcgtgggattcggttgcgagtatatgtcgccgttttcctgtcacactccaaa

SEQ ID NO: 67413 - protein, 109 aa, Zea mays
  misc_feature: Ceres CLONE 1541976
MDGGYYGGRDQRYSGGYYGGGGIATPGYAPAVPYGMSQVNLEGHGCGRALPPPANREGVLFLPPPPRGGGGPSTVKVVLVPLANPPGTNSQLSWDPGELAGVKSSSHRR

SEQ ID NO: 67414 - DNA, 891 bp, Zea mays
  misc_feature: Ceres CLONE 1541977
  misc_feature: Encodes the peptide sequence at SEQ ID NO. 67415
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
tgtgttgggttttttgttttcttggcgggggnnnggcgggtnnnncgcgttggggctccccgcggtggcggccgctctagaactgtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcaccgggcagggctccggcatggccttcagcaagctgaccggcggcgggccggcaaccccggggggtctgatcccgccggcgggggcggcggggcgttccgctcttgtcttggagggtatctctcccccccggcaacgtctacgggggcgggagacgtgaatcgcctggccagggggcgtggggtgcgcccttctaggggaggcgtaaatccgccggcccgtggtctcgaggggggacgtcctcgtactggagggggcgtcgcgagcagagcgcgggggggtggtactcggaagagcgatcgatcacgtcgcggatcctgtctttcttcgatgccgtgctccgccaggttccacggggggtgacagtgcgggggagccgtgcgaggaggatgttccggtggagagctagaggcccgtgggcacctctgcacgatagtggtcgatcagagcggtactcgatatgtggcacgtcatgcaggcgtgcaagctgcgggtcgggcggatgcgcccgcggctacgcgtgtggggagtctctgggacggcgctctatccctctctgtg

SEQ ID NO: 67415 - protein, 87 aa, Zea mays
  misc_feature: Ceres CLONE 1541977
MPINRIALGSHQEVYHPGALKAAFAEFISTLIFVFTGQGSGMAFSKLTGGGPATPGGLIPPAGAAGRSALVLEGISPPRQRLRGRET

SEQ ID NO: 67416 - DNA, 715 bp, Zea mays
  misc_feature: Ceres CLONE 1541981
  misc_feature: Encodes the peptide sequence at SEQ ID NO. 67417
tccccgcggtggcggccgctctagaactagtggatcccccgggctgcaggaattcgtctcacccctagaaaaaatcactaccaccgctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgccccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgccccctgaacccaaaggctaaccgtgagaagatgacccagatcatgttcaagaccttcaacacccccgctatgtacgtcgcccatcagggccgtcctgtctctgtatgccaggggtcgtaccacaggtatcgtggctcgactcgggaagagggggtcagccccactggttccccatctacggagggatacggcccttcccccaggccattc

SEQ ID NO: 67417 - protein, 116 aa, Zea mays
  misc_feature: Ceres CLONE 1541981
  misc_feature (4)..(117): Pfam Name: Actin Pfam Description: Actin
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPPEPKG

SEQ ID NO: 67418 - DNA, 717 bp, Zea mays
  misc_feature: Ceres CLONE 1541983
  misc_feature: Encodes the peptide sequence at SEQ ID NO. 67419
tcgtggatcccccgggctgcaggaattcgtctcacccctagaaaaaaccgccgcccccacatctatccacccgcccgcccgtccgtccgttcgttcgtctccacgcgcaaacgagagagagaaggctaggtcgtcgtcgtcgtgaggcggagagatctgggaggaggaggagcgatggacgggaagctacccccgccgaacccgaacctgccgtaccgggaggactgctggagcgagggcgagacggcggcgctcgtcgacgcctggggctcgcgctacctcgacctcaaccgcgggagcctccgccagccgcagtggcgggaggtcgccgacgccgtcaactcccgcccgggggcctccgcgcgcggccgcccgccccccaccgacattcattgcaagaaccgcgtcgacacgctcaagaagaagtacaaggccgagcgcgcgcgcggcgggccgtcctccttggtcctttctcgggcagcttgacatctttcgtgggcccccgctcttcgggcatcaagatatacgtctccgcctgcgggccgcgttggccgtgtttttggagggggtagtatgcctgcctcgctctcctttcgtcgtaattggcccctgaccgcttttccggggccttcccggttgtctaaattatcccctgttggggtgcgtacctccgcttttcgcaaaactttcttccttatgggtcccctgcggtgggct

SEQ ID NO: 67419 - protein, 103 aa, Zea mays
  misc_feature: Ceres CLONE 1541983
  misc_feature: The sequence is a functional homolog of SEQ ID NO 434 in the 10/374,780 US patent application
  misc_feature: The sequence is a functional homolog of SEQ ID NO 86 in the 10/225,068 US patent application
  misc_feature: The sequence is a functional homolog of SEQ ID NO 934 in the 10/225,066 US patent application
  misc_feature: The sequence is a functional homolog of SEQ ID NO 2856 in the 10/374,780 US patent application
  misc_feature: The sequence is a functional homolog of SEQ ID NO 466 in the 10/225,066 US patent application
MDGKLPPPNPNLPYREDCWSEGETAALVDAWGSRYLDLNRGSLRQPQWREVADAVNSRPGASARGRPPPTDIHCKNRVDTLKKKYKAERARGGPSSLVLSRAA

SEQ ID NO: 67420 - DNA, 714 bp, Zea mays
  misc_feature: Ceres CLONE 1541985
  misc_feature: Encodes the peptide sequence at SEQ ID NO. 67421
caaagctggagctccccgcggtggcggccgctctagaactagtggatcccccgggctgcaggaattcgtctcacccctagaaaaagccctattttagtctgctcgacacgccaccggccactgacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactgccttgccccatggttctctcatcccactcgtactgctattcgacaacgctacaatcttgagggtagctttgaggctttcaccaggcaatgtgggtgc

SEQ ID NO: 67421 - protein, 165 aa, Zea mays
  misc_feature: Ceres CLONE 1541985
  misc_feature (64)..(165): Pfam Name: PLAC8 Pfam Description: PLAC8 family
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWNCLAPWFSHPTRTAIRQRYNLEGSFEAFTRQCGC

SEQ ID NO: 67422 - DNA, 695 bp, Zea mays
  misc_feature: Ceres CLONE 1541987
  misc_feature: Encodes the peptide sequence at SEQ ID NO. 67423
ggatcccccgggctgcaggaattcgtctcacccctagaaaaaataatctctccgcagccgactcgccccggtggggctgactgagctccggtccgcctcgacccgcggccgtacgccccggagctccacccgtcgcgccgcgtcggagctcgtcgccggcgatggcttccgcggtgggcgcttcgaccgccacgcggttcctcccgcggctcccggacccgtggcggccgcgtcgtgcgcgcgcggcgctcccgccgctcacgtggcggcctcccgcggtcacggtggccgcggcgtcgccccgacctggggaagcggaaggtaggcggcgggagaggacgcggaggcggcgcgccagggggccggggcaagaggaaggcgtctcgctaagctctgaaaaggagacgctaaattctactccacgtgctcaaaccaactaggatgcagaagcccgaaccggtgtccatgcagactgggaaaggttctgcctttagaagggggacactggttctcgctgcagggctttttggagttagcattgccttgtagggagggggcttaaaaggcttcggagtattttgctgggtatttattggaaacagagtttggcgggtggaaaatctccttttttttttgttccgggctttcagtagtttcaagtgtgccaaatgatatccctaaaccgaattctttct

SEQ ID NO: 67423 - protein, 92 aa, Zea mays
  misc_feature: Ceres CLONE 1541987
MASAVGASTATRFLPRLPDPWRPRRARAALPPLTWRPPAVTVAAASPRPGEAEGRRRERTRRRRARGPGQEEGVSLSSEKETLNSTPRAQTN

SEQ ID NO: 67424 - DNA, 828 bp, Zea mays
  misc_feature: Ceres CLONE 1541992
  misc_feature: Translation starting site: 257
  misc_feature: SWISSPROT Homolog: EC 4.2.1.1 Carbonate dehydratase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnnnnnnnggggggggggnnnnggctgtgnnnngaaaactggagctccccgcggtggcggccgctctagaactagtggatcccccgggctgcaggaattcgtctcacccctagaaaaaaaaagcgaaggcatccatccatccatagatccctcacctccctcactcgtgaagaaccagagaacccacccactgacccaccctcctccacctccaaggccatgggcgacgccgtgtagcacctcatgagcgggttccagaagttcaagaccgaggtgtatgacaagaagccggagctgttcgagcctctcaaggccggccaggcccccaagtacatggttggtcgccagctccgacacccgcgtgtgcccgtcggtgaccctgtggcctgcagcccggggaggccttcaccgtgcgcataatcgccgccatgggccctgcctactacttgaccatgttcacccccctttctgggtcgctccttcgaaaaacatcacgtagcggcccttccgaagtagtagagtaatcctttattaaactagacctttcccttctgtccgtgtggtttccctaggggggcgcaccccccctcccgggaagggggcacccctatcgactctgtccgttcaatcgaataacttggggtaatggattggggtttcccgtggcccttggccacgcccaacacacaaaaacccccccctcccgtgccccgtttcgtatgaccttctggccccccctcggggatgtaatggatgccctttgtttacttactcccttggttgagacgtactttgtaattctcaccccttgtcct

SEQ ID NO: 67425 - DNA, 561 bp, Zea mays
  misc_feature: Ceres CLONE 1541995
  misc_feature: Encodes the peptide sequence at SEQ ID NO. 67426
  misc_feature (561)..(561): n is a, c, t, g, unknown, or other
tccccgcggtggcggccgctctagaactagtggatcccccgggctgcaggaattcgtctcacccctagaaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggaccccacgcggtcggcacgaacgggcgggtcccccgggcggggccccccaacggaaggcaaaaactttaaaggggggccccccaaacggggtttgggcccccttttggggggccaaatttttcctcggggggggggtgtggaaaaaaaagggggtaggggggggggagaaaaaaaccccccccccccccccccccataaatataaaaaatcctccccaacgccaaataaaaaaaaaaaaaacaaaccccacgctgggggggggggagttgtcaacacgaataaataagagagccccgccccccccccccccn

SEQ ID NO: 67426 - protein, 153 aa, Zea mays
  misc_feature: Ceres CLONE 1541995
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTPRGRHERAGPPGGAPQRKAKTLKGGPPNGVWAPFWGAKFFLGGGVWKKKGVGGGEKKTPPPPPPINIKNPPQRQIKKKKTNPTLGGGELSTRINKRAPPPPPP

SEQ ID NO: 67427 - DNA, 662 bp, Zea mays
  misc_feature: Ceres CLONE 1541996
  misc_feature: Encodes the peptide sequence at SEQ ID NO. 67428
ggatcccccgggctgcaggaattcgtctcacccctagaaaaagtctcctcactccgccggtccaacccaacaaccagccccgccgaattccaaggtttcccgcgtgcggcggcgagcggggcgggacgtgccggggacggtggttgggttggattggattggatcggatcggtgccgcccgttgaccagagcgtaaaccagagatgggtaagggcggcggctgcgtccccagctagaagcgccagccgccggccgccgcgccttcttcgtcgtccgccgcggcggcggtgccgcgcgaggcgcccgaggaggaggcggccgccgcggtcgggcgaaagctgcggctctacatcgtgttctactcgatgtacgggcacgtggagtccctggcacggcgcgcagcggctggcgccggcgcactggacggcctggaggccgtgctgcggcgggtccccgagacgctcccgccggaggtgctggagaagatgcaggcgccggtcaaggaccccgcggtccccgtgatcgcgtcggccgcggagctgcacgaggctgacagagtgttgtttggcttcccgacgaggtactgcgccatggctgcgcaaatgatggccttcttctactccaccggctcgctctgggaggcgcataagctcgctgggaag

SEQ ID NO: 67428 - protein, 99 aa, Zea mays
  misc_feature: Ceres CLONE 1541996
MYGHVESLARRAAAGAGALDGLEAVLRRVPETLPPEVLEKMQAPVKDPAVPVIASAAELHEADRVLFGFPTRYCAMAAQMMAFFYSTGSLWEAHKLAGK

SEQ ID NO: 67429 - DNA, 656 bp, Zea mays
  misc_feature: Ceres CLONE 1542000
  misc_feature: Encodes the peptide sequence at SEQ ID NO. 67430
ggatcccccgggctgcaggaattcgtctcacccctagaaaaagcggctcatataaacctcaaaacccatccaggacagcgaccacagaaagaagagagagcacatagagtggagtggtggacagaccatggagctctgcgtctctacacccccatcctccgtacgcgccaccgccgcgcccatatccttcaccccgccccgacgtggagcgtctgcctccaccgccgttccgccccaccgccgcatcccaactctaggctggcgctgcgccagcgcggtcgtgcctggcacggtgcccaccgaagagccggcatccgcctccaacgccatcttcgtctcgtacaagcccgatacgcctgccgacgacaaggtcgaggaggtcagcgccgcgcctattggctccgcgaagacgcctatggcagagctagtgccgtcagatgcatccccgttctcagatgatggctgcctgcatgacattctaagaaagttgaacattgaaatgcctccaattttaaacatcacggaatttgggggattttaacccttaatagcacccaagcacctggaaggggctaaaaaacattcaggggccctaggtcccacaaatggcttggattgtaatggaaaaaggagtttcgcgaaattggcgcccccgg

SEQ ID NO: 67430 - protein, 137 aa, Zea mays
  misc_feature: Ceres CLONE 1542000
MELCVSTPPSSVRATAAPISFTPPRRGASASTAVPPHRRIPTLGWRCASAVVPGTVPTEEPASASNAIFVSYKPDTPADDKVEEVSAAPIGSAKTPMAELVPSDASPFSDDGCLHDILRKLNIEMPPILNITEFGGF

SEQ ID NO: 67431 - DNA, 703 bp, Zea mays
  misc_feature: Ceres CLONE 1542001
  misc_feature: Encodes the peptide sequence at SEQ ID NO. 67432
  misc_feature (703)..(703): n is a, c, t, g, unknown, or other
ccccgcggtggcggccgctctagaactagtggatcccccgggctgcaggaattcgtctcacccctagaaaaattatggactgcgatatggtacttgcaatgagtgacggtatgttttcttcttgaacttgctagatgttagagtttatgtatttgggtgttttgcccctttggcctatatgtacttgtgggaaaccctaactctaacagtacttttgtcctatgggctgttaatttattcactctttttcctccaatactagagatacagcagttcagcacaactagaatctggaatctggggattcttcctaaaacagtattgtgtttttctttaaaaaggcctaaaacaatatatttgttgatacaagcaagcactcctttttctgatatgtatctttactaccttttctgcggtgatttatgcatgccaacttggcaaactcgtgtcagatcttaaacataaaccagaactgagcagtatatcttgccctttctctttattcttttctgcttagttttgttagattgtgaaagcctgcctccagatagtattgcagcatgccagcatttacatgctaatgggttcagtttattcccagggaaagtagtggagtacgacaagcctacaaagctcgtggaaaccgaaggatctctcttccgtgatcttgtcaaggagtactggtcatacacatcgaattgan

SEQ ID NO: 67432 - protein, 33 aa, Zea mays
  misc_feature: Ceres CLONE 1542001
PRGGGRSRTSGSPGLQEFVSPLEKLWTAIWYLQ

SEQ ID NO: 67433 - DNA, 1028 bp, Zea mays
  misc_feature: Ceres CLONE 1542002-R
  misc_feature: SWISSPROT Homolog: EC 2.7.11.1 Non-specific serine/threonine protein kinase
ttcttcctctcgcgtttttttttttttttgaacataagcttcccctatttttgtaaaaggcattctagcccttggatttggatcaataattcttgacacttacttgcgtacatcacatggaaaccgtggtgggcatttgaaatctgcttttccaatatttctgtacatctccatcaaatttgaaccttggaaaggtaatgatatccagccataagaacaaatatgatcacaccacagtgaaatgtgtcaagctttgcgtcatcatatccttttcggctaataacctctggtgccacatatgctggactaccacaagttgtgtgtagaacaccatcttggcctcttgattcagcaaaagcactcaatccaaaatctgaaatttttagattcccattctcaccaacaagtatgttttccggctatccaccaccatgatatacacccctactattacaaatatctaccgcactacccaattgttggaagtatttccgaggaagcatcttctcttaactttcctttaacaaactttggtaaaactattcaccaccctttaaaatattcaagccccacacttatatcttttggaattagtcatccatgaacttcattaatagttccacccacagtttggggttgccctcaccaagttttcattccccgaatattactccctcatttataatcctgcttcacttaaagccccaaaccctttaaaaaatttatttcccctgttcaaaaaaccctttacattgcaaacaccttttaaaaaggctccccttaaacgccccaagccttggttatttctccggccaaaggttacctattccccaaggacattttcccaaccctccaacagttttgcataacaaatgtttcccattccctttttccccccccacaaaattaactaataagaacccgtgccccccactcaatttatgagatcttttatgaacaacaatcgcgcaaataacgaaataaaacctccccccggaattatttaattttctttccacattcctttc

SEQ ID NO: 67434 - DNA, 760 bp, Zea mays
  misc_feature: Ceres CLONE 1542004
  misc_feature: Translation starting site: 223
  misc_feature: SWISSPROT Homolog: EC 1.1.1.37 Malate dehydrogenase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (44)..(44): n is a, c, t, g, unknown, or other
nnnnnnnnnnnnnnnnnnnnnnnnnnnnnnnnnttttngggggnaaaaggtggactcaccgcggtggcggccgctctagactagtggatcccccgggctgcaggaattcgtctcacccctagaaaaagctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgattgctgcgtttcctcttctgaagggagttgttgctacaactgattgttgtggaagcctgcacttggggtcaatgtggccgtcatggttggtggattccccaggaaggagggaatggaaaggaaagatgttatgtcgaaaaatgtttcaatctacaaatccaaagcttctgccctttgaagcccatgcagctcccaactgcaaggttctggtggttgccaacccaaaaaacaccaatgctcttatcttgtaagaatttgctccatctattcccgaaaagaacggtaccttgccctgaaccgtttgtgaccacaaacagggcttcttgggccagaatttccggagaaaacttaagggaccg

SEQ ID NO: 67435 - DNA, 814 bp, Zea mays
  misc_feature: Ceres CLONE 1542005
  misc_feature: SWISSPROT Homolog: EC 3.2.1.23 Beta-galactosidase
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
tgtgttgtttgtgttggttgtttttgttnnnacnnnnnnnnnagnagaattgctggagctccccgcggtggcggccgctctagaactagtggatcccccgggctgcaggaattcgtctcacccctagaaaaacgcttgctatattggtgaaccttgtcaattgcagaacagcgctcactacgctgctgatttcccatcctttctcgttaaattaccatatgaatagcgccaattccatacggtttaccggtgtggcgcctctgctcgagaaaaaaaaaaaaacgagacgctcgaggtacccaattcgccctatagtaagtcgtattacgcgcgctcactggccgtcgttttacaacggcgtgactgggaaaaccctggcgttgcccaacttaatcgccttgcagaactttcgccctttcgccagctggcataatagcgaagaggcccgcaccgatcgcccttcccaacagttgcggaggctgaacgcccaatgggggattgtaagcgttaatatttggggcgaattcagagttaaaattgtgtgtaatcagctcaatttcttttaccccctcgccacaatcccgcaccctccccgtgcggttccaggggaatggggcggttattggtgtttaggggtggcccgtttgtggaagaggagggccccgttttaagaaacggggaattccaactctccgaggggcaaagtaaccgtcttaacgaggcgaagggccccctatgtatgaaaccatcccccctaattcgggtttttttcggggtcacagaatggccttaaaacggattaaatactgagaag

SEQ ID NO: 67436 - DNA, 804 bp, Zea mays
  misc_feature: Ceres CLONE 1542007
  misc_feature: Encodes the peptide sequence at SEQ ID NO. 67437
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnnnnnnnnnnnnnnnnnnnnnnnnnttttntttttggggggggcagcacnnncccgagccgcggctccccgcggtggcggccgctctagactagtggatcccccgggctgcaggaattcgtctcacccctagaaaaaatcatcgctcgctgagcttccgttgttgcacagcacatcgatcgacgacgatatcgggaagcaatatggggttggccttgtcgcggctggaggagattaggacgcagtaccgcatggcagcggaagacggcgaggctgacagtccggcaccggcgccagtgccgccgaccggtgctgctgctgcttccggcggcggcactgaaaagaagaagtacgcggacgactcgtcgtggtcgtcaaagacgacagagtgggttcctcataagttctctgagatcggcggtcaaagacgacctgatgaggatatgtgccgagggatctacctttccacgatcggatcaccagtcgaaaacaaataaatactggccagatgggagaaatgccgactgcttccggctgttccccatgggactcagactctccgggggcgcgtgacggaaaggtatgggagtgggcgcctcctcttccctggaaaagtaaaaaagggattcgtcggactgaggaaggccctccctggcgaggggggcgtatccgcaaggacccgtgcgcctggaccgaagaaacccgctccctaaccctaggataattgccctgaaattacgtgctggtaaatttcagcaacctgccaacaacaacgtgacatcgcccgagcttcaaaccaccaaa

SEQ ID NO: 67437 - protein, 97 aa, Zea mays
  misc_feature: Ceres CLONE 1542007
MGLALSRLEEIRTQYRMAAEDGEADSPAPAPVPPTGAAAASGGGTEKKKYADDSSWSSKTTEWVPHKFSEIGGQRRPDEDMCRGIYLSTIGSPVENK

SEQ ID NO: 67438 - DNA, 673 bp, Zea mays
  misc_feature: Ceres CLONE 1542012
  misc_feature: Encodes the peptide sequence at SEQ ID NO. 67439
ggatcccccgggctgcaggaattcgtctcacccctagaaaaaatccgctttcggcgccgtcgccactcgccaccatctccaccgcctcctctcgacaagcatcccctcccatacccatggcaactgaccgtctcctccaccttctccgagcgccgacaggctctccggctgccgccgccaccacccgcgcggcttgttggggtcgtccacggacgcagcgcgtcgacgtctggcagggtgctgcggggattcgccgcgcgtccgtgtcctgctcgagcactagctctggcgggcaggggggactaacatataaggatgcaggcgtggacatagacgccggcgccgagctcgtgcgccgcatcgccaggatggcacccggggatggcggcttcggcgggctctttccctacgatgacgattatcttgttgctaccaccgatggggtggggacaaagctgaagcttgctttcgacactggtattcatgataccatcgggtttgaacctggtgtcaatgaaccgcaatgactttgtaactccaaggggcaaaacctttgttcttcctagattaccatgcccccagccagctttgttgttgttcttgtcaaaaagggtatccagggggtattagggatgggtggcaaacatcagattgtgcccctcctaagaagggg

SEQ ID NO: 67439 - protein, 136 aa, Zea mays
  misc_feature: Ceres CLONE 1542012
  misc_feature: SWISSPROT Homolog: EC 6.3.3.1 Phosphoribosylformylglycinamidine cyclo-ligase
MATDRLLHLLRAPTGSPAAAATTRAACWGRPRTQRVDVWQGAAGIRRASVSCSSTSSGGQGGLTYKDAGVDIDAGAELVRRIARMAPGDGGFGGLFPYDDDYLVATTDGVGTKLKLAFDTGIHDTIGFEPGVNEPQ

SEQ ID NO: 67440 - DNA, 895 bp, Zea mays
  misc_feature: Ceres CLONE 1542015
  misc_feature: Encodes the peptide sequence at SEQ ID NO. 67441
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (51)..(51): n is a, c, t, g, unknown, or other
  misc_feature (594)..(594): n is a, c, t, g, unknown, or other
  misc_feature (595)..(595): n is a, c, t, g, unknown, or other
  misc_feature (707)..(707): n is a, c, t, g, unknown, or other
  misc_feature (728)..(728): n is a, c, t, g, unknown, or other
gtggccgggnnccgctggnnnnncgnntctggcccccccctcctgtcttgnctaagcggacctcaacgaggtggcggccgctctagaactagcggatcccccgggctgcaggaattcgtctcacccctagaaaaactccttatcctccgtcgcgggttcgtacggtgcccgttctgctgccgcgaccctttctccgagtgggccatgtacctcattgtcgatgcggcatggacgccaagatgcttctacaggaagcccaagattgtccagcacatattgtgttgaaatgaacgaacacacggcatccatatcaccactggcacaccaagacacagcttacctcacgttcttatgaatgcaacccgcccgacatcgctatgtctcgcacatccttttcactgatcatacgtttccctcgtttccgggttatttcttgctgcacgctttcaccatgacttccgctctccttcattccgaagacgcgtcaaaccgacccccgccccgcggatagccaaattttccctccaccccgttcttttctttcggtatagggggagactacatcgcgcgacctgacgcgcttcgcctccgaannaaccgagaccgaagcaccgccgacgaccccgcgcgaaactcccccgccgcccgtctatgcgcgccctccggacgccctgcctctcgccccccttcaccccacggccaagcanccccaccccccgccccccccnacccttagaccctattcacccccctccccctccctctttctgattatacgctctttgggcacaaaagcgattatcgcacaagcaaagaatcgattgcgccggacaatcgtccggcgggggcgccccctccgtccgggcgggtggcgcccccctcacctccccccccc

SEQ ID NO: 67441 - protein, 44 aa, Zea mays
  misc_feature: Ceres CLONE 1542015
MRHGRQDASTGSPRLSSTYCVEMNEHTASISPLAHQDTAYLTFL

SEQ ID NO: 67442 - DNA, 865 bp, Zea mays
  misc_feature: Ceres CLONE 1542016
  misc_feature (7)..(7): n is a, c, t, g, unknown, or other
  misc_feature (8)..(8): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (81)..(81): n is a, c, t, g, unknown, or other
  misc_feature (452)..(452): n is a, c, t, g, unknown, or other
  misc_feature (465)..(465): n is a, c, t, g, unknown, or other
  misc_feature (477)..(477): n is a, c, t, g, unknown, or other
  misc_feature (552)..(552): n is a, c, t, g, unknown, or other
  misc_feature (553)..(553): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (692)..(692): n is a, c, t, g, unknown, or other
  misc_feature (797)..(797): n is a, c, t, g, unknown, or other
  misc_feature (800)..(800): n is a, c, t, g, unknown, or other
ttttttnnttttttnnnnntttatccnnnnnnngggggggggnnncccccgcccgggctcccgccgtggcggccgctctanactagtggatcccccgggctgcaggaattcgtctcacccctagaaaaatagaccgcagacagagaggtggagcggccatgaagatccagtgcgacgcgtgcgagggcgcggctgccaccgtggtgtgctgcgccgactaggccgccctgtgcccgcgctgccacgtcgagatccacgcccccaacaagctcggcagcacgcaccagcggctcccgctcgaggctctctccgccgcgctcccggggtgcgacggctgccagggaggaagggggggggcctcttctgggcgcgagctcccgcgccctctcccgcgagggcgggcgaggggggctttttttttccccccccctctgtgggggggggggggcgtnttccccccccccnacccgccgtccnccccccccgctgcgccctccttcctccgcccccctccgcccgccgcccccgcgccgtctccccccccggcgcctnncccccccgggccgcggcgtgctgaatgagtcgggtcggcggtcccgtctttccgggcgctcgccagccacagggggtcccggcgccgcccctaagtgttcgnnnacgcctccgcgtcgtgggtgccgcgcgggggtccntgcccgggtgagcgcgcgggcccgggctcgtcaccgactccgtggctgcgctcgccgcgcatggggagcgggcggttaccgcggacgcggccccgcggccccgcnaanttgcgtcggggcggcggcgcgcgtcggtagcggggcgcgcggtggggtaatgagcccacacgccg

SEQ ID NO: 67443 - DNA, 661 bp, Zea mays
  misc_feature: Ceres CLONE 1542017
  misc_feature: Encodes the peptide sequence at SEQ ID NO. 67444
gggctgcggaattcgtctcacccctagaaaaaatcttgtcttgatcctctggtccgtggccatggcgtcgtccatgctcttcgttacccctgtgatcgtctctctcgggggctgcctgtccgagttgtacgggctcaggagcttcctcttcctgcgcatgagccggagtgcccgctcggacaagttcatgtccgtggtctccttcacgatgcacatccccgaggggatcgggggctcgcggcgggccccgatggaggcgaagctgagggcggccgtcaagctgttcggccgcttcgggcgcatcttcctgcagtgctggctcggggacggcgacgcctcgcccctcgacgacatcggcatcgacgacaccggaagtgtgaagcaggtgtcccacctgctctagtacgactccacgctcgtcatcttcgacgccgacgtcttccccgtcggcgagaacgccgtctccgtcgactgtcaggtcatcacggtcgtgtccgaccgcaaccccaccatcctgacgtgagacgagctcggcaacaacctcgtcatcaagggcatatgcgtcttcgtcgaccgctcgtgcgctcggaaacacgtccggacgagcttgttctagaagctcatcaatgtgccctggtaggtcgacctcccgatctactta

SEQ ID NO: 67444 - protein, 113 aa, Zea mays
  misc_feature: Ceres CLONE 1542017
  misc_feature: SWISSPROT Homolog: EC 1.2.1.13 Glyceraldehyde-3-phosphate dehydrogenase (NADP(+)) (phosphorylating)
MASSMLFVTPVIVSLGGCLSELYGLRSFLFLRMSRSARSDKFMSVVSFTMHIPEGIGGSRRAPMEAKLRAAVKLFGRFGRIFLQCWLGDGDASPLDDIGIDDTGSVKQVSHLL

SEQ ID NO: 67445 - DNA, 699 bp, Zea mays
  misc_feature: Ceres CLONE 1542022
  misc_feature: Translation starting site: 154
  misc_feature (699)..(699): n is a, c, t, g, unknown, or other
ggagctccccgcggtggcggccgctctagaactagtggatcccccgggctgcaggaattcgtctcacccctagaaaaaaatctcatgtcttcacactcctcgccatcacataaaaccagtgcaagctgaagcagcgcattggcgagcagcaccatggccttctcctccacagccttcgccggtaaggcagtgaacgtgccgtcgtctctcttcggagatgcccgtttgactatgcgcaagacggcggcgaagacaaacccggcggcgagctccggcagcccgtggtacggccccaaccgcgtgctctaccagggcccgctgtccggcgcgcccccgagctacctgaagggcgagttcccgggcgactaccgctggcacaccgcggggctgtcggcggacccggacacgttcgccaagaaccaggagctggaggacaaccactcccgctgggccatgctgggctcgttgtactagcgtgttcccggagctgctcgaccgcaacggcctcaagttcagcaaggccgtgtggttcaaggtcgggtcacatatctatcgcgagggtgggctggactacctcgacaacccgagcctgatccacgcgcacatcatcctcgtcatctgcgcctgacacgtcatgctcatgctctccatcgaggggtacagcgtctccggcgggccgctcgtagaggaagtcgaccn

SEQ ID NO: 67446 - DNA, 805 bp, Zea mays
  misc_feature: Ceres CLONE 1542025
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
nnnnnnnnnnnnnnnnnnnnccccnnnnnnnaaaannnnnnnnnnnccaaaggncctccacgcggcggcagccgctctaaaatagtggatcccccgggctgcacgaattcgtctcacccctagaaaaaaggcgaagaaggcgctgcgagcgctgaaggcgctggtgaagctgcaggcgctggtgcgcggctacctggtgcggcggcaggcggcggcgacgctgcagagcatgcaggcgctcgtccgcgcgcaggcagccgtccgcgccgcccgctacagccgcgcgctacccgcgctcccgcccctccaccaccaccctcccgtccgcgcgcgcttctcgctgcaagagcggtacggtgacgacaccgcgcagcgagcacggcgtggcggcgtaacagccggcgcttgcccgccagcatccagtcggcgccgcacggaggcggctacgaccggagccccaagatcgtggagatggacacagcgcggccccggtcgtcgcgcgtcgtccctgcgtaccgtggaccattgttacgcgcaatccatgtcgtcgccgctcctatcgtcgccgccgccgcctttgccatctcttgcacctgccaccatttccaccctcttgttccccgccattcttggttgccccacgaacacgcccaccttctactgtattattatttggtgcctaccccctaaacaaactcatcgtaccggctcaaccttcgcctgtttgaaaccgccccccgccttcccactccgtcactgaaaccacaccgcccaatgcaaccattaccattccccgatctccccc

SEQ ID NO: 67447 - DNA, 897 bp, Zea mays
  misc_feature: Ceres CLONE 1542033
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (363)..(363): n is a, c, t, g, unknown, or other
nnnnnnnnnnnnnnnnnnnnggggggnnttaagggagagggnnnnngaatcgtagactccccacggtggcggccgctctagactagtggatcacccgggctgcaggaatttgtctcacccctagaaaaaatttcctattgatgatagaggctgagaaacaggaacgtgctcagtctgcattacgtgcacacagtagttcaagaaaaaatagcaagaaggagataaatgtaccagaagattgtgctgcattaacagggcagttacaacccttttgtcaagaagaagttttggcccctgtattcaatggaacttttccctgtactgcatatcagtccttctccatcctcttaaggggaagatgtnaaattacatattattagtatctgttcggcctctgcggggttttctatcttattctcttggttccctggccctgttggcgggaggggggggggtggtctctttttacgcgtaactttccattgcctccaccccgacccctctctagttccgaagtgccgccccccccatctacacccgccccatttatacccacgggccccaataattgaacgtgcgcctttttcaggcttgtaacaaaacaacgacactctccccttatcctcattaccatatctcacaaccatacctctcccttctcctcctctccccttctttcctccccctccctccatgcgtacgagctccccaaaaaagagatggaccacgtagaaaaaaacattataacaggtccccaaccccgcccccccgagccactacgttccaccccgtttttctgcccccctcctccccccctacaccgcgcgcgctcacatgcgaaatataatcggtggagataaaataatgcttggcggggtagctgtaagccgaaaaagt

SEQ ID NO: 67448 - DNA, 804 bp, Zea mays
  misc_feature: Ceres CLONE 1542036
  misc_feature: Encodes the peptide sequence at SEQ ID NO. 67449
taaaaatataaataaaatttaaaaatgatttgttagtaatttttggtttgtgcaaactggaactccccgcggtggcggccgctctatactagtgtatcccccgggctgcaggaattcgtctcacccctataaaaaacagcatctctagtcttcacactcctcgccttctaataaaaccagtgcatagcagaagcagcgcattgtagagcagcaccatggccctctcctccacagccttcgccggctaggcagtgaacgtgccgtcgtctctcttctgttaggcccgcttgacgatgcgcaagacggcggcgaaggctaagccggcggcgagctccggcagcccgtggtactgccccgaccgcgtgctctacctgtgcccgctgtccggcgcgccccctagctacctgacgggcgagttcccggtcgactactgctgggacaccgcggggctgtcttcggaaccggatacgttctccaagatccggtagctggaggtcatccactcccgctgggacatgctgggcgcgttggtctgcgtgttcccggagctgctcgcccgcatcggagtcaagttaggaataggccttgtatttcatgggcggggtcgcatatcttcattcaagggtggggtgagactaccaccagcaacccgaaacctaaatccacgcgcaatataatcactcaacaaacagaaaaccatagccaaaatctttgcttctagtgggcgcctcatcctaagaggttacccggcggatctcccgtgtggggacccggtttctgggagaaggcctcctgtccaacccc

SEQ ID NO: 67449 - protein, 64 aa, Zea mays
  misc_feature: Ceres CLONE 1542036
MRKTAAKAKPAASSGSPWYCPDRVLYLCPLSGAPPSYLTGEFPVDYCWDTAGLSSEPDTFSKIR

SEQ ID NO: 67450 - DNA, 715 bp, Zea mays
  misc_feature: Ceres CLONE 1542037
  misc_feature: SWISSPROT Homolog: EC 2.7.1.4 Fructokinase
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (428)..(428): n is a, c, t, g, unknown, or other
  misc_feature (477)..(477): n is a, c, t, g, unknown, or other
aaaactggagctccccgcggtggcggccgctctagaactagtggatcccccgggctgcaggaattcgtctcacccctagaaaactaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcaaattgtattggattctgatatggaacagaagaagaagcggctgccccatcttaccagccctttttgtttgccctagtttccccttgtgaaaagggtgttttgttttataaactctacttgcaataagcagagccttttttttaatccccccacacaaaagggggggggggggcnnnnttccccctttccccctttattaantcctataaaaaacacataaatgacctccctttttagagggggggtgatngggaaaacccttggcttttcccccctttattgcccttgggggacgttcccccttttgcccaatggggtaataataaaaaaagccccccccgttcccccttctccaaaaattgtggaggcttgtaaatgggaaatataaaatgcacaaacggccgtttttttgttcaaaatcgccctccgatttttttttttaataccccgcactttcttgatccatataaccgcaaatggggcaaaac

SEQ ID NO: 67451 - DNA, 688 bp, Zea mays
  misc_feature: Ceres CLONE 1542040
  misc_feature: SWISSPROT Homolog: EC 3.2.1.23 Beta-galactosidase
ccccgcggtggcggccgctctagaactagtggatcccccgggctgcaggaattcgtctcacccctagaactagaaaaaatgatggcaatgtttgcctggtcatgaagtattattactttcgttgaaaccgtgatgctattaagacttaatttttttatggaacatcgaatgtaaggcatacatggttatgagtctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagatcccactattaaaaaacgtggactccaacgtcaaaagggcaaaaaaccgcctatcaggggcaaggccccactacctgaaacaatcacccctaatccaagtttttttggggg

SEQ ID NO: 67452 - DNA, 774 bp, Zea mays
  misc_feature: Ceres CLONE 1542051
  misc_feature: SWISSPROT Homolog: EC 3.2.1.23 Beta-galactosidase
  misc_feature (7)..(7): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
ggggggngggggggggggggggnngnnngnnngnnaaaaaaaatacaaaaactggagctccccgcggtggcggccgctctagaactagtggatcccccgggctgcaggaattcgtctcacccctagaaaaataagggtttttgttgctgtgttttctgaaacgcataagcgtgtcagtagcatgtaattcataaccggattgtagtgcttcattatctatagttttctgtacgtgtaaaatagaccagcgtaacagcgtagtttgcttcattctccgaagtcttgtatggctgtacacccaggcatctgggcatcatgaacccaactgattggctaaatgaaataaatctcctccatccaacagcttataaaaaaaaagagaaagaaaaagaaaaaaacatcttaattaaaacctttttacaaaaaaaaaccaagacgctcgaggaacccaattcgccctatagagagtcgtattacccccgctccttggccgtctttttacaactgcgggacggggaaaaccctggctttacccaatttaatcgccttgcggcacatccccctttctccacctggctttatatcaaaaaaagcccgcaccgatcccccttccccaaaattttgcacaccctggaatggcccaatggaaatttgaaaccgttaaaaatttttgtaaaaaatccgccgttaatttttttggttaaagacaacccccattttttttaaaccaaataatggcccgaaaattcggcaaaaaatcccctttatataaag

SEQ ID NO: 67453 - DNA, 589 bp, Zea mays
  misc_feature: Ceres CLONE 1542053
  misc_feature: Pfam Name: ATP-synt_B Pfam Description: ATP synthase B/B' CF(0)
  misc_feature: SWISSPROT Homolog: EC 3.6.3.14 H(+)-transporting two-sector ATPase
  misc_feature (561)..(561): n is a, c, t, g, unknown, or other
ccccgcggtggcggccgctctagaactagtggatcccccgggctgcaggaattcgtctcacccctagaaaaattgtgaacttaatagcaagataagctactttcagtaaaagagttattagatagtcgataacagaggattgtaagtactattcgaaattcggaagatttgcgtacagggacccttgtacaactcgtgaaaagctcgtattcgattgcagagagtcgaactggaagcagatgagtatcgaaatgataggatgctctgaaaatggacccgaaaaaaagaaaaagaaaacgcaagagcttccggggtacccaatttccccctataaggggggacaaattaaacccccccccccctggggccggtctttttaaaaccgccctgggggggggaaaaccccgggggggttcccccatttttattcgccctttgggggaaaatcccccccttttttcccccggtgggggggttatataacaaaaaaaaaaacccccccacacaaattccccccttccccccaccaattttttcccccccccctttaagaggggcgcncatataggaaaaattttttcacccccct

SEQ ID NO: 67454 - DNA, 852 bp, Zea mays
  misc_feature: Ceres CLONE 1542063
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (120)..(120): n is a, c, t, g, unknown, or other
  misc_feature (288)..(288): n is a, c, t, g, unknown, or other
  misc_feature (294)..(294): n is a, c, t, g, unknown, or other
  misc_feature (295)..(295): n is a, c, t, g, unknown, or other
  misc_feature (852)..(852): n is a, c, t, g, unknown, or other
nnnnnnnnnnnnnnnnnnnnnnnnnnnaaggcntccnnnnnttgaggtannnnaaaaactggggctccccgcggtggcggccgctctagaatagtggatcccccgggctgcaggaattcntctcacccctagaaaaagtagtagatctcgtttcagctgtgattctttattactgctatgctataattgtagtgttctcgttcccatttcttgatgcactcctctggaggatttggttgtttagttacatgctccttttctaaccttagaaaaatacccgaaggagtnaataannattcttggctggttccctggccaaggcgtcgaggggtgcgaattcgcccttttagacaatttaaaaaaatagcttcttgtagggcgcggtttttttattattgatttgggttgtgtgaaagggggggggcttttcttttttttcccccctctgtgggggggggggggggggggtcttcatcttctctttttactctacatcccccctccaatgaatcaacaacacctccctggccgcgggggggggggggggggtggcctttttcttgctcgcgcgtctgggacgcccctaaccacctttgtttctcgtccttcctggtcgtcaatggtgcagttgggacggcgcatttctgggctagatatgccggttcggagcggcctggcggtgttttgcaggtttgtcttcgctgtttgttatcggtttccttccttatcagcctatatgtgaaattaattatagacaccaagaaaaacatatgttaatgatgggagaagatagatgaacatcaaactataacgaacaagctcttatgatcggcattgtatatgtctacgttn

SEQ ID NO: 67455 - DNA, 683 bp, Zea mays
  misc_feature: Ceres CLONE 1542064
  misc_feature: Pfam Name: PsbP Pfam Description: PsbP
  misc_feature: SWISSPROT Homolog: EC 3.2.1.23 Beta-galactosidase
gcggtggcggccgctctagaactagtggatcccccgggctgcaggaattcgtctcacccctagaaaaatagaaaaatgccatctaatgttttctactaattgtgagtgggatgctgcacgcaaattttacacattgaccactggagcaaacgagaggaggtgggaaaagatgaaggataggctgcatactgttgtggattccttcaaaatcgaaaatagaatatgagtgcctgaattgctgtgttgtttttccttcgttgattcgctttttcttacataactgcagtgctgagatttttcagtagtaaataccgggattgtggattatgctgatcagtttcatttcgaaatgtttgttaccaaacttgagcaacatttgtttgtactttatgtgtataataataatatcttgtctggatgtacccaacttaaatcaccttgcaccacataccccaaacgagacgctcgaggtacccaattcgccctatagtgagtcgcattacccgcgctcactggccctcgttttacaaacgcatgactgggaaaaccctggcgttacccaacttaatcgccttgcagcacatccccctttcgccagctggcgtaatagcgaaaaggcccgcaccgatcgcccttcccaacagttgcgcagcctgaatggcaaatggaaattgtaagcgtta

SEQ ID NO: 67456 - DNA, 776 bp, Zea mays
  misc_feature: Ceres CLONE 1542066
  misc_feature: Encodes the peptide sequence at SEQ ID NO. 67457
ggcggccgctctagaactagtggatcccccgggctgcaggaattcgtctcacccctagaaaaaccagggccaagactctaggttttgatgggcgtcagagcaattacgctgagatggaccatgtgaggcaggaactggtccatgcgaatcaaatctttgctcagaatccatcgtggccagtcattgcggtcactggaaaactatcgaggaaacagctgctgtcatcttggggatcctccatgacaggaagcaaaagtgctccttgcccctcatatcctaacgatactagcactgtgttctatccccttctttactacgccttggtaacgtgtgcatgtttttgaattattttttttcccccccccccccaaggggggggggggggagagttttttttctcagttttcctcttttcttcctctgcttcccccccccaaaaaaataaaaacttaattctccaaggtttgggggccgccgaaaaaggccggatggtgtttaatctcccctttatctacctccgttccgctcataggcacccctgcctctgtgtttccccccttcgctccttctaaccctctcccctcttgtgttacaggggacagagctcgccgcccgcttccgttcgcccatttttgctctttccttaagtaatttgttctcgatccctccgcaccaactttttaaaaacaccggcgcgcggcagcgactccggcgcgcccccacaccctactgcctcctccttcttcctaatagcatatatttatctgtacccttgg

SEQ ID NO: 67457 - protein, 76 aa, Zea mays
  misc_feature: Ceres CLONE 1542066
MDHVRQELVHANQIFAQNPSWPVIAVTGKLSRKQLLSSWGSSMTGSKSAPCPSYPNDTSTVFYPLLYYALVTCACF

SEQ ID NO: 67458 - DNA, 642 bp, Zea mays
  misc_feature: Ceres CLONE 1542088
  misc_feature: Encodes the peptide sequence at SEQ ID NO. 67459
tagctggagctccccgcggtggcggccgctctagaactagtggatcccccgggctgcaggaattcgtctcacccctagaaaaagcgcttgtagaatgcccgcctttcccgtccgtgcctccgcttcgtccagcgtcgtcggtagcctcaccggtacccgccgccccaggctcatcaagaacaccaccgtcatcttcgccaccgccccctccaccctcgtggccatgggcgacgccgtggagcacctcaagagcgggttccagaagttcaagaccgaggtgtatgacaagaagccggagctgttcgagcctctcaaggccggtcaggcccccaagtacatggtgttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctcaaggtggaggtcctcgtggtcatcggccacagctgctgcggtggcatccgggcgctgctctccctccaggacggtgcacccgacaacttccacttcgtcgagaactgggtcaagatcggcttccctgccaaggtcaaagg

SEQ ID NO: 67459 - protein, 182 aa, Zea mays
  misc_feature: Ceres CLONE 1542088
  misc_feature (74)..(182): Pfam Name: Pro_CA Pfam Description: Carbonic anhydrase
  misc_feature: SWISSPROT Homolog: EC 4.2.1.1 Carbonate dehydratase
MPAFPVRASASSSVVGSLTGTRRPRLIKNTTVIFATAPSTLVAMGDAVEHLKSGFQKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKVK

SEQ ID NO: 67460 - DNA, 726 bp, Zea mays
  misc_feature: Ceres CLONE 1542093
  misc_feature: Encodes the peptide sequence at SEQ ID NO. 67461
  misc_feature (5)..(5): n is a, c, t, g, unknown, or other
  misc_feature (6)..(6): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (641)..(641): n is a, c, t, g, unknown, or other
aaaannaaaaaaaaaaaaaaaaagaaaaaactgcacccgttnnnntnnnnnnnnaaaagctgggactccaccgcggtggcggccgctctagaatagtggatcccccgggctgcaggaattcgtctcacccctagaaaaaccacccactgctttcagctttccatcttccatttccaccctcttcctcacgcatccgacgctataaaatccaatccaaccccgtgcaagctccaaataccatagccctcctagtcctggcagcaccacactctcgcgctcctctcgggcaggaaaaaaaaagaagaagatcggtgtggttgcgcctagcttcccgcgaagcgagacgtcacgggcgtagcgtagtagagctagcaagccataccataccatacatatcccaccgattccgatcggcatggccgggagcgcgaggtcggcggccgcgaagcacgcgtaccggatgttcgtcacgccgtccaggggcggcgccgcggcgaggggccccggggccggcgccgcggaggagttcgacaagtctgacatctggggctcgttacgcgcggaatcccagtactccagccccggggcccaactggggcgccaggttgggcgcgccccaatcccacggcttccaggagcanggccggaaagaaacccccttggtacaagacggaagggcgaggcgcaaacgtgggtccccctggcccaattgaaaaattgcccgag

SEQ ID NO: 67461 - protein, 103 aa, Zea mays
  misc_feature: Ceres CLONE 1542093
  misc_feature (76)..(76): Xaa is any aa, unknown, or other
MAGSARSAAAKHAYRMFVTPSRGGAAARGPGAGAAEEFDKSDIWGSLRAESQYSSPGAQLGRQVGRAPIPRLPGAXPERNPLGTRRKGEAQTWVPLAQLKNCP

SEQ ID NO: 67462 - DNA, 675 bp, Zea mays
  misc_feature: Ceres CLONE 1542096
  misc_feature (675)..(675): n is a, c, t, g, unknown, or other
ttagctggagctccccgcggtggcggccgctctataactagtggatcccccgggctgcaggaattcgtctcacccctttaaaaatccgtcagccccagacactgagctggtctgtttagtgggaaagccatctgttggtttttcgcctatcatgcttgatgagacgaacaccctccagccctctgggcggtgagcctgcccctgaccaggataactaggtgctggactcgggactcctgtactgcctactcggctggtgcaagtctctactaccgctagaacaagatcctccttgccgaggaggagctggggaccggcatgtagaaggtcacgggggcccaacccgaccgctaagtggagggacactaggccgccgagaataaggacggccttctcgtcaagattgcaccgctccagctccagttccagctcgtctagcgacttccaccacgacgtgccgatcgatgagaaccggtagtttgtcattaggaatatcaccaacgtgcttaacgatcacgtcaaggatgatgctggctgccccccccagccccactatggagggctgcccacctttgcgacttccctatttcgcccctgggtgggtaggacacgccttaattcaccttcctccgtaatgggaaagccacttttcccgggcagcccgggggccctccn

SEQ ID NO: 67463 - DNA, 594 bp, Zea mays
  misc_feature: Ceres CLONE 1542097
  misc_feature: Encodes the peptide sequence at SEQ ID NO. 67464
ggatcccccgggctgcaggaattcgtctcacccctagaaaaaatctctagtcttctcactcctcgccttcgctgaaaccagtgtcaagcagaagcagcgcaatggcgagcaactccatggccctctcctcctcagccttcgccggcaaggcagtgaacgtgccgtcgtctctcttcggcgaggcccgcgtgacgatgcgcgagacggcggctaatgcaaagccggcggcgagctccggcagcccgtggtacggccccgaccgcgtgctctacctgagcccgctgtcctgcgcgcccccgagctacctgactggcgagttcccgggcgactacagctgggacgccgcggggctgtcgaaggtacccggacacgttctccgagaaccgggagctggaggatcttccactcccgctgggccttgctgaggcgcgttgggctgcgtgttcccggagctgctcgaccgctacgtggtggagctctgcgaggacctgtggctcaaggccaggtcgcacatcttcagcgacggtgtgctggactacctcggctaccctagcctgatccacgcgcagagcatcctcaccatctgggactgcc

SEQ ID NO: 67464 - protein, 107 aa, Zea mays
  misc_feature: Ceres CLONE 1542097
MASNSMALSSSAFAGKAVNVPSSLFGEARVTMRETAANAKPAASSGSPWYGPDRVLYLSPLSCAPPSYLTGEFPGDYSWDAAGLSKVPGHVLREPGAGGSSTPAGPC

SEQ ID NO: 67465 - DNA, 643 bp, Zea mays
  misc_feature: Ceres CLONE 1542099
  misc_feature: Translation starting site: 164
  misc_feature: SWISSPROT Homolog: EC 3.4.22.16 Cathepsin H
aagctggagctccccgcggtggcggccgctctagaacttgtggatcccccgggctgcaggaattcgtctcacccctataaaaagtgcctgcgcccagcaagccattatgctcgccttactccctcacagaacccagtaaaatattgccagtcccggcgtcgagatggcccctcgccgactgctcgtcctcgccgtcctcgccctcgcggccaccgccgccgcggccaactccggcttcgcggactctaacccgatccgccctgtcaccgaccgcgcggcctccgcgctcgagtccacggtcttcgccgcgatcggtcgctcccgcgacgcgcttctcttcacacgcttcgacgtcagggacggctagagctacgagagcgcggcggaggtccataagcggttcagtgatcttctcccagagcctccagctggtccgctccaccaaccgcaaatgcctctcctaccgcctcagcatcatccgcttcgcggacatgatctgggaggagttccgtgcaacccagctcggcgcatccaagatgtgctccgccacgcttaccggcaaccaccggatgcgcgccgcctgcgttgcgctgccggacaagaagactggaaggaggatgggattgtgagcccagtgatgaac

SEQ ID NO: 67466 - DNA, 610 bp, Zea mays
  misc_feature: Ceres CLONE 1542103
  misc_feature: Translation starting site: 178
ccccgcggtggcggccgctctagaatagtggatcccccgggctgcaggaattcgtctcacccctagaaaaacccgatatatcccccatctcttcgactcctttctggagcagctagggttccgtcctcgatgcgatccggcgagtgcacaccacctttccccactccgagctactcgatggccgccgagggtcacaagaagatgataaccctcaaaagctccgatggcgaggagttcgaggtggaagaggcggtggcgatggagtcgcagaccatccgccacatgatcgagagatgactgcgccgacaacggcatccctcttcctaacgtcaactccaagatcctatccaaggtaatcgagtactgcaacaagcacgtacatgccgccgcagccgcagccgccgcctcgaaggacggttccgacgacgtgggtgccgcctccgccaacagcaccgccgcctccggtgaggacctcaagaactggcatgcggacttcatcaaggtcgaccaggccacgcttttcgacctcatcttgggtgcaaactatctgaacatcaagggtctgctcgacctgacctgtcagactgttgctgacatgatcataggcaag

SEQ ID NO: 67467 - DNA, 867 bp, Zea mays
  misc_feature: Ceres CLONE 1542106
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (867)..(867): n is a, c, t, g, unknown, or other
tggtgttgcgatagatatttttcactnnnnggnnnnnnnnnnnnggtcccnnnacaaaacctccactccccgcggtggcggccgctctagaatagtggatcccccgggctgcaggaattcgtctcacccctagaaaaactcgtgccagcgcccagcagggcattctgctcgccttactccctcaaagaacccagtaaaatattgccagtcccgccgtcgagatggccccacgccgcctgctcgtcctcgtcgtcctcagcctcgcggccaccgccgccacggttatctccggcttcccggattcttacccgatccggcctgtcacctacctgccttttctcccccgctcaaggaaacgcggccttccccgcaactcttttctctcctcaaaaacgcggttttgcctatgctacagctatcttttttttttccccccccgcccctaagagggggggggggggggggccctctccccctcccccctctttttgtttctttccccccccatcccccgttaggtaggggtttaatatccccgtgtgcgccaccccaccggtccactggctggaggactcttccccatctcctttttctcacacagagcgggtttttcgcgtgcgaacattcccggcttggttcttcctcccctctcctcccccccctcttctcttacaccaccacacccactccttatgccgccaaatcccctcctatcggcgcgtccacctttatggtgcggttttcctcgttctattcacttactttattgacacacaccccggctcacctcaccttcgccccacactctactctaccatatattaagtctctgtgttcctttctcaccaaacatttacctcgcccctn

SEQ ID NO: 67468 - DNA, 637 bp, Zea mays
  misc_feature: Ceres CLONE 1542107
  misc_feature: Encodes the peptide sequence at SEQ ID NO. 67469
  misc_feature (637)..(637): n is a, c, t, g, unknown, or other
ggagctccccgcggtggcggccgctctattactagtggatcccccgggctgcaggaattcgtctcacccctagaaaaaaacgaacgcgacacgttgcacttaactgctgccaaaacaactatgcgcgtccagcgtctgctgaggctgaggatggcgtcccgctcgtgctcccgctgcgctgccttggcgccgcacgctgcgctcccgctctcctctctcctcgccccctcgccctctgccgcgcgccctcgatccgcgcccctctcgtgcgcagctcggccgtgcaggggccacgcggcggcgtcagcgttgcacggcgcggcagggcggaggcccccgagcgtggcggcgatgtcgtcgtcgacgccgccgccgggatccgtgcagaagtcggaagaggagtgggaggccatcctcacgccggagcagttcaacatcctacgcctcaagggcaccgagtaccctggaacgggtgagtacgacaagttctttgaggagggcatttataaatgtgctggatgtggaactcccttatacaaatcatcgacaaagttcaactcagggtgtggctggccggcattctatgaaggacttcctggggccataaggcagacgtcggaccctgatgggaggcggn

SEQ ID NO: 67469 - protein, 172 aa, Zea mays
  misc_feature: Ceres CLONE 1542107
  misc_feature (92)..(172): Pfam Name: SelR Pfam Description: SelR domain
  misc_feature: SWISSPROT Homolog: EC 1.8.4.12 Peptide-methionine (R)-S-oxide reductase
MRVQRLLRLRMASRSCSRCAALAPHAALPLSSLLAPSPSAARPRSAPLSCAARPCRGHAAASALHGAAGRRPPSVAAMSSSTPPPGSVQKSEEEWEAILTPEQFNILRLKGTEYPGTGEYDKFFEEGIYKCAGCGTPLYKSSTKFNSGCGWPAFYEGLPGAIRQTSDPDGRR

SEQ ID NO: 67470 - DNA, 904 bp, Zea mays
  misc_feature: Ceres CLONE 1542111
  misc_feature: Encodes the peptide sequence at SEQ ID NO. 67471
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (370)..(370): n is a, c, t, g, unknown, or other
  misc_feature (896)..(896): n is a, c, t, g, unknown, or other
aaaaaaaacccctcttatttnnnntnnnnnnnnnnnnnnnnnttaccnnnnnacatacgtgggctcaccgcggccgcggccgctctataatagtggatcccccgggctgcaggaattcctctcacccctagaaaaataccatttaaaaatcccacaaaatccccaacccctcctatcttcctaggggattccaccgctcaccgtgggccgccgccgccatcggagcgggtggtccccggatgggtagctgctctttggaagtcggccgccccgtaatctgctcttcattccccccgcggtcggttcccgccgaatcaacggctccgagctttatccgtccttccaagtgcgcgaggaagagaaaattgcncgggccatggatcggttgcggctattaccagaaaggtttaccgccccgagccgtttttttttttccccctcccacggggggggggggggggggggctcccttccttcatttattctcatccctgtgcactccccctcaatctttgacgctaggtgttagacgtagggccctctccattgtgttcggtgcctggagcggaggaggtggcgtgccacaataagcttgctctatgtgggggtgtataccgctcgggggtcggaccgtgaaaaggccttcggtgtgcgcacattatccggtccgcactgcggtcgcgtgcagggctgttatttgtatcaagggcacagtcatcgtcgtcttctctcatccaggtgggcggggcttaagcaggctgctggcaacttattacgtaccgccggcgcgcggcgatccgagacccgcgcggcagtacctcgcggccgggtcgtggtcgtgttcttattcctggtttggctgtgggtgaggactatgtgtggtaccgtctttactnacgcgccg

SEQ ID NO: 67471 - protein, 50 aa, Zea mays
  misc_feature: Ceres CLONE 1542111
MDRLRLLPERFTAPSRFFFSPSHGGGGGGGSLPSFILIPVHSPSIFDARC

SEQ ID NO: 67472 - DNA, 738 bp, Zea mays
  misc_feature: Ceres CLONE 1542117
  misc_feature: Encodes the peptide sequence at SEQ ID NO. 67473
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (23)..(23): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnttttttttnngggttattgtnggcgttggagatgggatcgcggtgtgtgtnnntaaactggagctccccgcggtgggggacgctctttactagtggatcccccgggctgcaggaattcgtctcacccctagaaaaagccgcctctccccactccctctcgtcgccgtcctctcccgttcgcaacgccacgctccccaccgccgaaatggccccgaagcgaggtggcagggcaccggtgccggccaagaagaagacggataaagtgacgaaccctctgttcgagaaaaggccgaagcagttcggcatcggcggcgcgttgcctcccaagtaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggcttaaaatggaacgagaaactgctgaatccaggaaacccattgttgtgaagtatggcctttaaccatggggacttacctcatttgagcagaaacaagggctccagctcgattgtcatccgcttcatggatgtgggatcccgaattggaaactgggttggtttgggcctttcccagacccctggtgcaagggaaa

SEQ ID NO: 67473 - protein, 41 aa, Zea mays
  misc_feature: Ceres CLONE 1542117
MAPKRGGRAPVPAKKKTDKVTNPLFEKRPKQFGIGGALPPK

SEQ ID NO: 67474 - DNA, 825 bp, Zea mays
  misc_feature: Ceres CLONE 1542120
  misc_feature: Encodes the peptide sequence at SEQ ID NO. 67475
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
nctctccccccnnnctntggcgcgtaaattatatnnntttntnnntcctcccnnnncaaaaactagaactccccgcggtggcggccgctctagaatagtggatcccccgggctgcaggaattcgtctcacccctagaaaaccccccaggggggcggggcaccacaggtactcttctcctgcttggcctcttgtgccgcaaccgcgagtgctgcctacggtagcctccaaagcagcacatccaaagcagggaccgaatggacatggaccggccggaggaggaggggcagcagcggagggagacgatgacgccggtgctcctcacgctgttcggcgtggacgtccaccggggcggcggcagcgggaagccggacgagtccccgatggacctgaagaaaagctccagcatgccctatcttctccctccccccccctgggggaggggggagggagaacgatggcctgcaagggggtactccctccaacgaaaccgagagcatggcgtcccggtcagtcataaaacccccgcacgtccacaaagggttctagtaccattatagtaaaggcaaattcccatggccacccgaaggaataaagcaccagcgaaagttccctgcgtattatgcctataggtgttttcttgtgttctagagaggggaaccgagatagggtgacatacccatcttagggggttatttcccacccaacccacacaattaatcgtccccaaacaccactgtgaggatatctattccaccacccctccaaagaatgaaatcctatcctcctcccggaggagaaaaagccactcatctcactgggtagtg

SEQ ID NO: 67475 - protein, 100 aa, Zea mays
  misc_feature: Ceres CLONE 1542120
MDMDRPEEEGQQRRETMTPVLLTLFGVDVHRGGGSGKPDESPMDLKKSSSMPYLLPPPPWGRGEGERWPARGYSLQRNREHGVPVSHKTPARPQRVLVPL

SEQ ID NO: 67476 - DNA, 645 bp, Zea mays
  misc_feature: Ceres CLONE 1542121
  misc_feature: Encodes the peptide sequence at SEQ ID NO. 67477
ggagctccccgcggtggcggccgctctagaactagtggatcccccgggctgcaggaattcgtctcacccctagaaaaaacgagatcccttaaactgccgggcatcacccaccagcccaccgccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcg

SEQ ID NO: 67477 - protein, 158 aa, Zea mays
  misc_feature: Ceres CLONE 1542121
  misc_feature (73)..(158): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIEL

SEQ ID NO: 67478 - DNA, 769 bp, Zea mays
  misc_feature: Ceres CLONE 1542123
  misc_feature: Encodes the peptide sequence at SEQ ID NO. 67479
  misc_feature (1)..(1): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (57)..(57): n is a, c, t, g, unknown, or other
ntattttaaaantnntntgnnnannncattaggtcaggggattgatattattttttnccaaaactggagctccccgcggtggcggccgctctagaactagtggatcccccgggctgcaggaattcgtctcacccctagaaaaagtgtttgagtactcgctcgccgctctaccactcatcatccggcttcgcatgcatctccctgctcgccgggcggtccgattccgccgtggcgttccgatgaaagcaaaggttcaaagaacggagaagccatcttcttcagctggtgcatgcctccccaatccgttggatattttcttctatgagcaatttgctcattgagccatcgattagagagatggatgagccaattgcgggtgaccctgtggtcacacggatggctgatcagcttcttaaaagtgctcgaggggatggagaacagggtatgtcctgcgttagcatcctcgacaggatacggaaacaatgcaccgagccattgcgaacccttcctttgtggtctattggaagagcgtcttgtggacgcccttgtgcacgatccatgccttgcccactatgctttgagaaccgtgacccattccaggctcaaaaatgagcacccttggaggcagaaggtatggggcccgtatcaaggggaaaaatcccgtcctgttggatcccccaatttccttgactggaggagtcaaagcaaatggggggggtcccgattcatgggccatggcgcctggtaaccttatttagcgcaaattgga

SEQ ID NO: 67479 - protein, 96 aa, Zea mays
  misc_feature: Ceres CLONE 1542123
MSNLLIEPSIREMDEPIAGDPVVTRMADQLLKSARGDGEQGMSCVSILDRIRKQCTEPLRTLPLWSIGRASCGRPCARSMPCPLCFENRDPFQAQK

SEQ ID NO: 67480 - DNA, 738 bp, Zea mays
  misc_feature: Ceres CLONE 1542125
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (25)..(25): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (71)..(71): n is a, c, t, g, unknown, or other
  misc_feature (85)..(85): n is a, c, t, g, unknown, or other
  misc_feature (87)..(87): n is a, c, t, g, unknown, or other
  misc_feature (396)..(396): n is a, c, t, g, unknown, or other
  misc_feature (476)..(476): n is a, c, t, g, unknown, or other
  misc_feature (477)..(477): n is a, c, t, g, unknown, or other
nnaaaaaanaaaaaaaaaacaattnctctnnnntnnnnnttnggnnnnnnnnnnaaactggaactccccgnggtggggggcgctntnttctcctatatcccccgggctgcaggaattcgtctcccccctagaaaaaaaaagcagaccatatccccaggcaaaggccaaagccaagcgagacagggagggaggggaaataaccaagtgtctcaagcaacctaccgcccgcccgcccgcccgccgcttcatttcctccactccacactcaccacgacacgacacaccaccaccctcttcccttctcttctctcaagaaagaaccagctagcgcgcgcacacacacacacaagcctccccacacccgccatgtcttgcctcccccagaattctacaagncagcgccgggcggcgtttctttttttcgccccccgccggggggagggggggggggacatggatggcgctttgctacgatnncccccaggagaaaaaccggcggcccctctatacggtacttctaggaagaagcaaaaaaaattagggtgggccgacttcccaacactcccggggagcgccgcgactcagccgccgaggagagcttatcctcaggcccccgcgtgaacccagaggaccccatacgcgcctccgcgaggtgcggggcaaagccacagtccgacagggcacgggccaccggttagtagacaaaagaaaccctcagcgtgcaccatctcccgacgg

SEQ ID NO: 67481 - DNA, 812 bp, Zea mays
  misc_feature: Ceres CLONE 1542126
  misc_feature: Pfam Name: HI0933_like Pfam Description: HI0933-like protein
  misc_feature (18)..(18): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (192)..(192): n is a, c, t, g, unknown, or other
tagggcgggggggaaaanttttttttttttnnnnnnnnnnnnnggatatnnnnnaaataagtgggagtccccgcggtggcggccgctctagaatagtggatcccccgggctgcaggaattcgtctcacccctagaaaacgatcttgttgagtatatcaacgctaattacgtcttggttgctacaggtagcanccaaaatggctactcaatcgctgcacaactgggtcattgccttattgcgccagttcccagcttgttcacatttaaaatcgcagataagcggctggctgatctccccggggttacattttcaatagttcaaaacaaatctgaagctcaattggcgtcccaaaaaagaggttccccaaccttactccgattggggtccaagcaaagtaaccccccccgggggccttattttgttttttcccccccctcctaaagggggggggggggggtgcaaccctccctcttcttaccttttaccactctcccccgcgaaaaatactcaatatggggtggacattcggcgccctctcggttattttctcttttcctcgtgtaactaatatatcaccgcacgcctcacattccgcccctccaaagtgttattagaagtgggcgagggaggaaattattgggtatgtgggaccatcttctcctactcaacgaaatcttagcggcctctgacaaacgagaaattgtttattttgatggcgtgattacaaaacccccgcaaaacgctcatcctacacaatcttctattcgcttgctatacaatacacgttggctacgcggcctacaccgccgtg

SEQ ID NO: 67482 - DNA, 646 bp, Zea mays
  misc_feature: Ceres CLONE 1542130
aaagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctgacgccgctgaggaacctgctgggcctggtgcggggccccaagtacgacggcgtgttcctgcacgacaagatcaagagcctgacgcacgacgtcagggtggcggacacggtgaccaacgtcatcgtgccggcgttcgacgtcaagtacctgcagcccatcatcttctcgacgtacgaggccaagaccgacgccctcaagaacgcgcacctctccgacatctgcatcagcacgtcggcggcgcccacctacttcccggcgcacttcttcaagaccgaggccaccgacggccggcccccccgcgagtaccacctcgtggacggcggcgtcgcggccaacaaccccacatggtcgccatgtccatgctcaccaggaggtgcaccgccgcaacccccacttcaacgccggcagc

SEQ ID NO: 67483 - DNA, 893 bp, Zea mays
  misc_feature: Ceres CLONE 1542135
  misc_feature: Encodes the peptide sequence at SEQ ID NO. 67484
  misc_feature (393)..(393): n is a, c, t, g, unknown, or other
cccagtattcctctatccacatattcaggcggggcaagatagtatctggtagtcctccgcggggcggccgctctagaactagtggatcccccgggctgcaggaattcgtctcacccctagaaaaaaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaacccgttgaagaggccaactgtggctgctgttgnaagaacttcctacttcaaagaaatgggtcccttcattaaaaatgcctaatttattgccctttagactttttccctcggaaacttggggactcatggtgttaaacctccgactttgttaaaagtttttgatgggcctacttttggtgccttggttgggacccaggcttattaattcagaaagaatttggcaaattttttctcccactccctaaaaagaaaaaaggaaataaaaaccggaggccggctctcaaagggtacccccaatttccgcccctatataggtggaggccggaaattcaccccgccgccctcactggggtgcgaacctttttacgacccgctccttgaccggggggaaacaccctggggcgatatcccacacctttagaccgccttttgcaacaccattccccccttattctccaggcttgggggtaaaatagggaaaaaggggccccacccccaatcagccctttcccatagaaattgtgcgcgggctg

SEQ ID NO: 67484 - protein, 54 aa, Zea mays
  misc_feature: Ceres CLONE 1542135
  misc_feature (3)..(55): Pfam Name: Ribosomal_S14 Pfam Description: Ribosomal protein S14p/S29e
MGHSNVWNSHPKNYGPGSRVCRVCANPHGLIRKYGLMCCRQCFRSNAKDIGFIK

SEQ ID NO: 67485 - DNA, 713 bp, Zea mays
  misc_feature: Ceres CLONE 1542137
  misc_feature: Encodes the peptide sequence at SEQ ID NO. 67486
  misc_feature (521)..(521): n is a, c, t, g, unknown, or other
  misc_feature (522)..(522): n is a, c, t, g, unknown, or other
gcggtggcggccgctctatactagtggatcccccgggctgcaggaattcgtctcacccctagaaaaagcctttcctgtctcctctctcgctctccccgtctcccgcacgcccatccgccgccgccgttcgccatgggcctcctcgactcgctctaccgcgtggtgatgcgccgcaacgccgtctatgttaccttcgtcgtcgccggtgcctttgcgggcgagcgggctgtagactacggagttcacaagatctgggagatgaacaacctcgggaaaaggtacgaagacataccagttttggggcagaggccagccgaagaatgatatactttggtcgccatttagctccggtttaaccgtttcattttcgcacaataataagctgtgtaaacttcttactctgctgctgagagctgcttcccattcattttactctgaacatgctgtgagggaatttcgtggtgcatggctgaaatctgttatatagagcatatgcaaatacgtctagaggattcctctcnnagaatagaccgagatagggttgagtgttgttccagatatgaaaaaacgagacgctcgaggtacccaattccccctatagggagtcgtattacgcgcgctcactggccgtcggtttacaacgttcaggactgggaaaaacctggctgttcccaacttattcgcctgaagcacatccccctttccccagctgg

SEQ ID NO: 67486 - protein, 63 aa, Zea mays; identical to SEQ ID NO: 65813
  misc_feature: Ceres CLONE 1542137
  misc_feature (4)..(58): Pfam Name: UCR_UQCRX_QCR9 Pfam Description: Ubiquinol-cytochrome C reductase, UQCRX/QCR9 like

SEQ ID NO: 67487 - DNA, 807 bp, Zea mays
  misc_feature: Ceres CLONE 1542143
  misc_feature: Encodes the peptide sequence at SEQ ID NO. 67488
  misc_feature (30)..(30): n is a, c, t, g, unknown, or other
ttaggtggtggtttctgttttgttatttgnccccgtgttcattctttgcggggggtcttcccctccgaagcagccgctctttactaggggatcccccgggctgcaggaattcgtctcacccctagaaaaaagaacctgatggaggctggtgtgatcgaccctgccaaggtgaccaggtgtgcgctccagaatgcggcctcggtagctggaatggtcctaaccacacaggcaattgttgttgagaagccaaagccgaagcctcaagtggcagagccaccagagggagcccttaccgtttaaaacttaacgttcttgaggctgctgtccagacggttcagatcagttgagagggtagaactttggtttgagaattttggttcagatccactgggagttgtagagtaggatttttattttgcagatgaagagtaattttactcttggtctgaacttgggccccccaaagacatttgcatctccattttttaaaaaataaactcatggcgatgcttggattgtacgagcaaaaaaaaaaaaaaaaaacgagacgctcgaggtacccaattcgccctatagtgagtcgtaattacgcgcgctcactggccgtcctttttaaacatcctagactggaaaaaccctggcgttccccaactttaatcaccttgcagcaaaattcccccttttcgccaggttggccgaaataacgaaagaaggctcccccaccaaatcgcccttcccaaacaagtttgcccaacctctgatggggcaaatggcaaatttgtcagccgttaaaatattttggttaaa

SEQ ID NO: 67488 - protein, 53 aa, Zea mays
  misc_feature: Ceres CLONE 1542143
MEAGVIDPAKVTRCALQNAASVAGMVLTTQAIVVEKPKPKPQVAEPPEGALTV

SEQ ID NO: 67489 - DNA, 839 bp, Zea mays
  misc_feature: Ceres CLONE 1542157
  misc_feature: Encodes the peptide sequence at SEQ ID NO. 67490
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
tcccattttactcatttaaccccctcgtttgttcccnnnnnnncacacttggaactccccgcggtggcggccgctctttcactagtggatcccccgggctgcaggatttcctctcacccctagaaaaatgccgtccgtgagggtgggcaggaagaggtcgttgtcccagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcagccacatcctcggcgtcggcatcctgctcgggctcaagaacaccgggggccccttcgaccagatcatcggctagaccccctgcgtcggccgttgtttaagatcagaactcacagccctccgatcgactccaccagccgggcaagtgccttgcaaggaggtggactttttaaccgtgtggtgccgtggcgccccctgtacccttgaaccccatctttgggtcccgatggcgccccacgaggtcacagagagacgaaaacgcccccagggtacccacatttccccccctatagtgagatcgtaaataacgcccacccaactggagacggctctgtgttccccccttgccgtgactcggggcagaaaccactgggcggttgcccccaatcattagtttgcctttgggatgcatctctcccccttttttccccctcgctagtcggataatgagccgagaatcg

SEQ ID NO: 67490 - protein, 108 aa, Zea mays
  misc_feature: Ceres CLONE 1542157
  misc_feature (22)..(102): Pfam Name: PSI_PSAK Pfam Description: Photosystem I psaG / psaK
MPSVRVGRKRSLSQGIRCDYIGSATNLIMVTTTTLMLFAGRFGLAPSANRKATAGLKLEARDSGLQTGDPAGFTLADTLACGAVSHILGVGILLGLKNTGGPFDQIIG

SEQ ID NO: 67491 - DNA, 756 bp, Zea mays
  misc_feature: Ceres CLONE 1542158
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (155)..(155): n is a, c, t, g, unknown, or other
  misc_feature (756)..(756): n is a, c, t, g, unknown, or other
acccttttgttggatttatatccnnnnnntgaananncacaatntaatctcgcggtggggcgctcttaatagtggacccccgggctgcaggaattcgtctccccctagaaaaagagctggctcgctcaccctgtcacccaccctatggccgccgntttacggtttttagccgcgtgctctctctgtctccctcctcccttctcggggacaatttcggctaccgctgccgccctacgccagggttcccagtttttcgccaggccctttctcccgggacaaagaccctccgggccaccagttaacaccttaataactacctggatctaaggctttacaaaatagcctaaaaatttggctggggggaatattttactttttggcaaaaaaaaattttcccccttttaaacgaaattcccaggggggggttgttttctcaaaaaaaaattggattttttatgtgagaaagagtgggtttatttgttgggtttttttcccccccccccccgaaaagaaaatacattcttcgtttctaaagggaaaaaaagagggcccacacaacaacaattttccccccccctgttcacaaaaaaaaaaagcggtgatattcttctttttcttctggtggaaaaaaaaaacccacgatgctagtttttatttgctctgaattacgcccgcgagactatgtttctgggctcaacatccgcttgttgttttagtaaaaaaaaaaaaaatattactgccgccatcctcttctgn

SEQ ID NO: 67492 - DNA, 716 bp, Zea mays
  misc_feature: Ceres CLONE 1542164
  misc_feature: Encodes the peptide sequence at SEQ ID NO. 67493
  misc_feature (716)..(716): n is a, c, t, g, unknown, or other
gctctagaactagtggatcccccgggctgcaggaattcgtctcacccctagaaaaaattttgtttgctcatagctctgtatgtcgcttcatcggttccgcagcagcagaaggtggtggtcagggttccaaccatgacagatgacaagatcaagcagaaggccatcgaagctgttgcggacatttacggtattgactccatagcagcggatctgaaggagaacaagatgaccatcataggcgagatggatgcagtagcgattgccaagaagttaaagaagattggaaagattgacattgtgtctgttggacctgcaaaagaagaaaagaaggaagaaaagaaagaggagaaaaaggaggaaaagaaagaagagaagaaagaggacaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctgaatgccaaatggaaattgtaagcgttaatattttgttaaaattcccgttaaaatttttgttaaatcagctcattttttttaaccaatagggccaaaatcggccaaaatccctn

SEQ ID NO: 67493 - protein, 163 aa, Zea mays
  misc_feature: Ceres CLONE 1542164
  misc_feature: SWISSPROT Homolog: EC 3.2.1.23 Beta-galactosidase
MTDDKIKQKAIEAVADIYGIDSIAADLKENKMTIIGEMDAVAIAKKLKKIGKIDIVSVGPAKEEKKEEKKEEKKEEKKEEKKEDKKKKKKNETLEVPNSPYSESYYARSLAVVLQRRDWENPGVTQLNRLAAHPPFASWRNSEEARTDRPFQQLRSLNAKWKL

SEQ ID NO: 67494 - DNA, 696 bp, Zea mays
  misc_feature: Ceres CLONE 1542165
  misc_feature: Encodes the peptide sequence at SEQ ID NO. 67495
  misc_feature (179)..(179): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (205)..(205): n is a, c, t, g, unknown, or other
  misc_feature (206)..(206): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (252)..(252): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (260)..(260): n is a, c, t, g, unknown, or other
ccagcatgagctccccgcggtggcgggcgctctagatacgagactacagggctgaggaattgatcaaacctagaaaaagaagccagtcctgaatcacgtcttcacccgtgctcgtgcgctgcgcccataccttccgcctccacgctccccacgtgcaccgtggaccgtgcacagcaccncacagccaggtccccatggcgnnntnnttaaacccgacagaattgcactcagccacaaannnnnnnnnngtgnagnnnggncgtggttggggggcggcggtcagaacgtattacaacacccgcccccccaccaccacaaagcgagagagaagacccaacctacctccccttacccacccacacacgctattaatagccaaaccatactcccacatattaaaagagtaccgtcctctttcccacatacccacattataataaacaaacctacataaaacaataaacaaaaaattgaccccgcaaggacacacccaaaatataaccccgacacctcaccacaaaatcactgagcacaacactaaagacacccactatactcccacacaacaccatcgctacaacacgcaagaaccccaaccacaaaaacaatatcataaacaacacaacatccgaaacaccacactccacttcacaacacagagaaaaccgcacagcactaccaacgcggctcgcaaag

SEQ ID NO: 67495 - protein, 80 aa, Zea mays
  misc_feature: Ceres CLONE 1542165
  misc_feature (3)..(3): Xaa is any aa, unknown, or other
  misc_feature (4)..(4): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (18)..(18): Xaa is any aa, unknown, or other
  misc_feature (20)..(20): Xaa is any aa, unknown, or other
  misc_feature (21)..(21): Xaa is any aa, unknown, or other
MAXXLNPTELHSATXXXXVXXGRGWGAAVRTYYNTRPPTTTKRERRPNLPPLTHPHTLLIAKPYSHILKEYRPLSHIPTL

SEQ ID NO: 67496 - DNA, 690 bp, Zea mays
  misc_feature: Ceres CLONE 1542170
  misc_feature: Encodes the peptide sequence at SEQ ID NO. 67497
  misc_feature (74)..(74): n is a, c, t, g, unknown, or other
  misc_feature (271)..(271): n is a, c, t, g, unknown, or other
  misc_feature (391)..(391): n is a, c, t, g, unknown, or other
  misc_feature (392)..(392): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (473)..(473): n is a, c, t, g, unknown, or other
aaacctggagctcacagcggtggcggccgctctagaactagtggatcccccgggctgcaggaattccgtctcanccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaangccaagccagcggcggcgtccgggagcccgtggtacggccccaaccgcgtgctgtacctgggcccactgtccggcgaagccaccaatctacctcaccccccaggggggggggggagagannttnnnaaaccnnnnnggctnttcnncnaaccccgaaaaacattcgccaagaaccgggaactgggaggtgatcccccccccnctgggcccatgctgggggccccctcggattgctccttccccaaaaaagcttgaccccgaaaagggagttagaattcccgggagcaccgtttggtgtgcaaagccgcctccccataacccccgagaaaggggcgggcttgcaattacccccgaaaacgcaaaacccttcttccatccgggcgccagaaatctgatggtgtgtggggcccctgcccggg

SEQ ID NO: 67497 - protein, 123 aa, Zea mays
  misc_feature: Ceres CLONE 1542170
  misc_feature (39)..(39): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (84)..(84): Xaa is any aa, unknown, or other
  misc_feature (85)..(85): Xaa is any aa, unknown, or other
  misc_feature (88)..(88): Xaa is any aa, unknown, or other
  misc_feature (89)..(89): Xaa is any aa, unknown, or other
  misc_feature (107)..(107): Xaa is any aa, unknown, or other
MASSTMALSSTAFAGKAVNVPSSSAFGEARVTMRKTAAXAKPAAASGSPWYGPNRVLYLGPLSGEATNLPHPPGGGGRXXXKPXXLFXXPRKTFAKNRELGGDPPPXGPMLGAPSDCSFPKKA

SEQ ID NO: 67498 - DNA, 893 bp, Zea mays
  misc_feature: Ceres CLONE 1542180
  misc_feature: SWISSPROT Homolog: EC 1.6.99.5 NADH dehydrogenase (quinone)
  misc_feature (29)..(29): n is a, c, t, g, unknown, or other
tggctttttttttgattgtctaacctccncacatttttttccaatatctggggtccccgcggtggcggccgctctattctagtggatcccccgggctgcaggaattcgtctcacccctagaaaaattttggatttcaggacttttagccccggttagtgaaggaccagagaagctttctagttatgaatcgggtatagaacccatggggggggcttggttacaattccgaatacgctattacatgtttgcgctagtttttgttgtttttaatgtggaaacagtctttctctacccttgggcaatgagtttcgacgtattgggtgtatcccgtttttatcgaagctttcatttttgtgcttatcctagttgttgggtttactttatgcatgggcgaataggatgccttggaatggtcttaactgaaaaatgcaatacaaaaaaataaaaggattacgctttaggcccccccatattctcccttatagtgagtagtaaataacgcgcgtcttccatggtagtcgtttttacaactatctctgacgtggataaaaccccttgtagaaaacccccaagccctaatatcgcccttgcaagactctattccccccgtttcctcccagcatgtggggaattgagctcgaatgaatggctccgcagccgtaatcgtcccttttccctaaacatattttgctcaagccactttatatgggctatatctgtcactatttgatatgccatttaataatttttggtttaaaaatattcacgagtttagcactcttccgtatataaaaaaaattccactttttataaacctaagtgaggccgtataaatacggggaaacaacccgatcgattaatctgcagatgttatattacctcgtacgatatg

SEQ ID NO: 67499 - DNA, 631 bp, Zea mays
  misc_feature: Ceres CLONE 1542183
  misc_feature: Encodes the peptide sequence at SEQ ID NO. 67500
  misc_feature (172)..(172): n is a, c, t, g, unknown, or other
  misc_feature (285)..(285): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (397)..(397): n is a, c, t, g, unknown, or other
  misc_feature (398)..(398): n is a, c, t, g, unknown, or other
  misc_feature (448)..(448): n is a, c, t, g, unknown, or other
caccgcggtggcggccgctctagaactagtggatcccccgggctgcaggaattcctctcacccctagaaaaacctttatccttagttggggtatcaatgcgtgcaatgcaagatgctctaattgcgataaaagacggcggtgtacctccacctagcgtcctgccatcttttnaggagatcaaggatacattgggtttcaaccgctattataaagaagagaaacattcccagtggacaagtgaaggaagcagctgaaatctgatcccgtggattccgccggatcgnggccttggcttaatttcctcccgaaatgctggggttcccccggaaatgaggaattttttttccccccccccgggggggaaagaaggggggttnnnnannnncnnttcccccnnaaaatttatatagagactctcccttcccggtccggggcggggggggattnaaaaaccccccaaaaggggatttcaccttctaaaggcccaggccccttcctggggggttcggttttttcccccaaaaataagaaggggaaattacctgggctccatccagtgcttctcagtttgcttgggccgggtttgtccatggccccccccccaagggcctagggcgaggaaatggttcc

SEQ ID NO: 67500 - protein, 84 aa, Zea mays
  misc_feature: Ceres CLONE 1542183
  misc_feature (58)..(58): Xaa is any aa, unknown, or other
HRGGGRSRTSGSPGLQEFLSPLEKPLSLVGVSMRAMQDALIAIKDGGVPPPSVLPSFXEIKDTLGFNRYYKEEKHSQWTSEGSS

SEQ ID NO: 67501 - DNA, 637 bp, Zea mays
  misc_feature: Ceres CLONE 1542184
  misc_feature: Encodes the peptide sequence at SEQ ID NO. 67502
tccccgcggtggcggccgctctagaactagtggatcccccgggctgcaggaattcgtctcacccctagaaaaatagactcgtccactccagagccaaccagcacgcgctgtgaccgactgtgatcacacaccacgtcgttagtggacagagtggccctggcacgatgaccatgagaaccaccacctccttctcatggagatggaatacgtccccgaagttggagacgcccacgtgctgcccctggacaatagagcataggtcgccctgcgcgcgccagatctccagcctggccgccgccttcctcgaacctgccgtccctgaacccgtcaccggacgtgaacgcgctgttcacgacctgctccggcctgcatcccgcgcagcaccgtggaggtggagcgcctgagaccggagctgcggttgatgctcgcgggcctcatccgccgctgtctctactccgaagcccagctggaggcgcgctactcggacctgctggcggtcttggaggacaagccgctggaccactgccgctcttgacctacttggagcactacctgccgctgtgcaatctggagcacagactgctggcgagacacgttcgaggccgtcacccgcccgcgtcgacttcgtggtgtcctg

SEQ ID NO: 67502 - protein, 37 aa, Zea mays
  misc_feature: Ceres CLONE 1542184
  misc_feature: SWISSPROT Homolog: EC 2.5.1.43 Nicotianamine synthase
MLAGLIRRCLYSEAQLEARYSDLLAVLEDKPLDHCRS

SEQ ID NO: 67503 - DNA, 650 bp, Zea mays
  misc_feature: Ceres CLONE 1542186
  misc_feature (258)..(258): n is a, c, t, g, unknown, or other
  misc_feature (261)..(261): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (394)..(394): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (484)..(484): n is a, c, t, g, unknown, or other
  misc_feature (502)..(502): n is a, c, t, g, unknown, or other
  misc_feature (535)..(535): n is a, c, t, g, unknown, or other
  misc_feature (551)..(551): n is a, c, t, g, unknown, or other
  misc_feature (553)..(553): n is a, c, t, g, unknown, or other
  misc_feature (584)..(584): n is a, c, t, g, unknown, or other
  misc_feature (601)..(601): n is a, c, t, g, unknown, or other
  misc_feature (633)..(633): n is a, c, t, g, unknown, or other
  misc_feature (634)..(634): n is a, c, t, g, unknown, or other
aaagctggagctccccgcggtggcggccgctctagactagtggatcccccgggctgcaggaattcctctaacccctagaaaaatccactcctctcgctcccagaaagtcatctacctcgccggcggtgcatcccaggcgctcggttggctcctctccgtgcccggcgcttcgggcaccgtcctcgaggtcgtcgtgccctactctagggcctccatggcgcatctccttggcaagatgcccctgcaattcactagcangcnggctgcaaaggacatggcactggccgcatacaatcgagcactccagctttctggaccttttctgcaagttaagggggttggtttaccgggtttttttttccccccccgggggggggggggggggnnnnttttntttnnnnnnntggaccccaattgtcacaaaaaaaccccgccnnnntgtcgaaggggnnnatccagccgcgggagaacacaaggtttccgnattctctctgccttcggnaataaaaaaaaccgtgaaaagttttctccacgnttcccaccccccgtcncnccgtcccgagcactccccgcaaacctccttncccccctcccccctaanatatatgtcccccgccccccgccccccctgtnnatccttcccaccccga

SEQ ID NO: 67504 - DNA, 1009 bp, Zea mays
  misc_feature: Ceres CLONE 1542187-R
tcaagcgtctcccatttttttttttttttatacacaaacaaattttcctctcgataaacacaaatttcactgtcactctgcccaactgtatattagagcaacaactaaatcattagttatttataaaactactgcgattagaatatccactaaagactaaactatcctgctgaaagatgtctggtatgctcctcatatcccgttccagaatccaatactggcttcaataatctgaccaaaatttattcaaggtggaacctttcttgcaaacccagctaaaaaatctcgtgtttagttcaattacgagtaattatatgtgtaaagatgcaacctttgacggattctctatttcggcatgagctgggatatcttgtcatcctcaccagtggtggtgctcaccccccggtgggtggtgcggagccacaaacactcggccgataagctgaccacattgctgagcagcccgctgccaaagccgatgcccactatggtgagcactgtagagcccccgcgttccgcatcggtggcagcgggtatcccgtacaagcccttgcttcctttcgaaggacctggtgttaaaacctcgccgtccccaccgctgccgtgagccttccccagaacgatttggagaattaactctggcgattggggccatatatgactttttgtaggaaatacgttccaaatgtctaagaagccgttactcaggaagttccgaattcccttcggggtaatcggggcccggaacacgctggttttgcccattggtaaatccataaacaattttaggctggcccccttcttagtgaatttccctccctgaatgcctccataatatggcgtttctccgaaaaagcttataccccggcgaattttcacccccacggtaaaactccatccgtatggtgcccgaaaacctgtttctcgaatatgtccgccacctgttagtgggtgccccctggaaaactcctcgcggacatttctctccatcacaaatcccggaggtctt

SEQ ID NO: 67505 - DNA, 615 bp, Zea mays
  misc_feature: Ceres CLONE 1542189
  misc_feature: Encodes the peptide sequence at SEQ ID NO. 67506
cacccgcggtggcggccgctctagaactagtggatcccccgggctgcaggaattcgtctcacccctagaaaaaatcgctcatcacagataaatcttttttcccctccatttcatttcagcgtcgcgaaaaatggtagtcgttgatccgaaagccgtcgcctcggcgcaccagttcaccgtggtaatcgacggcgtcgagacgaccgtccacgagggcgtgctccggcgcaacggcggcacggtggccgtggtcggcccgggcgtcctcgaggtgagccgtctccagcacatgctggtgcgcgacgggggcgggggcaacgtgcgcttctcccagagcctgtaagcggccgcctaggactgcggcacggcgtcgttccaccggtgcaacgcacctgcgcgtgaagagcgcccgcgccgtgacctgtagcgcgctgccggtcgggcgaagtgcagcgtgcgcgctccaggagatctccaacgctccaatggcgccgcatcgcgtccgatgatgtagcagatccgccgggagatctccatcatgaggatgacgtgccaccccgacgtgacgggcatccgggaggtgctcgccacgcgctcgcgcatcgttgtggttag

SEQ ID NO: 67506 - protein, 70 aa, Zea mays
  misc_feature: Ceres CLONE 1542189
MVVVDPKAVASAHQFTVVIDGVETTVHEGVLRRNGGTVAVVGPGVLEVSRLQHMLVRDGGGGNVRFSQSL

SEQ ID NO: 67507 - DNA, 660 bp, Zea mays
  misc_feature: Ceres CLONE 1542191
  misc_feature: Translation starting site: 90
  misc_feature: SWISSPROT Homolog: EC 3.1.3.2 Acid phosphatase
  misc_feature (660)..(660): n is a, c, t, g, unknown, or other
acccgcggtggcggccgctctagaactagtggatcccccgggctgcaggaattcgtctcacccctagaaaaagagcctactctcctgccatggctccgctcccccgcttcctgatactcctgctcgccgtaacctcctccgcctttgccgccgccgcggcaaccggggctccggtggtgggggaggactacgtccgtccgccgccggcgcggtgccaccgcaaggcactccttagcctcttcccttggagcaagaaggaggagtccgccgccgcctccgatccgcagcaggtgcacatttctctagctggagaaaagcacatgagaataacatgggttaccaatgataactctgtcccatctgtggtggactatggaactaaagaaagtacatacacaatgaaatctcaaggagaaagcacatcctacagctacttattgtatagtttcaggaaaaattcatcatgttgtcattggacctcttgaagacaacactatttattactaccgatgtggagggcaaggtccagaattccaatttaagacccccgcctcccaatttcctttgtcattggctgttggtggtgatcttggacaaactaattgggaaacttccaccctgaatcacattaagcagtgtgagcctgatatgcctttaccn

SEQ ID NO: 67508 - DNA, 620 bp, Zea mays
  misc_feature: Ceres CLONE 1542195
aagctggagctccccgcggtggcggccgctctagaactagtggatcccccgggctgcaggaattcgtctcacccctagaaaaagaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgttagggcgttcgcgccccaagggcccgtgccattggctcagcccgcccggccgacgcgccgcggcgggccgcctcgaagctcccttcccaacgggcggcgtgctgaatcctttgcagacgacttaaaacgcgacggggcattgtaagtggcagagtggccttgctgccacgatccactgagatccagccccgcgtcgcacggattcttttgaatccgaactggacagaatatatctgggcacaccatcgaaaattgccattattgatcatgagaagaaaagaacatttgttgtgagga

SEQ ID NO: 67509 - DNA, 755 bp, Zea mays
  misc_feature: Ceres CLONE 1542196
  misc_feature (235)..(235): n is a, c, t, g, unknown, or other
  misc_feature (391)..(391): n is a, c, t, g, unknown, or other
  misc_feature (414)..(414): n is a, c, t, g, unknown, or other
  misc_feature (755)..(755): n is a, c, t, g, unknown, or other
tggcggccgctctagaactagtggatcccccgggctgcaggaattcgtctcacccctagaaaaaaaaaaagtgggagagaacagggctttcgcccccggcctcacaaggtcgggaagggtttcctcgagctcaccctctccactcgtgcacccgccgccacttcctttctctcgcgcacccgacgtcgcatcctctctcgtgcagttggggccagctgttgggccgaggtctacnacggggtcgacctctccgtggagacagccaatgcggccgagaggccagcccccacgagccaccactgagctcgacggcgaagctccccgaatccggactccggatttttttttccccccccccaaggaggaaacgaaaggggggatcccccccccntccccccaccccccccccccccnaatgtcgatcaatgacaccccctccccccctccaatccgggggggggtggccgagctgcaaagaagacccaccaccccgcactttgcgccctttggctatattctactggagcgggacaacccccgcacgtggcccaacatatgagttggacgagctctatgtgccgtacacagcatacccccccacaagccgcggcatttttctatcctccacacccccggctgcgtccattcgcaggctgctctcccatttgtcccatccaaacacccaacttatcttcttttcgttatctagccatccatgacacgaacactccgccgccgcccctcccctactcgan

SEQ ID NO: 67510 - DNA, 685 bp, Zea mays
  misc_feature: Ceres CLONE 1542206
  misc_feature: Encodes the peptide sequence at SEQ ID NO. 67511
  misc_feature (309)..(309): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (402)..(402): n is a, c, t, g, unknown, or other
  misc_feature (405)..(405): n is a, c, t, g, unknown, or other
  misc_feature (419)..(419): n is a, c, t, g, unknown, or other
aaagctggagctcaccgcggtggcggccgctctagaactagtggatccccagggctgcaggaattcccctaacccctagaaaaaactgctgcgtcccctcccttttcgccatcgagcgtcaactgtgctggccgccggcgcgtaactgcaccagggtcactgcttacgaggaagaggaggcacaacagtgttgttggggtgtctcgtcgtgcggtgccggtgccggtgaccatgggcgtgcacgccaaggcaatgagctggtacacgagcccgccggggtcccccgcgcccgggagggccgccaaggcncaccacgctctttttttcaacccccggggcggcaaccccatcatttttttttttcccccccccccgggagggaagaaaggggggtttnnnncntcncttctccctcctcnacctttataataataaaaatataatcaccaacgagcggggggggcattgttttttgaccccccctggctctgtatacttctttttctccttattccttcccccatacataaatcttacctgctcccccccgccctcagccatcattcgacttgcttctccccctccccaccttgtcttcccctctaccatcgaaaactctacaccatctgtctgtttgtattccccctcaagaagtccccgctttccgcatcgtttccaacttcaa

SEQ ID NO: 67511 - protein, 65 aa, Zea mays
  misc_feature: Ceres CLONE 1542206
  misc_feature (56)..(56): Xaa is any aa, unknown, or other
  misc_feature (57)..(57): Xaa is any aa, unknown, or other
  misc_feature (63)..(63): Xaa is any aa, unknown, or other
MGVHAKAMSWYTSPPGSPAPGRAAKAHHALFFNPRGGNPIIFFFPPPPGGKKGGFXXSLLPPXPL

SEQ ID NO: 67512 - DNA, 775 bp, Zea mays
  misc_feature: Ceres CLONE 1542208
  misc_feature: Encodes the peptide sequence at SEQ ID NO. 67513
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (35)..(35): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tgtttttgttcttgtttgtnnccnccgctccccantntaatacgcatnnnnnacaaagctggagctccccgcggtggcggccgctctagaactagtggatcccccgggctgcaggaattcgtctcacccctagaaaaagctagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggaaaaccagccaacgtgttcggcaagccctatgagagcacggagtacatctcgtacagcggcgacggtttcaagctgcttgatcccgtccaagtggaaccccagcaagggaccggggagttcccccggccaggtgctcccgctaccgaaggacaactttcgatcgcctactagtttacgttgttcggtcatttattaccactcccaagttctctaatcaataacgattcgtcccgaactgacctgacatcttccccgcagtgaagttttccttcctcccccaccaactccaatcttaaccaatgttttctgtagaatgattaaaggtaacttactcgtg

SEQ ID NO: 67513 - protein, 133 aa, Zea mays
  misc_feature: Ceres CLONE 1542208
MASTSCCLLHQSTARLGASPRLAAAPPRSAQLLVCKARKQEAAADQSDVSRRAALALLAGVTAAAGAKVGPAAAAYGKPANVFGKPYESTEYISYSGDGFKLLDPVQVEPQQGTGEFPRPGAPATEGQLSIAY

SEQ ID NO: 67514 - DNA, 639 bp, Zea mays
  misc_feature: Ceres CLONE 1542213
  misc_feature: Encodes the peptide sequence at SEQ ID NO. 67515
  misc_feature (384)..(384): n is a, c, t, g, unknown, or other
atagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttggcaatgcaggggagggggggcngggaaactccgtccaaggctaaatacaggcgagagaccgatagcgaacaagtaccgcgagggaaagatgaaaaggactttgaaaagacagtcaaagagtaaaattcccaagccgccccttcccccatctcctttcgcgacccattttgacgattccggatggggcgccaaggccaaaataagcccggggaaaaaaagccggcgggagaaaaggcccaaaaaaaccccagggcggaaaaacccgctgccaagtaag

SEQ ID NO: 67515 - protein, 39 aa, Zea mays
  misc_feature: Ceres CLONE 1542213
  misc_feature (7)..(7): Xaa is any aa, unknown, or other
MQGRGGXETPSKAKYRRETDSEQVPRGKDEKDFEKTVKE

SEQ ID NO: 67516 - DNA, 816 bp, Zea mays
  misc_feature: Ceres CLONE 1542214
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (154)..(154): n is a, c, t, g, unknown, or other
tttttttttcctccccnncnnnanaannnnntntnnnnnnnnnnnnnnnnnnnaaaaactggagctccccgcggtggcggccgannnttttcttcttgatcccccgggctgcaggatttcctctcacccctagaaaaaactttgatgccatgtncagggaccatggcattgagcctggtgtggagcactatgttgggatcattgaggtcttggggaagtcagggcatctcaacgaggctctggagttcattgagaagctgcctttccagcccaatgccatggtgtgggagtcacttcttgaacctggcccgcatgaatggagacattgaccttgaggacctggcaaaaggagttgttggtgtcacttgtatcatcctaggcaaaatcctactaaagcttcccagccccacctcccttttatttccccgcttaattaaaaggggggggaggcgcaccaacaaacctttttccatccacccccctccccctcttaaaaatttttaaaagatcggtgctatctttggcgcctttatggtatttttccccacttacaccactataatatctattcttccccttattacaattttccccccctcctatgcccctctctatactttaatcatttgttctatttcccaccactagccccaaccactcatctaatttacttctatcatttctaaatataaactattaactttaataaatatctcacttttttcactaataattaaaatctttctcatatattatcaatatataaattccttacatattcaacccaatcttcctcttccaaaatttttatttttg

SEQ ID NO: 67517 - DNA, 794 bp, Zea mays
  misc_feature: Ceres CLONE 1542216
  misc_feature: SWISSPROT Homolog: EC 3.6.3.14 H(+)-transporting two-sector ATPase
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (122)..(122): n is a, c, t, g, unknown, or other
  misc_feature (427)..(427): n is a, c, t, g, unknown, or other
tttgggtgttnccctccnnnaaannnnnnnnnnnnnnnnnnnnnggaaannnnngaaagctggagctccccgcggtggcggccgctctagaactagtggatccccccggctgcaggaattcntctcacccctagaaaaagagctgccggaaggcccgtcggatccgccgccgccaagatgaatgacgccgatgtagccaaccagatccagcagatggtgcggttcatccgccaggaggccgactagaaggccaacgagatctccgtctccgccgaggaggaattcaacattgagaagctgccgcttgttgaagctgaaaaaaacaagattagacccgactttgaccgcaaagagaagccggttcacccacggaagataattgagcactctatgccggtgaatgcttctcccatttttttcccccccnacgaggggggggggggggggccacaaccaaaccactattccattcaccccacttccccccttgaacaaccacaccgcgtcctggaggggcgggggacccttttgcaatgagccttagattggctccacgggcctgtgggcccgctgccggaaaccagccccgtcgggggaagaagcgccccccgccctgacctcgaacaaaatacaccctctggtggccggcaaacccggaggcttgccgttcctccgccggcatcccccaggattgtctcgtcattagtaaggcagtctgcggcgccgggcccacggggctcttgttcttgttcaccaccgggggaacgtagtgtcctctccccacgcccgagggg

SEQ ID NO: 67518 - DNA, 662 bp, Zea mays
  misc_feature: Ceres CLONE 1542217
  misc_feature: Encodes the peptide sequence at SEQ ID NO. 67519
agagctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgcccgcgggggtgaccggcgagttccccggcgactacggctgggacaccgccgggctgtccgcggacccggaggcgttcgcgcggaacagggcgctggaggtgatccacgggcggtgggcgatgctgggtgccctgggctgcatccccccggaggggctggagaagtgggtgcccctgaacttcaaggaagcccgtgttggtccaggccgggcccgcaaatctttctcggaggcgggctgggactacctggggaaaccccaacctggttgcacccgcaaaacatcccgg

SEQ ID NO: 67519 - protein, 166 aa, Zea mays
  misc_feature: Ceres CLONE 1542217
  misc_feature (69)..(157): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPAGVTGEFPGDYGWDTAGLSADPEAFARNRALEVIHGRWAMLGALGCIPPEGLEKWVPLNFKEARVGPGRARKSFSEAGWDYLGKPQPGCTRKTSR

SEQ ID NO: 67520 - DNA, 665 bp, Zea mays
  misc_feature: Ceres CLONE 1542219
  misc_feature: Encodes the peptide sequence at SEQ ID NO. 67521
  misc_feature (412)..(412): n is a, c, t, g, unknown, or other
  misc_feature (574)..(574): n is a, c, t, g, unknown, or other
aaagctggagctccccgcggtggcggccgctctagaactagtggatcccccgggctgcaggaattcgtctcacccctagaaaaagtccggttcagttcagtggcgccgtcgtgcctcgacgacggcgggagacgccgcaagcaggtgagagtgagacgggcggtgactagcgggcgcttaggccgacatcggccccgcagcggcggggtagggtgcgtcaacacgcgggactgcgacttggggggggattgattcccttcgctgttctctcttctccggcgcgtgcgcgcgggatcgaaggtagggtttgcgccccaaagttcgtgtctttggggacagcggcggcaatggactacacctacgccatccacatcgtgggggagggcgggggggcccgacgcctgggccaacncggcgtcggccgcaggcgccgacccccgcatttggggcaccgaggacgactaccgccgggggaacgcccaacccggctacggggaccggaacccctcgtcccggggggagaacgagcagcccccccccggggaaaaaaggtcccgggggggggcggccagcncccattgcctggggcgggggcaaacccaaacgaagtcgcgcgccattgggaaagaagttcttcccaaacaaagcttttgctgggaagttcg

SEQ ID NO: 67521 - protein, 106 aa, Zea mays
  misc_feature: Ceres CLONE 1542219
  misc_feature (22)..(22): Xaa is any aa, unknown, or other
  misc_feature (76)..(76): Xaa is any aa, unknown, or other
MDYTYAIHIVGEGGGARRLGQXGVGRRRRPPHLGHRGRLPPGERPTRLRGPEPLVPGGERAAPPRGKKVPGGGGQXPLPGAGANPNEVARHWERSSSQTKLLLGSS

SEQ ID NO: 67522 - DNA, 813 bp, Zea mays
  misc_feature: Ceres CLONE 1542223
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (813)..(813): n is a, c, t, g, unknown, or other
nttttcccccccnnnnnnccgcgctntncccctnnnattgctaannnnnaacgtctggagctccccgcggtggcggccgctctagactagtggatcccccgggctgcaggaattcgtctcacccctagaaaaagtccgttccggcgtcctctctcccccagacccccaccccatgccaacgcccaccccgccgtctccgtccccgtctccctcttctggaacttgccctctgctccggatcggcgcgggccgtcgttttgccatggcatttccatcttgggcgactctgttcttcgccgggatgacggtggcgttggcagccgtggaactttaatccgaagctggaggagggagcgtctgcttctaccggatgttcggtttcggggactctctcacggatacttttttttcccccgccctggggggggggggggggttccggaacccctctccctaacccccccctactcgccagacctttttactaggccgcccctcccgggccggccaatccccaacgcggtcctactccctggtctcgaagctttcttttctctaaagcggccatattggagtgtttgccccttattgtatgtcctcccttacccttggcggcgggggggcggacttcttctaacacgggcgctcttcaccttttgcatacacggggtgggggatctgttgaatcttcacaggtgcttcagctccatttgactcaaatacccattccgacgtgttctgcacaggggctagtcccccccccgcgccatggagcaccccacgttgcacccgggctaccacggaatccactcn

SEQ ID NO: 67523 - DNA, 728 bp, Zea mays
  misc_feature: Ceres CLONE 1542228
  misc_feature: Encodes the peptide sequence at SEQ ID NO. 67524
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (36)..(36): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
tgggggttttttgnnnnnncncccaacacccgcccnantannnnnccgcttnnnnntcaccactggagctccccgcggtggcggccgctctagaatagtggatcccccgggctgcaggaattcgtctcacccctagaaaaaaaagtccgcgtccagatcccgccaccaaccgatccggcgccctccagcatggcgggggcgggggcgaaggcggcgggagccctggctctggcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctgggcatctggagcctgaacttgggaaactggagcatcctcaccatccggaactttataagaataacattcaaggaacagtcccttctgagcttggcaacttgaagaatctaaaaagcttcgactttgaacaaaaacaacattttcaggggacaatacctccctgcccttggtaaagtttgaaagtcccttggtatttcttgccggcacaaatgggcccatcccttttgactggaggcccccatccccaaggggaaacttcccctaggcaaaaattttaaactccctcaaaaacttgcttgga

SEQ ID NO: 67524 - protein, 136 aa, Zea mays
  misc_feature: Ceres CLONE 1542228
  misc_feature (23)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGAGAKAAGALALALVLALAGANSEGDALSALRRSLRDPGGVLQSWDPTLVNPCTWFHVTCDRDNRVTRLDLGNLNLSGHLEPELGKLEHPHHPELYKNNIQGTVPSELGNLKNLKSFDFEQKQHFQGTIPPCPW

SEQ ID NO: 67525 - DNA, 662 bp, Zea mays
  misc_feature: Ceres CLONE 1542231
  misc_feature: Encodes the peptide sequence at SEQ ID NO. 67526
atagctggagctccccgcggtggcggccgctctagaactagtggatcccccgggctgcaggaattcgtctcacccctagaaaaaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggggctggtggtttcattggatcccacattgctcgccgtctgaggaacgagggccattacatcattgcctctgacctggaagaggagggggggggggggacccaggacctgttctgccatgacctccccctcgttgatcttcgggtcctggacaactgtctccaggtcacccatggttgtccaccatgtcttctttcttgctgccaagggggggcatggggttcatccaggctgttccacttctgggatccgtgtccaacatccctctgtacccgtttttaccatggctgggagtgctgcacttttccagggggtgcggaagatgttctttcctagggcccccggagcggtcctcatttatacccctctacgtt

SEQ ID NO: 67526 - protein, 146 aa, Zea mays
  misc_feature: Ceres CLONE 1542231
  misc_feature: SWISSPROT Homolog: EC 5.1.3.18 GDP-mannose 3,5-epimerase
MGSSEKTVTAYGEYTYAELEREPYWPSEKLRISITGAGGFIGSHIARRLRNEGHYIIASDLEEEGGGGTQDLFCHDLPLVDLRVLDNCLQVTHGCPPCLLSCCQGGAWGSSRLFHFWDPCPTSLCTRFYHGWECCTFPGGAEDVLS

SEQ ID NO: 67527 - DNA, 690 bp, Zea mays
  misc_feature: Ceres CLONE 1542237
  misc_feature: Encodes the peptide sequence at SEQ ID NO. 67528
  misc_feature (317)..(317): n is a, c, t, g, unknown, or other
  misc_feature (326)..(326): n is a, c, t, g, unknown, or other
  misc_feature (390)..(390): n is a, c, t, g, unknown, or other
  misc_feature (410)..(410): n is a, c, t, g, unknown, or other
  misc_feature (446)..(446): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (576)..(576): n is a, c, t, g, unknown, or other
  misc_feature (651)..(651): n is a, c, t, g, unknown, or other
  misc_feature (669)..(669): n is a, c, t, g, unknown, or other
acagctggagctccccgcggtggcggccgctctataactagtggatcccccgggctgcaggaattcgtctcacccctagaaaaaaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgcccgaaaatcgntggaacccnccccctgggttcaaaaggtcccctcccccggggaaattccgggtttcaaacccccccggggggngggggcaaaggaaacccggngcttcccccccaaggggcaccccgggaggggggggnatttttttcccaccnnncccccgggggccaaaagggcgcccccccccctgggggcactttttttttggggggaagggggggaggagaagccacccctcccggggttttaagagcgggggggcgggagaancaaaaaagagactttggcgcccctttttttctctttagggaggcgcgggggggggggaacacccccccccctccntataaaaagaggaggggnggggaaaaaaccacaaaaccg

SEQ ID NO: 67528 - protein, 137 aa, Zea mays
  misc_feature: Ceres CLONE 1542237
  misc_feature (59)..(59): Xaa is any aa, unknown, or other
  misc_feature (62)..(62): Xaa is any aa, unknown, or other
  misc_feature (83)..(83): Xaa is any aa, unknown, or other
  misc_feature (90)..(90): Xaa is any aa, unknown, or other
  misc_feature (102)..(102): Xaa is any aa, unknown, or other
  misc_feature (107)..(107): Xaa is any aa, unknown, or other
MALAPTSAAVLKTPFLGARRALANAAAKPAPRRALVVAAAAAAKKSWIPAIKSDARKSXEPXPWVQKVPSPGEIPGFKPPRGXGAKETRXFPPKGHPGRGGXFFPTXPPGAKRAPPPLGALFFWGEGGEEKPPLPGF

SEQ ID NO: 67529 - DNA, 739 bp, Zea mays
  misc_feature: Ceres CLONE 1542246
  misc_feature: Encodes the peptide sequence at SEQ ID NO. 67530
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
ggggttttgctcccgccgcccctatcattaaatannngacccacancccaaaactggaactccccgcggtggcggccgctctagaactagtggatcccccgggctgcaggaattcgtctcacccctagaaaatccgcctctactgtagccacggcccttggttcccctccattattcgacctcacctcaccttgccaccagccatggctgccgtgaccgccgcggccatctctctgtcctcctcctccgcctcctcccctgcggctgctgccaaggccaaggcggcgtccccgtcgtcgtcgccatgcaggcacctccagttcctgtcggcagcgagcccgcggcggcggtggcgggccggcgcccgcgcggtacgggcgcaggtgtccaccaccgagaccgcggcggcggggccggcgaagacgtccaagaagcaggacgaggggctggtcaccaacaactacaagcccaaggagccgtacgtcgggaggtgcctgtccaacaccaggatctccggcgacgacgcgccgggggagacgtggcacatggtcttcagcaccgaaggcgagatcccgaatagagaagggccatccatcggcatcatcgcttgatggcgacaacaacaacggtaagcctcacaagctcaaggctataaatccatcgaccagccagcgccctccgagaaattttcatgtgaattccaaaaaaggttatcccctttttgcctatcaaaaaagct

SEQ ID NO: 67530 - protein, 135 aa, Zea mays
  misc_feature: Ceres CLONE 1542246
  misc_feature: SWISSPROT Homolog: EC 1.18.1.2 Ferredoxin--NADP(+) reductase
MAAVTAAAISLSSSSASSPAAAAKAKAASPSSSPCRHLQFLSAASPRRRWRAGARAVRAQVSTTETAAAGPAKTSKKQDEGLVTNNYKPKEPYVGRCLSNTRISGDDAPGETWHMVFSTEGEIPNREGPSIGIIA

SEQ ID NO: 67531 - DNA, 901 bp, Zea mays
  misc_feature: Ceres CLONE 1542248
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (48)..(48): n is a, c, t, g, unknown, or other
  misc_feature (49)..(49): n is a, c, t, g, unknown, or other
ttttttttttttnnttgttnnntacacnccccnntttttcgccttttnntcacactggtgctcaccgcggtggcggccgctctagactagtggatcccccgggctgcaggaattcgtctcacccctagaaaactctcctgggtcctggcttctccttccactccggagatcgacggctgcttgccgcactcgcgctcgctcccacggccggcaaccatggccgccgccgctgccaccgtgccagcccccttcctctcgggcctcccctctccacagaccccgtctcctgtgcctcccctcccccgttcatgatagcccttcccgtctccgctcctttccttcctcgcagagaagcgccgcgcctttttcttttctctcctcaaaacttccttgttcctatcaattcccactttttttttttcccccccccccccgggggggggggggggggggggttatattttactcctttttacctctcaccttctctccctctcttccctcctatcgcctctcttcctcctctccctcaactacttcccatacgagtctcacacctccaaactctccacaacacgcgcgattctattcgtttttccttcaactcctcatgatcttgacttctctatttttttctctactacaccccgctgcgtgtggttaccgcgttattcgattacgttttcctatttcccttcctctcctcgccacccatcactcgcattcccctactcctcctccctccccactcccagccccccgtctctccccactcacccctcttactcctccgccctctccccttctctctctctttttcttcgcctcacgcgttctccagttctagatgtctgttcttctggcgacttcgcagtgatgacctgaccttatgcaccccccg

SEQ ID NO: 67532 - DNA, 1237 bp, Zea mays
  misc_feature: Ceres CLONE 1542251
  misc_feature: Encodes the peptide sequence at SEQ ID NO. 67533
aatgtgtgcacggcactgcttagttctttccaaagagagaaagcaacaaaacaatcaggggtccatccatttttgtcagccatgacgaacggctacctgttccgcgagtacatcggcgcgcagtccaccggcgtccagttctccgacgtgcccatcaacgccttcgttagcttccacttcatcctctccttcgccatcgactacacgcccgtggggcagcagccgaagccggtgccgaccaacggggtgttcagcccgttctgggacacgggcaacctgtcccccgccgccgtggccgctataaaggcctcgcaccctaacgtcgccgtcatggcggggctcggcggcgccagcgtgctggacatcgtcaatgccgtcttcaccccgacctccgtcgacacgtgggtggccaacgccgtgacgtcgctcacgggcatcattaacaggtacgggctggacggcgtggacgtggactacgagcacttcgccgacggcgccgacgtgaatacgttcgtcgagtgcatcggccgcctcctgacacagctcaagcagacgatgcccaacatcgccacctccatcgcgccgttcgaggacccagtggtccagaagtactaccaggcgctctggagcaagtactccggcgtcatcgactacgtcaacttccagttctacgcctacggcgacaacaccgacgtgcccacgtacgtcatgttctacaacaaccagttggcgaactatcccggcggcaaggtcctcgccagcttcaagaccggcaacgtgaccggactgctctcgccggaccaaggtatcagtggggccaaggagctgcagcggcagaacaagctgccagggctgttcatctggtcggcggacagctccaagaagagcagctacggcttcaagtacgagaccgaggcgcagcagatcattgccaaccactgatcgatctgcgatcaggacttagcttaacaagggatcacacattttacaataaataaatgataacctctcaggtcaacaacaattacttgcaggttaaggagttcggctgttgatttaaggacagaatgatggtgagtgaaaatgcaagtttaaagaaaatcgtcattattctgtcctttaaacttgtactagcaaagtaccagtgtgttgttacgatttacatttatgtttaagtatacaataaaaacataaacacatgtgtgttatgttggttggataaaaaaaaaaaaaaaaa

SEQ ID NO: 67533 - protein, 286 aa, Zea mays
  misc_feature: Ceres CLONE 1542251
  misc_feature (14)..(266): Pfam Name: Glyco_hydro_18 Pfam Description: Glycosyl hydrolases family 18
  misc_feature: SWISSPROT Homolog: EC 3.2.1.14 Chitinase
MTNGYLFREYIGAQSTGVQFSDVPINAFVSFHFILSFAIDYTPVGQQPKPVPTNGVFSPFWDTGNLSPAAVAAIKASHPNVAVMAGLGGASVLDIVNAVFTPTSVDTWVANAVTSLTGIINRYGLDGVDVDYEHFADGADVNTFVECIGRLLTQLKQTMPNIATSIAPFEDPVVQKYYQALWSKYSGVIDYVNFQFYAYGDNTDVPTYVMFYNNQLANYPGGKVLASFKTGNVTGLLSPDQGISGAKELQRQNKLPGLFIWSADSSKKSSYGFKYETEAQQIIANH

SEQ ID NO: 67534 - DNA, 871 bp, Zea mays
  misc_feature: Ceres CLONE 1542252
  misc_feature: Encodes the peptide sequence at SEQ ID NO. 67535
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (871)..(871): n is a, c, t, g, unknown, or other
ttttttttttttttgtttcttcttttctcaccccnnnngggggaaannnnnnaaagctggggctccccgcggtggcggccgctctagaatagtggatcccccgggctgcaggaattcgtctcacccctagaaaaagccaagatccagcaaaccagagttctccaaagcgcgaagctccagctcaagctccaggcaaccgtcaccgtcagggaacgcgcgcgcaggaatggccttttactacggcgtgggcggacagtcgtcggcgtgggcggcgccgggcggcagcaggccatggaccaaggcggaggacaaggtgttcgagggcgcgctggggacgtcccccgccccacttgccgaaacggtgggccctcgtgccccccccgggctgtccaaccgcacgccgcgagggtgacttgtgtcctccccccccccggggggggggggggggggggttcttcctttaatcccccccctgccccgagggcccccggaactccctagggatcaacacaacccatcctcccccgcagggggaagataacgctctaggcgcccccgtcgccaccaacggcgcggacgctccaaccacacgtgcacccgacgaaaagtatttcgccaccccaccacatgcgcccgccgccccgcccgacgaaaggacgtgcacttggcgcgccaaacctaggtacgaccacatttttaaaaaactaacataccaacccacctactaccccactggacagaagccgcacctcccgagaagcacccgcgaggaccacaacctcatacatacccctcatagaaagaatatcgttcggtatctatccggattgggaataccggcctacaagaacgaaacgaatgagcgaacagn

SEQ ID NO: 67535 - protein, 61 aa, Zea mays
  misc_feature: Ceres CLONE 1542252
MAFYYGVGGQSSAWAAPGGSRPWTKAEDKVFEGALGTSPAPLAETVGPRAPPGLSNRTPRG

SEQ ID NO: 67536 - DNA, 1110 bp, Zea mays
  misc_feature: Ceres CLONE 1542257
  misc_feature: Encodes the peptide sequence at SEQ ID NO. 67537
aaaaagagtcagagacacacacacacgcagacggacggaccactagcaaacagcagcgccccacgatcagcacccctgccgccggggcaaactgctgctgctgccgatccggtccgggggatggagagggacgccacagccttctgcccgccgccccagcccgccccggctcctgcggcggtgctgggcgccggtgtcgcggtcgcggtcgcgccggcggcagggaacggccgcggcggcggcggcggagggaagcagtaccgcggcgtccggatgcgcaagtggggcaagtgggtggcggagatccgcgagcccaacaagcggtcgcggatctggctcgggtcctactccaccgccgaggccgccgcgcgcgcctacgacacggccgtcttctgcctgcgcggccgcgccgcgcggctcaacttccccgaccagctcgacggcgcgcaggcggcggcagcggacagcacggaggggccgcgcagggacggggccggggccgggctcaccgccgccgccatccgcaagaaggcggccgaggtcggggcccgcgtcgacgcgctccactgcggcgccggcctagctggtggcggcacctccccgctgctgctgtcccaccgccgccgccccaagaaccccgacctcaaccgggagcccaccccggacacctcggacgacgagtaaagcggggctagtttttgtcgccgttcttcttcttcctcggtctaccagtccctactccctagctagatagctgtagcagatagagcaagcaaaccaggtggacccaggaggccaggacagacggaggggcgcgggcggtcgcggtcgcggtcgcaacccaaggtgttcgatgggctgcggatgagctccatccaataatggagttgcgacgtcgacgtcagggccggaagcctagcgtgcgagctctcccggtctccccgtagcagggtgacactcacagacgggtgcgggcgggcgggcatgtagctcaagcaagacggctatgttactatgtacctctcagccttggcataaagacgtgtaaaggaaaaaaaatatatactccccggcaagcaagatgtgttttttcaaaaaaaaaaaaaaaaa

SEQ ID NO: 67537 - protein, 187 aa, Zea mays
  misc_feature: Ceres CLONE 1542257
  misc_feature (45)..(96): Pfam Name: AP2 Pfam Description: AP2 domain
  misc_feature: The sequence is a functional homolog of SEQ ID NO 489 in the 10/374,780 US patent application
  misc_feature: The sequence is a functional homolog of SEQ ID NO 682 in the 10/666,642 US patent application
  misc_feature: The sequence is a functional homolog of SEQ ID NO 989 in the 10/412,699 US patent application
  misc_feature: The sequence is a functional homolog of SEQ ID NO 488 in the 10/374,780 US patent application
  misc_feature: The sequence is a functional homolog of SEQ ID NO 490 in the 10/374,780 US patent application
  misc_feature: The sequence is a functional homolog of SEQ ID NO 681 in the 10/666,642 US patent application
  misc_feature: The sequence is a functional homolog of SEQ ID NO 683 in the 10/666,642 US patent application
  misc_feature: The sequence is a functional homolog of SEQ ID NO 988 in the 10/412,699 US patent application
  misc_feature: The sequence is a functional homolog of SEQ ID NO 990 in the 10/412,699 US patent application
  misc_feature: The sequence is a functional homolog of SEQ ID NO 198 in the 11/375,241 US patent application
  misc_feature: The sequence is a functional homolog of SEQ ID NO 806 in the 11/435,388 US patent application
  misc_feature: The sequence is a functional homolog of SEQ ID NO 16 in the 10/412,699 US patent application
  misc_feature: The sequence is a functional homolog of SEQ ID NO 1848 in the 10/412,699 US patent application
  misc_feature: The sequence is a functional homolog of SEQ ID NO 204 in the 11/375,241 US patent application
  misc_feature: The sequence is a functional homolog of SEQ ID NO 2090 in the 10/374,780 US patent application
  misc_feature: The sequence is a functional homolog of SEQ ID NO 630 in the 10/225,066 US patent application
  misc_feature: The sequence is a functional homolog of SEQ ID NO 648 in the 11/435,388 US patent application
  misc_feature: The sequence is a functional homolog of SEQ ID NO 810 in the 10/412,699 US patent application
MERDATAFCPPPQPAPAPAAVLGAGVAVAVAPAAGNGRGGGGGGKQYRGVRMRKWGKWVAEIREPNKRSRIWLGSYSTAEAAARAYDTAVFCLRGRAARLNFPDQLDGAQAAAADSTEGPRRDGAGAGLTAAAIRKKAAEVGARVDALHCGAGLAGGGTSPLLLSHRRRPKNPDLNREPTPDTSDDE

SEQ ID NO: 67538 - DNA, 671 bp, Zea mays
  misc_feature: Ceres CLONE 1542258
  misc_feature: Encodes the peptide sequence at SEQ ID NO. 67539
  misc_feature (390)..(390): n is a, c, t, g, unknown, or other
  misc_feature (671)..(671): n is a, c, t, g, unknown, or other
aaagctggagctccccgcggtggcggccgctctagaactagtggatcccccgggctgcaggaattcgtctcacccctagaaaaagattctccgttctccacagtcctccacactcgccgagcgacaccgcgcgggacgaccgagcaagcagagcatgcaaccgtcgtgcctgggcgcatgcagcggtggaggactagcactctccgcccgccgcctccacggcccctcctactgccgcgtcgcgccgcatagggcttccgcctcgtgctccgccggtggcggcggcaaggcatcgccgcgggggaaggacaacgtctggagcgtcgataacgagcgtgccgccaaggaggcggtccggggccccacccaccgccgcgggaggggccccantgttcgccgcctgcccccgcccaacatgaaggggaaggatgcggggtccagggttctagtgtctggagccatgctcgtggaggtcaaaactgtgctccaaactccaaaacctggttacaaagcctttcttggggatacatttgccaaattaccttaaactggcaaaccggaaagggcgtgtggaagctatctttcccaccaattcacagtctgaacatgggaccccccgtttggggtttgggtaaccaaacgaacaagctcccttctttctactgccgtcn

SEQ ID NO: 67539 - protein, 130 aa, Zea mays
  misc_feature: Ceres CLONE 1542258
  misc_feature (79)..(79): Xaa is any aa, unknown, or other
MQPSCLGACSGGGLALSARRLHGPSYCRVAPHRASASCSAGGGGKASPRGKDNVWSVDNERAAKEAVRGPTHRRGRGPXVRRLPPPNMKGKDAGSRVLVSGAMLVEVKTVLQTPKPGYKAFLGDTFAKLP

SEQ ID NO: 67540 - DNA, 590 bp, Zea mays
  misc_feature: Ceres CLONE 1542262
  misc_feature: Encodes the peptide sequence at SEQ ID NO. 67541
  misc_feature (350)..(350): n is a, c, t, g, unknown, or other
  misc_feature (361)..(361): n is a, c, t, g, unknown, or other
  misc_feature (362)..(362): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (472)..(472): n is a, c, t, g, unknown, or other
  misc_feature (474)..(474): n is a, c, t, g, unknown, or other
  misc_feature (475)..(475): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
cggagctccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatgggtgatggtgttcggcgaagatcacngacccaaggcnnacccnnnnngaaacttccagaagagagggggggggaaccctggcgcggggaatgggggttccccccccccccccaaaaannnnngggggggggcgtcccccccccccccncnnccccccccccccgggggggggggggggggggaaaatataaaaaaaagcccccccccccaccccccgcgggggggggggggggganntnttcttcaaaaaaaagggggggcgggat

SEQ ID NO: 67541 - protein, 140 aa, Zea mays
  misc_feature: Ceres CLONE 1542262
  misc_feature (4)..(101): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (61)..(61): Xaa is any aa, unknown, or other
  misc_feature (65)..(65): Xaa is any aa, unknown, or other
  misc_feature (67)..(67): Xaa is any aa, unknown, or other
  misc_feature (68)..(68): Xaa is any aa, unknown, or other
  misc_feature (92)..(92): Xaa is any aa, unknown, or other
  misc_feature (93)..(93): Xaa is any aa, unknown, or other
  misc_feature (102)..(102): Xaa is any aa, unknown, or other
  misc_feature (103)..(103): Xaa is any aa, unknown, or other
  misc_feature (131)..(131): Xaa is any aa, unknown, or other
  misc_feature (132)..(132): Xaa is any aa, unknown, or other
MAAESFLFTSESVNEGHPDKLCDQVSDAVLDACLAQDPDSKVACETCTKTNMGDGVRRRSXTQGXPXXKLPEERGGEPWRGEWGFPPPPQKXXGGGVPPPPXXPPPRGGGGGGKYKKKPPPPPPAGGGGGXXSSKKRGGG

SEQ ID NO: 67542 - DNA, 678 bp, Zea mays
  misc_feature: Ceres CLONE 1542264
  misc_feature: Encodes the peptide sequence at SEQ ID NO. 67543
ggcggccgctctagaactagtggatcccccgggctgcaggaattcgtctcacccctagaaaaaaaaaacatatcgacaattcctcctccctcctcccatcgcttgcccctcgctcccctccctctccgcgccgccccctctcaaatcgaaatccctctccgccatgccgaagggcgccaagaagcgcgccaagatcaagaagcagcagcagcagggccaccccgacgatgccggcaacaccaacgccagcaacggcaactgtaacggcagagatgacaacaacagcgcctcgagcggccgcgacggcgaacaccaccagcggatcccacccaaagtttctcgtgtggatgcgaacgaggactccatggagagctctgaggagatggtcaccccccgagctgccgcgtcggagccggatgaggaggagactaaggccactgcggccgaggtgcccgtggagcgcaccgtcgacgccgacgtcgccgggtctggggaggtcatagtggacgccgtttccgacggaaaaccgttggacagggaaggtgagggccaaagtggaatgaaggcaaaggtgggaagtgcccccccgtgggtggccgcaagaaaccggaaggtaaagggatggcgttgggtggccccaaggaaaacccctgggctcccagaacccacgcgttctgg

SEQ ID NO: 67543 - protein, 171 aa, Zea mays
  misc_feature: Ceres CLONE 1542264
MPKGAKKRAKIKKQQQQGHPDDAGNTNASNGNCNGRDDNNSASSGRDGEHHQRIPPKVSRVDANEDSMESSEEMVTPRAAASEPDEEETKATAAEVPVERTVDADVAGSGEVIVDAVSDGKPLDREGEGQSGMKAKVGSAPPWVAARNRKVKGWRWVAPRKTPGLPEPTRS

SEQ ID NO: 67544 - DNA, 749 bp, Zea mays
  misc_feature: Ceres CLONE 1542268
tctgaactagtggatcccccgggctgcaggaattcgtctcacccctagaaaaaataagccaagtggaagtgaagcttagctgtatatacaccgtacgtcgtcgtcgtcgttccggatcgatctcggccggctagctagcagaacgtgtacgtagtagtatgtaatgcacggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactaccgtacccatatgatgcggacgtacgtgtgtaaaacaaacgaatcccccccccctgggtggctaacacagacggcctagcgcccctccgaggcacccaattcccgcctaaaacacactcgaaattagccccccgcccacggggcccgtcttattacaaccgtcggccacgggaaaaaacccgcgggcatcaccacggcgagcgggcccgttgggcgcaccagcccctttttatcccacctggatagcaaatgcgaaaaagctccccgacgttagccttccgtctcataaatgtggcgtcgcgccttggggggtgccaatgtgaacatttggactcggtgtctggtctgtcgtgtgacctgggcgggcaagtggttaggtctcccaacgagtcgctgttgtgttcggacgtcggtgggg

SEQ ID NO: 67545 - DNA, 770 bp, Zea mays
  misc_feature: Ceres CLONE 1542272
  misc_feature (770)..(770): n is a, c, t, g, unknown, or other
aaagctggagctccccgcggtggcggccgctctagaactagtggatcccccgggctgcaggaattcgtctcacccctagaaaaattcattcttatttagtattttcttgctgtcaggtgagatccgattgaactttgagagcccttgaagcagtgagcagccccggggagaagaaaggaacttgagagtatgccgtgccatcacaatggtccgagtgattatgctgttgccactgctccctcacatttaagaggtttcctcttatttagacggcgcatttaattaacattatcttgctaaagagagacttatgcgtagtctacttgtgtactcgttcgtttgtcctcatgttcttggctccaggaactctggttttttatcattgtacccgtagtaaaaccttagatgtaccccccccatgccgtatgcgtctatattcggttggtccaatgctaatcttggagcctatatgccacctgttggggttcattttaggcctttccttggtttcacgattaaaggaccaccgtaagcttactgcttggcgcaaaataaataaaaaaaccgagccgctcgggcggacccttttcccccctatagggaatccgtattacgctcgcactccttgggccggtcgttctttatcacggtccatacgcggcaaaacccctggtctctgacccccaattttgactaccttatgcataccctctccccgtttacggctgctggggggagctttacgcgaccatcgccccctatcctcctan

SEQ ID NO: 67546 - DNA, 744 bp, Zea mays
  misc_feature: Ceres CLONE 1542273
caaagctggagctccccgcggtggcggccgctctagaactagtggatcccccgggctgcaggaattcgtctcacccctagaaaaattttttcaattgtgttttctgttattggttcagcatgcacatatattgacatgatttatggaatggcatctaccatctttgcgtatatttatgacatcgttcttaattaatgtaagcaatatgaatgatggatctttttaacatcctaaccatcattgtgacgctcattaccctaattcggatatcatttatggctacaccgaaaacaaaaaaaaaatcgacacgctccagatacacagttaaccataattgaatacttattacgcgcgctcacaggacaacaattatctacggcgtgactagcaaaaatctgctttacccaactcaaatccgttgcagccatcaccctttccccagctggagtaataccgaagaggccgcaccgatagcactacctacagtatgacaggcttgaatggccaatggaaattgtcaaccctaatatttagttaaaattctcgttaaattttcggtaaataacctcatttttttaacctataaggcaaaaatcgcggaacctccccttctaactccaaaaaatagacccaagataagccttaaacgtttgttacagtcttgcaactaagagttcccctattaaaaaaacgatggacctccaacttcgaaagggcaaaaaaaccgtccatcagggccgatgg

SEQ ID NO: 67547 - DNA, 776 bp, Zea mays
  misc_feature: Ceres CLONE 1542280
  misc_feature: Encodes the peptide sequence at SEQ ID NO. 67548
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (69)..(69): n is a, c, t, g, unknown, or other
tttttgttttttnntcnnncctcccctaanttggtgggtgttaatttaannnnaaaannnnnnaaaannttggagctccacgcggtggcggccgctctagaactagtggatcccccgggctgcaggaattcgtctcacccctagaaaaaaaacaccgagcagcgagaaggggttggtgtccagcacgaattgaatcgtcgccagaagtcatggcggattcggccacttcccgtccaaccgttctcgtcaccggcgccggcggccgcacaggccaaattgtctacaacaaactgaaagagaggtctgagcagttcgtggcaagagggctagtcaggaccgaggagagcatgcacaagattggggcagccggtgatgcttactttgcctgcattcagaacgctggatcgacctagaacctgctttcccacccccccgaagggggggggggggggggccccacgtagttactcctaaaaatgcggacccggcggttgtgtaccattggctctcagggaggcacgtggcccggagcgccttactctaggaatgagcaccccaaggaacccaccgcaaccgcggcgcgacggagggatgttgatattttcaggaattgttggcgtgtagtagcagcccctcttacccccaaacgcacacagaaaaatataatgagaggtgcgaggtccgctcatcgcaccgtaggccgggcgcagagccgtccgccaccatcacttccccctgctaacccgagggcgcggagcaaaataccactctccccg

SEQ ID NO: 67548 - protein, 67 aa, Zea mays
  misc_feature: Ceres CLONE 1542280
MADSATSRPTVLVTGAGGRTGQIVYNKLKERSEQFVARGLVRTEESMHKIGAAGDAYFACIQNAGST

SEQ ID NO: 67549 - DNA, 834 bp, Zea mays
  misc_feature: Ceres CLONE 1542281
  misc_feature: Encodes the peptide sequence at SEQ ID NO. 67550
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
tttttttttctttttttccnaaaaaaannnntnnnntgggctaannnnaaccgctggagctccccgcggtggcggccgctctagactagtggatcccccgggctgcaggaattcgtctcacccctagaaaaagacacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaattactgttacaaccgccctccttgtggcgggggggggccggatgccgttgcccacctctgattcgtgtcctcctccccagcgcccgcctaaggtccgttgatgcgtcaccccacgatccacttctttccgcgttccccggcccatgggatcccttgggccctcctccacattccttcccgcttacacacatccctgtaaaacgttggtccgttcccccccccacatcggtgaaattttcttggtccactataatacccatcaacatcctccaaaacaaacccaactacacaggcttcagacaaaaataaaaaaaggctttaaatatcctaaaccccggccctatgttcccttcaataccaaaactgtgagggcgccccacccgtccacggtgcaccaacccctcccctccttctggccggacgcctcccaccacct

SEQ ID NO: 67550 - protein, 106 aa, Zea mays
  misc_feature: Ceres CLONE 1542281
MALQAAYEYLQQAVGHGAWSSTQTLTLLLIAVPTVLLLLASLAKSTSSSGKGKPPLPPSPPGTLPIVGHLHHIGPQTHISLQELVANYCYNRPPCGGGGPDAVAHL

SEQ ID NO: 67551 - DNA, 943 bp, Zea mays
  misc_feature: Ceres CLONE 1542282
  misc_feature (25)..(25): n is a, c, t, g, unknown, or other
  misc_feature (927)..(927): n is a, c, t, g, unknown, or other
  misc_feature (943)..(943): n is a, c, t, g, unknown, or other
ggggtatttgatagatctggaggcncccccccgactctcttcataactggagctccccgcggtggcggccgctctagaatagtggatcccccgggctgcaggaattcgtctcacccctagaaaaataaagaaaaataaaaaaaaaaaaaaagacttgatgcacaccgcatgcaaatcctgcaggctgttgcttctcagcagggccaaaagctgtgcctttggcctagcagtagctaccactagtaccaggagatcttcccgtcccaacatcttcaacagaagaatcaagctgtgggagctcgtgaggcacagggcgggcagagacaatgatggagaaggaacacatcaaaatggccatgctagaggcaagagcaaacaaaaaaaaatagataagggggacctgtggaataagctatgaaaaatccaacaaatccgtcctgtgttggggcgtccgagtaggtgtgcccccccccacaaaaaaaaaaaaatgcgggcgattagcggggaccccacattgagccccttatagtgaatccagcaatgaagggggcgcttccatatgggccagctcacattgtcaaaagagtatatcgacagtgcggaaataccccaccgcagcgaaacgccccgaatcacggcaggtcatatagtcttttacgggcatacccaccacttacaaccgcaaagcgctgccacgaaacacaggacttaagtgtagccgcgtggccacgtataccatcgtgcaacgtcatcattctcaacacacaccgccactgacagggaggtgcaaaacgagatagagcggtataacctgttcgagccaaaatgttggtgacagaaggcgcgccgcacagagaatcgagagccgttgcagcacagaccactaattatgggaacaatgcaagatagccagacacaaagatcagncataagataaagagan

SEQ ID NO: 67552 - DNA, 719 bp, Zea mays
  misc_feature: Ceres CLONE 1542295
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaacgtatgtatgtatgagacggattcaacagcgcattcggtttctttaaaaaagagcacgattcattgggaaacagtcgcggctgtaccaaacgtggtctattgctgggttcctagtagccaagctactaatagaaaagccagacgctgctaggattctgtggaacgatgaggatgctgaaatccttaatgcttcgagcacaaacagaaaacgtggcaagaaagtgttgaagaaaacatacatcgtgtgagttctcgcagcaagttcgattaaattcctcagttagcatttttaagttgtaatataggaagtgttgtccctgtatataaacttaaatgaggttgcatttttgctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccacagttgcgcagcctgaatggcgaatggaaattgtaagcgttaatattttgttaaaattcgcgttaaatttttgttaatcagct

SEQ ID NO: 67553 - DNA, 730 bp, Zea mays
  misc_feature: Ceres CLONE 1542305
  misc_feature: Encodes the peptide sequence at SEQ ID NO. 67554
catagctggagctccccgcggtggcggccgctctagaactagtggatcccccgggctgcaggaattcgtctcacccctagaaaaaaccggcgagccacatcgagaacacgatcgagcacacacaagcacgaagactcgtttaggagaaaccacaaaccaccaatcggtgcaagcatcatggagtacggtcagcaggggcagcgcggccacggcgccactggccatgtcgaccagtacggcaacccagtcggcggcgtcgagcacggcaccggcggcatgaggcacggcacgggaaccgccggcggcatgggccagctgggtgagcacggcggcgctggcatgggtggcgggcagttccagcctgccacggaggagcacaagaccggcggcatcctgcatcgctccggcacccccagctccagctcgtctgaggacgacggcatgggcggaaggaggaaaaaaaaaaaaaaaaacgagacgctcgaggtaccccattcgccctatagggagtcgtattacgcgcgctcactggcccgtcgttttacaacggcgttgactgggaaaacccttggcgttaccctactatattccccttgcgagccatccccctttccacagctgggcgtaattaacaaaaaaggcccccaccgatcccccttcccaaacatttgcgcagcctgaatgggcgaattgaaaattgtacatcgttaaaatttttgttaaaattccg

SEQ ID NO: 67554 - protein, 167 aa, Zea mays
  misc_feature: Ceres CLONE 1542305
  misc_feature (14)..(106): Pfam Name: Dehydrin Pfam Description: Dehydrin
MEYGQQGQRGHGATGHVDQYGNPVGGVEHGTGGMRHGTGTAGGMGQLGEHGGAGMGGGQFQPATEEHKTGGILHRSGTPSSSSSEDDGMGGRRKKKKKNETLEVPHSPYRESYYARSLARRFTTALTGKTLGVTLLYSPCEPSPFPQLGVINKKGPHRSPFPNICAA

SEQ ID NO: 67555 - DNA, 719 bp, Zea mays
  misc_feature: Ceres CLONE 1542311
  misc_feature: SWISSPROT Homolog: EC 3.2.1.23 Beta-galactosidase
acccgcggtggcggccgctctagaactagtggatcccccgggctgcaggaattcgtctcacccctagaaaaatttattctttcaagcatcgagattattaattctttgttacgtagatatatagagtagtatttcattatgtatatatatcaaccagatgatccagataggggaatctggtcagtcattggagttatttgaaattttcatccagctgtatgtatattgttgaattgtttctgattcaactggccatacatatcatcattaaaaaatcttcatcggctcaaaaaaaaaaaaaaaaacgagacgctcgaggtacccaattcgccctatagtgagtcgtattacgcgcgctcactggccgtcgttttacaacgtcgtgactgggaaaaccccccccctacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgccgttaattttttgttaaatcagctcatttttttaaccaattaggccgaaatcggcaaaatcccttttaaatcaaaagaataaaccgagaataggtgtgagtgttgtttccagtttgggaacaagagtccactatttaaagaacgtggacctcaacggtctaagggcgaa

SEQ ID NO: 67556 - DNA, 771 bp, Zea mays
  misc_feature: Ceres CLONE 1542316
  misc_feature (14)..(14): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
atttttattataanacactaaaaatccttttttccnncttanttttacatagctggaactccccgcggtggcggccgctctagaactagtggatcccccgggctgcaggaattcgtctcacccctagaaaaagcagaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtctatattgtaatttgaggataattatatgatgctctaagtttattgatattcctgtcactcgaatatgttagatgtcctaaaaaaaaaaaaaaaaacgagacgctcgaggtacccaattcgccctataatcgagtcgttattacgcgcgcttcactggccggtcgttataccacgtctatgactggaataaacccctggcgtttacccaacttaaaatgcccttgaaggcacaatcccccattttcgccaattcggcgttaattaccaaagaaggcccgccaccgaattggcctcttaccaaacaatttgccccag

SEQ ID NO: 67557 - DNA, 667 bp, Zea mays
  misc_feature: Ceres CLONE 1542335
  misc_feature: Encodes the peptide sequence at SEQ ID NO. 67558
atagctggagctccccgcggtggcggccgctctagaactagtggatcccccgggctgcaggaattcgtctcacccctagaaaaaaacgaactcactccctcgaccgtatcgccggctgctcctctatccctttcctgccactagtccactactatctaagctagcatggccatgatgatgctagcgcgcaacctgtgctctcgtctccgcccaccgctcgccgccgccgcggcgttctcgacggtccccgcggcgtcggcggccgcagcggaggcggagaggtcgatacgggacgggccgcggaacgactggagccggcccgagatccaggccgtctacgactccccgctcctcgacctcctcttccacggggctcaggtccatagaaatgtccataaattcagagaagtgcaccactgcacacttctttcaatcaagactggtgggtgcagcgaagattgttcttactgccctcagtcatcaagatacgacgctggattgaaggctcaaaaattgatgaacaaagatgctgtcttagaagcagcaaaaaaggcaaaagaggctggaagcacccgtttttgcatgggagctgcatggagagaaaccattggaaaggaaaaaaaacctcaaccagattcttgaatatgtcaaggaaaatacggggttg

SEQ ID NO: 67558 - protein, 158 aa, Zea mays
  misc_feature: Ceres CLONE 1542335
  misc_feature: SWISSPROT Homolog: EC 2.8.1.6 Biotin synthase
MAMMMLARNLCSRLRPPLAAAAAFSTVPAASAAAAEAERSIRDGPRNDWSRPEIQAVYDSPLLDLLFHGAQVHRNVHKFREVHHCTLLSIKTGGCSEDCSYCPQSSRYDAGLKAQKLMNKDAVLEAAKKAKEAGSTRFCMGAAWRETIGKEKKPQPDS

SEQ ID NO: 67559 - DNA, 755 bp, Zea mays
  misc_feature: Ceres CLONE 1542336
caaagctggagctccccgcggtggcggccgctctagaactagtggatcccccgggctgcaggaattcgtctcacccctagaaaaagctttcaaggatatgatcctggatggtgatggcaggactgtgtactgatctaaaatccagcaagcaactgatctaaaatccagcaagcaccgcctccctgctagtacaagggtgatatgttttatctgtgtgatgttctcctgtgttctatcttttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattaccccaaagaaaagtaaaaaaaaccataggtgcccgggggggacgccctgccgctcccggtcgcccgtgatcgctgcattctcggtgcgaaaagaaaggtatggtcgcggcacccccgggggtaccccatatcccccctaaaagggaaagccaatatgaccgccgcgcccgtgggccgtcacttattaacaccctctggcacaggggaagaaaccctgggggtaaccccaaatttaagaccgcttagagacacactccccctttcgcccgcggtggcgaaaaggacacaaaagaccgccgaccaaattacctcttcagaaaaaggtgagccgccctcgtcttggcgag

SEQ ID NO: 67560 - DNA, 717 bp, Zea mays
  misc_feature: Ceres CLONE 1542339
  misc_feature: Translation starting site: 223
  misc_feature: SWISSPROT Homolog: EC 3.2.1.23 Beta-galactosidase
caaagctggagctccccgcggtggcggccgctctagaactagtggatcccccgggctgcaggaattcgtctcacccctagaaaaatttttgattcaggctggcgaacgaaaccaaaaaaaaaaggggcatgggagtttgtggtgcatagatgctggcatggtgtaattgatttaaaagatcatgtatccgtagttctgtttgggttacttttgtcttagaacatgcatggaagcttgtgcaatatattaccaataagaaaaaaaaaaaaaacgagacgctcgaggtacccaattcgccctatagtgagtcctattacgcccgctcactgaacgacgttttacaacgtcctgactgggaaaaccctggcgttacccaacttaatcgccttgcagcaattccccctttcgccagctggcgtaatagagaagaggcccgcaccgatcgcccttcccaacagttgcgcatcctgaatggcgaatggaaattgtaagcgttaatattttgttaaaattcgcgttaaatttttgttacatcagctcatttttttaaccaatacgtcgaaatcggcaaaatcccttataaatcaaaagattagaccgagatagggttgagtgttgttccagtttggaacaagagcccactattaatgaccgtggactccaacgtcaaagggcgaaaaactgtctatcagggcgatggcccactacatgaaccat

SEQ ID NO: 67561 - DNA, 737 bp, Zea mays
  misc_feature: Ceres CLONE 1542353
  misc_feature: Translation starting site: 175
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaagtccatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccatcgtcgccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcggtttgcagcacatcccccttttcgccagctggcgtattagcgaaaaggcccgcaccga

SEQ ID NO: 67562 - DNA, 727 bp, Zea mays
  misc_feature: Ceres CLONE 1542355
  misc_feature: SWISSPROT Homolog: EC 3.2.1.23 Beta-galactosidase
caaaagctggagctccccgcggtggcggccgctctagaactagtggatcccccgggctgcaggaattcgtctcacccctagaaaaacttttgagttggagttgagctggatctgtgatgaattgaaccgtctgcatcagaaggttccaaatgaactgttggaccacgccaaagctgctgctcacgcagctcttgaggagatggatgctgactaagaaacaggacgattagcccagacttggtgtttttggtgctgctgaaatctccgatccctttggggtgacccactggacatggccaatttgacacaatttgatattttgacccatgtcatgtgcaactcctttcgttgaggtctggtatctagattgacttgtatcagagctgtggtttacgcatactggattctggactcactggactgtgtgtgtgtttttccgaactgtgcatcttacttttagctgtcagaaaaaaatacaaaccagacgctcgaggtccccaattcgccctatggcgagtcgtattacgcgcgctcactggccgtcgttttacatcgtcgtgactggaaaaaccctggcgttacccaatttaatcgccttgcagcacatccccctttcgccaactggcgtaataccgaataggcccgcaccgatcacccttcccaatagctgcccagcctgaatgggaaatggcaattgtaagcgtgtcttttctagtaaaattcacgt

SEQ ID NO: 67563 - DNA, 679 bp, Zea mays
  misc_feature: Ceres CLONE 1542359
  misc_feature: Encodes the peptide sequence at SEQ ID NO. 67564
  misc_feature (408)..(408): n is a, c, t, g, unknown, or other
  misc_feature (411)..(411): n is a, c, t, g, unknown, or other
acagctggagctccccgcggtggcggccgctctagaactagtggatcccccgggctgcaggaattcgtctcacccctagaaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctctggtctcggccaccccccaagggggggggggggggcccggccacacccaanccncctccatcggggggaggagaagggcggtggcccggttgggggagctcacgggcgtcccccggagggttaaccgggaggcgcggcggtctgcggaaaaaagcgggcacggagggggtcccgaagcacgtgcacctagggggggccaagtttgagctgcgctacccctaaggcaagggccaccgaccccggccaaatgatccatctcctcggccgattcaagtcccatcttagatggtgacctaggcagtagacttattcgggtgcaggg

SEQ ID NO: 67564 - protein, 116 aa, Zea mays
  misc_feature: Ceres CLONE 1542359
  misc_feature (66)..(66): Xaa is any aa, unknown, or other
  misc_feature (67)..(67): Xaa is any aa, unknown, or other
MGAVTSTVAARFAFFPPSPPSYGFEQPAPLPAPATPEPPAPATSKPPPLVSATPQGGGGGPGHTQXXSIGGRRRAVARLGELTGVPRRVNREARRSAEKSGHGGGPEARAPRGGQV

SEQ ID NO: 67565 - DNA, 780 bp, Zea mays
  misc_feature: Ceres CLONE 1542361
  misc_feature: Encodes the peptide sequence at SEQ ID NO. 67566
  misc_feature (9)..(9): n is a, c, t, g, unknown, or other
  misc_feature (13)..(13): n is a, c, t, g, unknown, or other
  misc_feature (780)..(780): n is a, c, t, g, unknown, or other
tggttttgntggntggggggggtgtgttttcttttaaccactatattaataaaaatggagctccccgcggtggcggccgctctaaaatagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgaaggacgacctgctgaagcaggtggactacctgctgcgcaacggctggataacctgcctcgagttcagcaaggtcggcttcgtgtaccgcgagaactccacctccccatgctactacgacggccgctactggaccatgtggaaactgcccatgttcggctgcaacgacgccacccatgcgtacaaggaagctgcaggaaggccatcaaatccctacccgggacgcctttccccccgcgggcatcgggctttcgaacaaacattccaagcaagaaccccagtggcggtcgacgcttttccatccgccttaacatatgccccccccggggccaagccgtaaattaaggaacccggcgactccccgcccccgggccccccn

SEQ ID NO: 67566 - protein, 181 aa, Zea mays
  misc_feature: Ceres CLONE 1542361
  misc_feature (58)..(162): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSKDDLLKQVDYLLRNGWITCLEFSKVGFVYRENSTSPCYYDGRYWTMWKLPMFGCNDATHAYKEAAGRPSNPYPGRLSPRGHRAFEQTFQARTPVAVDAFPSALTYAPPGAKP

SEQ ID NO: 67567 - DNA, 668 bp, Zea mays
  misc_feature: Ceres CLONE 1542362
  misc_feature: Encodes the peptide sequence at SEQ ID NO. 67568
  misc_feature (668)..(668): n is a, c, t, g, unknown, or other
ccccgcggtggcggccgctctataactagtggatcccccgggctgcaggaattcgtctcacccctagaaaaaaaaaatccatcccttcgcgcacgcaacgcaaaaacaagcacaaacacgcgcaatccgatctgggccggccaagcagccacccatccatggcgactagggtttggctcaccgccctcctgcttggtttcctcgtcgccgcctcccccttcaccagccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgacttcccaaaaaatgctggcaaaattgtactagcaggtgaagaaactgaattactagttggtctgcaaaatgacggtgaatcaattttgaatgttgttgctgttcattcaactctccatcttccttttgaccacaatatgtatggccagaaccttactgttcagaatttcttcaattcatcagttcctgtttctgtgcaagcaaccttcccctacaagttcgttgtgagcaagttcttgcagcctggagcatatgatctggttggttacatagtgtatgagatcgaccagcacactttn

SEQ ID NO: 67568 - protein, 169 aa, Zea mays
  misc_feature: Ceres CLONE 1542362
MATRVWLTALLLGFLVAASPFTSRVARAESEEDAAAAEVVEGADLGIVGDDTQVSSDGPLSPAPGVETVVDFPKNAGKIVLAGEETELLVGLQNDGESILNVVAVHSTLHLPFDHNMYGQNLTVQNFFNSSVPVSVQATFPYKFVVSKFLQPGAYDLVGYIVYEIDQHT

SEQ ID NO: 67569 - DNA, 757 bp, Zea mays
  misc_feature: Ceres CLONE 1542363
  misc_feature: Encodes the peptide sequence at SEQ ID NO. 67570
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (34)..(34): n is a, c, t, g, unknown, or other
  misc_feature (36)..(36): n is a, c, t, g, unknown, or other
  misc_feature (38)..(38): n is a, c, t, g, unknown, or other
tttttgccccccctcccctcgttcccnnngnctnananaatgattttttttaatatagagctctccacagaggcggccgctctttactagtggatcccccgggctgcaggaattcgtctcacccctagaaaaacaatgtatggtgcttgacaacgaagctctgtatgacatatgctttcgcacgctaaagctcgccgccccctacctttggcgacctgaaccatcttatctctgccaccatgagtggcgtgacatgctgcctgaggttccctggtcagctcaactctgacctgcgcaagcttgccgtgaacctgatcccgttccctcgcctccacttcttcatggtcgggttcgccccgctgacctcccgcgggtcgcagcagtaccgcgccctcacggtccccgagctgacccagcagatgtgcgacaccaagaacatgatgtgcgctgctggatctccccccctgatcggtatctgaacagccacgaccatgatctccgggaaaaagatcacctaggaggtggaccatctgatggtttatagtcaataacaagaactcgtccattttcggtggaagggatccacataatctttcaatgtctatcattgagccttcattccctccccaagggtcatagagtaatgatgtgaaaccttttccttgggtgtaacaccccccttccctaccaaagagtagtgttatccccatgcgttgaaacctaaaccattctgccactcgtcctatggttcctgagg

SEQ ID NO: 67570 - protein, 79 aa, Zea mays
  misc_feature: Ceres CLONE 1542363
MSGVTCCLRFPGQLNSDLRKLAVNLIPFPRLHFFMVGFAPLTSRGSQQYRALTVPELTQQMCDTKNMMCAAGSPPLIGI

SEQ ID NO: 67571 - DNA, 662 bp, Zea mays
  misc_feature: Ceres CLONE 1542366
  misc_feature: Encodes the peptide sequence at SEQ ID NO. 67572
  misc_feature (380)..(380): n is a, c, t, g, unknown, or other
  misc_feature (405)..(405): n is a, c, t, g, unknown, or other
tccccgcggtggcggccgctctagaactagtggatcccccgggctgcaggaattcgtctcacccctagaaaaaactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccgggtgagggcgccaagcncgggttttctgacgaggcgccgacnccatcgcccggtgcagcttccgggaagggaaagaaggtagcggaagaggaggacgacaagaaggttgcagcgacgccccagccggtcgcaaaagctcaggtggtgggaaggccaccaatccaaagctaccgcaagaacacgaagtctaccacccagcttaaaggcaacaaggagggatgcttaagccaagcaagaacaaggggtccttgtacgtcaagggtcagcatggaatgaggcccccctaccctcaggaaaaa

SEQ ID NO: 67572 - protein, 147 aa, Zea mays
  misc_feature: Ceres CLONE 1542366
  misc_feature (24)..(141): Pfam Name: AUX_IAA Pfam Description: AUX/IAA family
  misc_feature (62)..(62): Xaa is any aa, unknown, or other
MSPPLDLDYIGLSPAAAAAAAHDDLKGTELRLGLPGSGSPDRRVVAATATTLDLLPGEGAKXGFSDEAPTPSPGAASGKGKKVAEEEDDKKVAATPQPVAKAQVVGRPPIQSYRKNTKSTTQLKGNKEGCLSQARTRGPCTSRVSME

SEQ ID NO: 67573 - DNA, 679 bp, Zea mays
  misc_feature: Ceres CLONE 1542368
  misc_feature: Encodes the peptide sequence at SEQ ID NO. 67574
  misc_feature (679)..(679): n is a, c, t, g, unknown, or other
atagctggagctccccgcggtggcggccgctctagaactagtggatcccccgggctgcaggaattcgtctcacccctagaaaaaattaaagaatacgccaggctccttgtcgctcgtaaaatggaggtcgcgacggcgacggaggcgtctgcgccggcggcaagcggcggcgcggcggggcagagccacccgttcccctggctagacgctgccatctctgagccctactacttcctgcacctcctcgccttcttctcttactttgcggcccgcagcgcggcgctctccgccgacgacggaggggagctccacgaccgcctcctccgtagggagatccaggcagtgctcgtgttcctggtgctcttcctagtgaagattgtgaaagaggaaacctgggaagcagtaattgcccactcgttgctttatgcgaagggtttattgctggcagttactttggttattgattgttggctggcctttgcctactttctgggatttcttgttatatatgctgtagctcaacagcccctttttgatggcctaggccattcaaatctttttgaccccttttgcaacttggaaaggctgcttaactgattaagccttcctctcgaatttttgggtggcgagaattccgaaaccttcttttttcagccttattggctgtcctaggcacgcn

SEQ ID NO: 67574 - protein, 158 aa, Zea mays
  misc_feature: Ceres CLONE 1542368
MEVATATEASAPAASGGAAGQSHPFPWLDAAISEPYYFLHLLAFFSYFAARSAALSADDGGELHDRLLRREIQAVLVFLVLFLVKIVKEETWEAVIAHSLLYAKGLLLAVTLVIDCWLAFAYFLGFLVIYAVAQQPLFDGLGHSNLFDPFCNLERLLN

SEQ ID NO: 67575 - DNA, 633 bp, Zea mays
  misc_feature: Ceres CLONE 1542369
  misc_feature: Encodes the peptide sequence at SEQ ID NO. 67576
ggagctccccgcggtggcggccgctctagaactagtggatcccccgggctgcaggaattcgtctcacccctagaaaaagtgaaatcgcgctccgatttgtgcttctgcgacttctatcggccagtccgaaaaatccaaggacattgccgggcggaaccctccctccacccacatcatggcggcgactactgtggcaagccggaagcgagggacagcggccttccttgatgaccccttctccttccccggagacctgccgtgcctgcagacgaagcgcggccggtgctcgtcttcgattgttgccgccgacctcggcctgagcttcccgctggagttcgacccggtcgaggcactccatctcatcttcccgggcgaggatcggcaggttctacaaaacgatttacaagcgtcaggaaatgtcctgcatgctgcgatcagagcatacaaagattatttggcagaaagaagcaaacaatctgcttctgccatcaactatgttccatccgacaacgatgaaggagatagcattctatctgaatctgaatctgatgtttacctaatagaagaaaccattcccaccaattgctctggatgggctgaggtcatcgtcaaggagatgtcctctgcttctga

SEQ ID NO: 67576 - protein, 152 aa, Zea mays
  misc_feature: Ceres CLONE 1542369
MAATTVASRKRGTAAFLDDPFSFPGDLPCLQTKRGRCSSSIVAADLGLSFPLEFDPVEALHLIFPGEDRQVLQNDLQASGNVLHAAIRAYKDYLAERSKQSASAINYVPSDNDEGDSILSESESDVYLIEETIPTNCSGWAEVIVKEMSSAS

SEQ ID NO: 67577 - DNA, 701 bp, Zea mays
  misc_feature: Ceres CLONE 1542370
  misc_feature: Translation starting site: 144
aagctggagctccccgcggtggcggccgctctagaactagtggatcccccgggctgcaggaattcgtctcacccctagaaaaatacgtgcttgatctccctccgccactccatccatctcctcgctcccagtccccgggaagcatggcgtcagtcaacatccgctccccggtagcaggacttcacccggcgacaaaaacgctcaggtcggcggatgacttccttggccactcgagccgcctcggccgcaccgcgtatcccacgatgcgcaacctcaaggcggaggccaagggcgagtggatcccctgtctttcctccccctcctacctctacggcagccatgtcgggtgacaatggcttcgaaccgatgggcctgccggaagagcccgataacctgccgtggttcgtgaagaaaggaactggtgaactgacagtgggccatgcttggggtgcccgggatgctcatcttggaggtgctgaccaaaacagggctgatcaacacgcccttctcggtacgactcctggaagtcggagaacttcctcgaccccagcccacgctagctcgaggtccgagttcactcttgttcaaactaatttcaaattatacagcctagtggctgggaaatcaaaggaaccaccgggcaggcttgcaaaaaaggaaccctctttctttcatacatcctataaggtcctggcctgtgc

SEQ ID NO: 67578 - DNA, 822 bp, Zea mays
  misc_feature: Ceres CLONE 1542373
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (822)..(822): n is a, c, t, g, unknown, or other
ttgggtccccccccccccccccgcttattntnntttttttttttctttcaaaactggagctccccgcggtggcggccgctctagaactagtggatcccccgggctgcaggaattcgtctcacccctagaaaaaaactcgccgtctgccttctgcgcctccatttcggcctctgtcccttgcaagttcaatctcacctccaaccatgggtaaagagaagtcccacatcaacattgtggttattggccatgtcgactctggctagtcgaccaccacaggacaccttatctacaagcttggaggcattgacaagcgtgtgatcgagaggttctagaaggaggctgctgaaatgaacaagcggtccttcaagtacgcgtgggtgctcgacaagctcaaggctgatcgtgagagaggtattcaccattgatatcgctctgtggaagtttgagaccaccaactacctaactgcacggtcatttggatgcccctgttacaccgtgaacttcattcaagaaacaagtatcactggatacccctcccaatgctgacctgtgcctagtccctaataatttgaacttcctccacctagttggttttatgaaggatcggataccctcccaccgaatgggttctgtaacctttggattcattgacctcctcccttcgccggtttatcaccttttgtaaaccgacacccattacataatttctgcttaccttctctaacataagaagggatatgacatacacacctttatctcaacattaactgctcaaaagggcacaccattatcttttcaacaacaaaatactgaccgccaacn

SEQ ID NO: 67579 - DNA, 622 bp, Zea mays
  misc_feature: Ceres CLONE 1542374
  misc_feature: Encodes the peptide sequence at SEQ ID NO. 67580
tgtggatcccccgggctgcaggaattcgtctcacccctagaaaaagtttttgaggcgcccgtccaagcatcccatccattctctctcgctgctctgctccccacggaccacggggcaccaccacaaaccagacgcgacgcacgcgcgcaaaatcatccggcggagccagggcggaggcaaaccagagacgcggcacgcgacgcgtgagggcgaggagcagcggcagcgcgggcgcggcgacaccgcgaggccagagcgagacgcaacggccgaggaggggcacaggcggccgcctccgcctagagtccctgctaccatggacactttcttcctgtcgcacggctcgcccacgctctccatcgacgacaacatccccgcgcggcacttcttcaagtcgtgggtgccggcgaaggtcgcgggcgaccagcccccgcgcgccatcctcgtcgtgtcgggacacgaagacacggccacgccggaggtcaacgtcatccgcggcagcaacgacaccatttacgacttctatgggctttccccagccccatgtacagctccaggtaccccggctccggtgcgccccggaacctgggccctgcctgaaccaaggggctcccgggaagca

SEQ ID NO: 67580 - protein, 102 aa, Zea mays
  misc_feature: Ceres CLONE 1542374
MDTFFLSHGSPTLSIDDNIPARHFFKSWVPAKVAGDQPPRAILVVSGHEDTATPEVNVIRGSNDTIYDFYGLSPAPCTAPGTPAPVRPGTWALPEPRGSREA

SEQ ID NO: 67581 - DNA, 669 bp, Zea mays
  misc_feature: Ceres CLONE 1542376
  misc_feature: Encodes the peptide sequence at SEQ ID NO. 67582
atagctggagctccccgcggtggcggccgctctagaactagtggatcccccgggctgcaggaattcgtctcacccctagaaaaaacccgagttttggttacccattgtcatggatgttcatgggcacacggccaccacaccgcggcgcgtggccagcgcagcgaatccatccccatcctcatgattataaataaataataattttacacgccctcttctctctcgatttctcgcggagcggccctccacctttatcgccgccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggagttatcctcagtgtggtaatgtcaacttcagttttagaaatgtttgcaaccgtggagcctgtggtgcaccccgtccatcaccgagtccaagtccaagaatgatgccaggacctcctgcttctggatatgaccggtcacctctattttacggaggaggtggtggcgccccacctccaattccgcttggaactggtagctatggtgctccatatccacaccttgggatgcaatatggttatggtccaccagtaggacctccctggttcatatggtctt

SEQ ID NO: 67582 - protein, 125 aa, Zea mays
  misc_feature: Ceres CLONE 1542376
  misc_feature (29)..(60): Pfam Name: zf-RanBP Pfam Description: Zn-finger in Ran binding protein and others
MASAKFGAAQQVENRGALSKRSRNDVSVREGDWSYPQCGNVNFSFRNVCNRGACGAPRPSPSPSPRMMPGPPASGYDRSPLFYGGGGGAPPPIPLGTGSYGAPYPHLGMQYGYGPPVGPPWFIWS

SEQ ID NO: 67583 - DNA, 542 bp, Zea mays
  misc_feature: Ceres CLONE 1542378
  misc_feature (218)..(218): n is a, c, t, g, unknown, or other
  misc_feature (226)..(226): n is a, c, t, g, unknown, or other
  misc_feature (251)..(251): n is a, c, t, g, unknown, or other
aaagctggagctccccgcggtggcggccgctctagaactagtggatcccccgggctgcaggaattcgtctcacccctagaaaaaacccccgcacccaccgtgggccgtggcccgagtcgccgtggccgccgcggcaggccgacagcgccctcccggtggtgagcgcagcccggcgcgcgcgccgcggccaccgccgcgctcgaaccgcccagatctangggcctangcggccccccctcctcatggcgcgncgactgcccgtgtgacgcgctgctcctcccttctcctcaccggcgtggtaccgcatcgctgcatccccgcccacgatgattgcccggtgctactatcgtggaatccgtcttggactcgaaaacctgcttcaacctgatcttggaaacccggccgggttctgtgagggggataaattcccctttccaacgggcgttaatcttttttcttgcgaaaaagggagaaaaaattgggggggacctttttcaaaggccccgggggggcccccttttccaccaaaaaaaggcaaaaaa

SEQ ID NO: 67584 - DNA, 649 bp, Zea mays
  misc_feature: Ceres CLONE 1542379
  misc_feature: Translation starting site: 134
  misc_feature (363)..(363): n is a, c, t, g, unknown, or other
  misc_feature (649)..(649): n is a, c, t, g, unknown, or other
agtggatcccccgggctgcaggaattcgtctcacccctagaaaaatcctcctgttctttgtttcccgtcccatcgtgtgtgagcgcgtctgctggtctgccaagaggacgaaaggaaggaggagcaagtagagatggcttgcactgcgcagtccatgctctccgccagcgactgcatcttcctgaggagcaagcctcaggcagcatcccaagtgcgagggggcatcatcggcggtggccgcagcagcaggccgttcctgctcacctgcaacgcttcctcttctccgtccccttcctcgccggcgccggcgcaggaagaccccgactgccaccaccatgagtgcgcgcgcggagaatgatgtcnggagcctgatcgccgagtggctggccgaggagaggacccaggtcgccggcactttccctcccaaaaaaaaagggtggaccggcttattggagaaggacaccgcccgccagaccaaaatctactccgtccagcccatggggtacgtggccgatagtgccatccactccgggcacgcggggtaccttcggcggaagggcgcccaaaaaacgggccgccctcgcccgcggggctcgtcccctacccccgattcccccgagccccgatccatcttcatccaggttaaaan

SEQ ID NO: 67585 - DNA, 620 bp, Zea mays
  misc_feature: Ceres CLONE 1542380
  misc_feature: Encodes the peptide sequence at SEQ ID NO. 67586
ggatcccccgggctgcaggaattcgtctcacccctagaaaaagcacgccgctccacgttgaccgttgcgagtttaaagcatccccttcctctcgagactccttcctctcacttctcatcgccgggatccagatcgttcttcctcttgcccgccgattcgttccaccaccgcgaaagccacacagagagcaggagagacaatccagagagatcggcgccatgaacgacctcatgactaggtccttcatgagctacgtcgacctgaagaaggcggcgatgaaggacctggaggcggggggcgacgggatcgagctcccggagtcgggcgccggcggcgtcacggacgagcgcctgcgcggattctttcaggaggccgaggcggtgaaggcggagatggcggccatccgcgacgcgctcgaccgcctgcacgccgccaacgaggagggcaagtcgctgcaccaggtcgacgccctccgcgcgcaccgcagccgcgtgaacgccgacatcatcgccgtgctccgccgcgcccgcgacatccgcgccaggctggagtccctggaccgcgccaacgccgcgcagcggaggctctccgcggggtgccgcgagggcacgccgctggac

SEQ ID NO: 67586 - protein, 134 aa, Zea mays
  misc_feature: Ceres CLONE 1542380
MNDLMTRSFMSYVDLKKAAMKDLEAGGDGIELPESGAGGVTDERLRGFFQEAEAVKAEMAAIRDALDRLHAANEEGKSLHQVDALRAHRSRVNADIIAVLRRARDIRARLESLDRANAAQRRLSAGCREGTPLD

SEQ ID NO: 67587 - DNA, 728 bp, Zea mays
  misc_feature: Ceres CLONE 1542391
  misc_feature: Encodes the peptide sequence at SEQ ID NO. 67588
aaagctggagctccccgcggtggcggccgctctagaactagtggatcccccgggctgcaggaattcgtctcacccctagaaaaaaagaagtttgtacacatttcaaaactactgaggatgtacttatccaacaccctgaaaagaatggtttctctccattctattaccgagcaagatgtatactctgcagtcccaaatacgatccatagcattccagaattcatattacgcagatgcaaagccaaaaaaaaaaaaaaaaacgagaccctcgaggtacccaattctccctatagtgagtcgaattacgcgcgctcactggccgtcgttttacaacaccgtgactggaaaaaccctggcgttgcccaatttaatcgccttgcagcacatccccctttcgccagctggcgtaatatcaaaaaggcccgcaccgatcgcccttcccaacagttgcacaccctgaatggcaaatgaaaattgcaagcgttaatattttgttaaaatccgctttaaatttttgttaaatctgctcatttttttacacaataggccaaaatcgacaacactccttataagtcaaaagaatacaccgagatacgtgtgagtgttgttccattttgaaacaagagtccactattaaagtacgtgaactccaacgtcgaagggcgaaaaatcgtctatcacggcgatgcccggctacgtgtaccatcaccgtaatcgagttatttggg

SEQ ID NO: 67588 - protein, 108 aa, Zea mays
  misc_feature: Ceres CLONE 1542391
  misc_feature: SWISSPROT Homolog: EC 3.2.1.23 Beta-galactosidase
MVSLHSITEQDVYSAVPNTIHSIPEFILRRCKAKKKKKNETLEVPNSPYSESNYARSLAVVLQHRDWKNPGVAQFNRLAAHPPFASWRNIKKARTDRPSQQLHTLNGK

SEQ ID NO: 67589 - DNA, 776 bp, Zea mays
  misc_feature: Ceres CLONE 1542392
  misc_feature (365)..(365): n is a, c, t, g, unknown, or other
  misc_feature (368)..(368): n is a, c, t, g, unknown, or other
  misc_feature (776)..(776): n is a, c, t, g, unknown, or other
tctgaactagtggatcccccgggctgcaggaattcgtctcacccctagaaaaaaaggagctatcgtttcttgtggacaggagaggagcttgccaacactgtaggttttttttttgctactgtataatgtatgatgcaccctgtcatgtgtacaaagaaagctcaactgttgtaggctgtttgtgttgtgtggcattctactagtcttcacattaaccatatttgttagggttgcttgctcctgcccatgcctgaaagatatattgttggttttaggtcctgataaaataattggcgatttgtaacttaagattattctaggtagttttataccccccacctgggggggggggggggggaataatntcnctcccccccctcccacctctccgaattcgccttaaagtggagccggtattaggcggcgggtctctggcccatccctttaaacaacgtcgttaactgggaaaaacccccgggggtgtcacccaaccttaaatctcctcggtcagccccttccccccctttttccccagattggcctaaataatccatagaggcccccgccccccacaggctccttcccaaagctgttcgcctgctcctaattggcccctcagtacatcttctaaccgcttcatcgattgtgtgtgcatgtttcgcatgcaatttagcttcgtaaaaccctgcctcatcctctaagcgcaatcgcgcgctacatgcgcacagctctcccgatctctggacctaaacctcttgtttatgtccgcgcgtgcn

SEQ ID NO: 67590 - DNA, 729 bp, Zea mays
  misc_feature: Ceres CLONE 1542394
ctccccgcggtggcggccgctctataactagtggatcccccgggctgcaggaattcgtctcacccctagaaaaatttggggttctgttataatatgtagagcatgaataaagatggatgctggtgactctgtcgccatcgccgtccatcatgagtgtcctgtaattcaacttatatctatcatgtatgtatgtatgtatgtatgtatgtatatgctggctactatgcttctttgttttaataccattttaatcgctgacattaactcaagtttaggccagccgctcgaggtacccaattcgccctatagggagcctcattacgcacgacacatggccatccttttacaccgtccctactggtaaaaccctgtcgctacacaacttaatctccttgaagaacatccccctttcgaccagatggcgtaataactaacaggcccgcaccgatcacccttccacaacagttgctcagcctgaatggcaaatggaaattgaaccccttcatatattgtcaaaatccgcataaactttctactaaatcagctcattttttaaaccactaagccaaactccgccaaatcccttataaatcaaaagaataaaccgacactgggttgactgttttcccactttgaaacatcagtccactattacagaacgtgcactccttcatcaaagggcgacaaaccaactatcagggggaacggccccttacctgaaccatcacc

SEQ ID NO: 67591 - DNA, 822 bp, Zea mays
  misc_feature: Ceres CLONE 1542402
  misc_feature (400)..(400): n is a, c, t, g, unknown, or other
acactggagctccccgcggtggcggccgctctagaactagtggatcccccgggctgcaggaattcgtctcacccctagaaaaaacgtacctccggcgccccctccgagatcggtcctccggtctgcgcagggtatctaactctagataccagcgtgtctccgccaggcaggcaggggagatcccaggctcccagccaaaggtcggctgcagccagccaaccagccagctaaagcggtcaaaatatgcttatgtactatcgagcaacaagaaaaaactagacctttccgcgacgcctcggggccctcaattcggcctatatttttttcgaattacccgccggtcaatggcccgccgtttttttttcccccccccccggggggggcgagggggggagcccantttaatcaccttctcccccaccccccccctgtccaaaaaaaagaaagaatatccgagagagggccgcgcgcggctcaccccctttcccagagttatctgccaccccttgaatgctcaacacggaccttccaacccgttttacaattcctgcccaaactccgctctgtcaaacgcccagccgagtatcgcctcgagaactgtcccacacagacggcctagacccccgctacaatgccacactacattcgtcgtagggcaccgcgttcctgccggcgctccgacatgacgccaccccattaccgtcaaaccgtgaccgctcgagatcgggcatctggacctacttccttataaacacatctgacacagacctccccacttcccccaacgacgtcaatctctccacaccgccccgtgctcttctc

SEQ ID NO: 67592 - DNA, 733 bp, Zea mays
  misc_feature: Ceres CLONE 1542410
  misc_feature: Encodes the peptide sequence at SEQ ID NO. 67593
aagctggagctccccgcggtggcggccgctctagaactagtggatcccccgggctgcaggaattcgtctcacccctagaaaaagtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccggctaggctcagggcgcgactagcatgggagtagtgcgatacttttgagagcaagggatagcgaggatcttggtctttggaatagtattgttaatgacattttttttccggttgtgtttctggagtaaatcgttgaacgacaaggcttcaagatgtctggatgtggattctgagtagaccttgaatccttgatgaatcagccagtcttggaaagaaagttccattttgttgttccaaacaaatccaaataattgaacaaaaagaaacgagacgctcgaagtacccaattccccctatagtgaatcttattacgcgcgctcactggccctccttttacaacgtcgcgactgggaaaaccctggcgttacccaccttaatcgccttgcacacattccccttttctccagcttgggttaatagcgaagaaggcccgccacgaa

SEQ ID NO: 67593 - protein, 69 aa, Zea mays; identical to SEQ ID NO: 55155
  misc_feature: Ceres CLONE 1542410
  misc_feature (10)..(66): Pfam Name: SecE Pfam Description: SecE/Sec61-gamma subunits of protein translocation complex

SEQ ID NO: 67594 - DNA, 1012 bp, Zea mays
  misc_feature: Ceres CLONE 1542414
  misc_feature (1)..(1): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
naaataagtgaccaatatttgcccgcctcncgagaaannnncaatactggaactccccgcggtggcggccgctctataactagtggatcccccgggctgcaggaattcgtctcacccctagaaaaactgcaaatcgcttcagggtgcaagagtgtcataaatctttatggccaacatctttcttgtatcatggaatcgtgtgtcatgtatcttccctgcaaataataactaactatatgaggagagcagcagggaaaaaatttcctttctctctgatatcattaaaaaaaaaataaaaaaatacaaaaatattaaaaactaaataaaagaaagaaaatgctcacaatatacttatatacaaaaatcgcgcgccctcgcagttctatataatccccctctacacaatgaaacaaattatcgaataaattacacttcccaccccttctatttatccatctcaattgatcattccggaaaattactactcccctgtgcctctatctatctattattatctactaacattcataataatcacatcaatatactctattactaccctgtatcgtagtgaactaactcatcatattattaatcacacttatactttttctcccattcagtctctagtcaccaccagttctgatctatgtcccgtcagctattcactccacttccgtcttctcaatcttctctggacataatgatatatcatcactatcaaatatactcatttgacaaacaatacattctctcactctctcgtctcactcctataatccaatgcgtgtatttaatctcaatagatctcattcacgccacaactactcaactcattcaccttaacgtacatcatttatatttctcttaatcttacatctgacctattcatcactaacttcagatcacattttatgctatcaatatattatactattaataattaattctaatcaatatagaattatattattcacgtcaatattccaatatgtaatatgtactcaactca

SEQ ID NO: 67595 - DNA, 764 bp, Zea mays
  misc_feature: Ceres CLONE 1542415
  misc_feature: SWISSPROT Homolog: EC 3.2.1.23 Beta-galactosidase
  misc_feature (351)..(351): n is a, c, t, g, unknown, or other
  misc_feature (352)..(352): n is a, c, t, g, unknown, or other
  misc_feature (764)..(764): n is a, c, t, g, unknown, or other
ggagctccccgcggtggcggccgctctataactagtggatcccccgggctgcaggaattcgtctcacccctagaaaaatggagttgagctttatgcatggttctgcgtaggcgagattgttggcagaggtttcaccttaaccggctataaggtctagttgatttccagtgatttaagacctgctttataaatcgacactttagctgatgcttgtcgaaacgacgatgatacctgccttccttcacaattttgtttcttgtaagagtctacctagtgctgaatccagcaaagacgggcacatggttgcaacattgcctcaataatttgcccgcgcaattcttgattttaaanntttctgatgatagcggaaaaataaaaaaaataaaaaaaaaaaaaaaaacgagacgctcgaggtacccaattcgccctatagtgagtcgtattacgcgcgctcactggccgtcgttttacaacgtcttgactgggaaaaccctggctttacccaatttattcgcctttgaacaaatccccctttccccagctggcgtaataacgaaagaggcccgcaccgatcgccctttcccaaaatttgcccaccctgaatggcaaatggaaaatttgtaaccgtttaaaatttttggaaaaaattccgcggttaaaattttggttaaaaacaactccctcttttttaaacacaataagggccggaaaaccgcgtaaaatctccccttatacatatcaaaacaaaataaaccccgtaatan

SEQ ID NO: 67596 - DNA, 748 bp, Zea mays
  misc_feature: Ceres CLONE 1542416
  misc_feature: Encodes the peptide sequence at SEQ ID NO. 67597
acagctggagctccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcatcagcgcggcgcggaccaggggggaccggccggcggcgtgcctctgcctcaacaccctcgccaacagcgtccagagcctcaacatgggcaccgtcgccaccatccccggcaagtgcgggggcctccgtcggattccccccatcagcatgtcccccgactgccactaggatccggctaagtttcgacgacccaggctagtagccctaccgaaacgtacaccaaacgtcccgcgcgccggctcgagtgatgaaacccaggggtggaaataaaatagagccctctttctttgccgggtaccgccaggccttattttaaccgctcctctatgtctagctgtacctggagtacttcgtttcacattaggcaagtaatgcggtcgggctcccgtgcgcg

SEQ ID NO: 67597 - protein, 121 aa, Zea mays
  misc_feature: Ceres CLONE 1542416
  misc_feature (34)..(120): Pfam Name: Tryp_alpha_amyl Pfam Description: Protease inhibitor/seed storage/LTP family
MAAVLNSRKTAQAVVAVLVAAALLASSTSAAITCGQVGSSLAPCIPYATGRASALPASCCSGVKSLISAARTRGDRPAACLCLNTLANSVQSLNMGTVATIPGKCGGLRRIPPISMSPDCH

SEQ ID NO: 67598 - DNA, 887 bp, Zea mays
  misc_feature: Ceres CLONE 1542418
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
tgtgtaggtagacttttattttctacagccgacactttnnnnnnacaatactggagctccccgcggtggcggccgctctagaactagtggatcccccgggctgcaggaattcgtctcacccctagaaaaaaaggaacacaaagctaaaggtgaagaagtatacatcagagaaggtattgaggcagcattagtgtatggttttccacttagtttaagtctttttagctcttatagaaaggactatctgtgtctgtatgatgaggaagtttcacttaggtgtttttttctgatgccaaggaccactgcatgataatgagataggtatatgtgctatggttggtacagtcccttgtaaatgctttctttagtgcacctttgtttttttgaaactttattttccgaggaaaccaaaatcttatattgcagtattatgtagtcttgcctgttattcagtattggggcccccccaaaaaaaaccgaagacgcctcgaaaataacctcaatttctccactataggtgagtaccaaattaccccgacgcttcactgtggccgttcggtttgatcaacgcgtcattccgacggaggaaaaaaaccccttgggtagatatcccccagacttttaattcgccctcttggcagccacatatctccccacttttctgcccaaggatgggctgttatttagccctaaaaaggggccccggcgaccagaatctgtccctttccccacacaatttgtaccctggccctgaaagtggccttaatggtaaaatttggataggccgttaataatttctcttgaaaaaatgcggcctgtaaatttttgtggtggaaagtacagtccacttttttattgaccctgggagttgccaaatctatggtaga

SEQ ID NO: 67599 - DNA, 679 bp, Zea mays
  misc_feature: Ceres CLONE 1542428
  misc_feature (255)..(255): n is a, c, t, g, unknown, or other
aagctggagctccccgcggtggcggccgctctagaactagtggatcccccgggctgcaggaattcgtctcacccctagaaaaacgtctttggagcgcgcaagagatctcagttctatttgaactgccggcttatataggctctagatgcataagtttagttatatgacctctgagcttattctaaagctatgaaagttctgtttcacggattacagattacagtgcgatatctgtgatgacatgtattctcactnttttctatgttttgagtaagcaacgtgtacattgcaaaaaccctgtatttgggtgtagtttgcatcatttgaatttgtgaaaacggaaaaactgaaaaattttttggggacaaaaaaaaaaaaaaaaccaaaacgtctcggggaccccaattcccccctaaagtgagaccaaatataccccgctttcctggctctctctttttacaccccctgaaatgggaaaaaccctggcgtttccccaaatttaatccccctgtaaaaaacattcccctttttgcccaggggggggaatataaaaaaaaaggcccccaccccaatatccccctttcacaaaatatttcccacccccctaaagggggaaagagaaaattttttaacggtttcaatatattttggttgaaaaaaaaccgcctaaattattttg

SEQ ID NO: 67600 - DNA, 903 bp, Zea mays
  misc_feature: Ceres CLONE 1542434
cgggggtagggcgagtatggtctcttgaccccttgtgcaactcataaaaaagcacctccccgcggtggcggccgctctagaactagtggatcccccgggctgcaggaattcgtctcacccctagaaaaaatatgcagcctttaatccactggctgataagactcaagcaatcaagatgtgcaatagagtatgccaatgggtgagggatttagaaaatgagatattcgtgtatggagaaagcaccctttcctggtgatatgttgtcctgtgtgtaataacttgctatgcctatgttacattttctttgttgaaagttttttttgatgttactttgtaccgaccaccgaattacctttgctattcggggaggtgtatgagggtggcttagatttgtcacacgggttggacaatatattccggaatcggtgctccttgttatttataacgtcctaatgaacccggatagtcctcccccccccgtttgtctatgacaataaaaaaggaatcccatagcccctccagagtgcatgccaatttccggcccctaattgtcgcagtaccacacaactgcagacgtcgcactttgactccgcacctatacctacaacacgtcccgtgtacgcggagactaacacctcttgccgagctgtatcacacacgtctaatgactcgttatgctgtacatgtccaggccaatgctcgccctagacgtgcgtgtatatatcgcggtagacgtgcccgaagtcctattgtgcagtttttccttgatgagttaggtgatggcacgagtaatggttgtattgaggaacttgcggatgcggggtcactaatttaagtagcgtaagaccaactctactaatttacactaagtatctcacactctctcagcttctcatagcagcg

SEQ ID NO: 67601 - DNA, 782 bp, Zea mays
  misc_feature: Ceres CLONE 1542440
  misc_feature: Encodes the peptide sequence at SEQ ID NO. 67602
  misc_feature (16)..(16): n is a, c, t, g, unknown, or other
ggggggggggaatgtngtttggtggggattacccttgtgttttggtaaaaactggagctccccgcggtggcggccgctctagaactagtggatcccccgggctgcaggaattcgtctcacccctagaaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgaggcgggaattcggttcagtggtgctattcctcattctttgtgtatcatatatggtctgcgacatttatatataggaataaaggcggatgatctggctgcacaaaaaaaaaaaaaactgagacgctcgaggtacccaattcgccctaatagtgagtcgtattacgcgcgctcactgggccggtgtttaacaaacgtcttgactgggaaaaaccctggcgttacccaaccttaatcgcccttgcagcacatcccccctttcgccagctgggcgtaaaaactaaagaggcccgtaaccgagtcgcccatatccaagagtttgcgacaacctggaagggc

SEQ ID NO: 67602 - protein, 65 aa, Zea mays; identical to SEQ ID NO: 66489
  misc_feature: Ceres CLONE 1542440

SEQ ID NO: 67603 - DNA, 750 bp, Zea mays
  misc_feature: Ceres CLONE 1542441
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaatggcatgactaggcattggagcgttgttgagcagcagccatggctatattactctaggcttacaattttgctgtagctgttacacagcaaggagtccacttggtaaacattggtagctaccaaaacaaccctatctcatggtgtaacaattttgtagatttacatttgtgtcatctttttgtaacaaactgatgtatcaaaacaccatattgcaagaaatactaaggcttgcctttgctatttgagcagacaagggaaaacactcgagacgctcgaggtaccacattcgccctatagtgagtcgaattacgcgcgctcactagccgactgttttacaacgtcgtgactgggaaaaccctggcgttacccaactaaatcgccttgcagcacatccccctttcgccagctggcgtaataccgaagaggcccgcaccgatcgcccttcccaacagttgcgcagcctgaatgggcgaatggaaattgtaagcgtaaatattttgctaaaattcgcgttaaatttttgttaaatcagctcattatttcaaccaataagcccgaaaatcggcaaatccccttataaatccaaatgaacagaccgagataaggttggagggttgctccacgtttggaacataagtcccttatttaaggaccgggaactccaac

SEQ ID NO: 67604 - DNA, 870 bp, Zea mays
  misc_feature: Ceres CLONE 1542445
  misc_feature: Encodes the peptide sequence at SEQ ID NO. 67605
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
agaacaatcgtggagggtggtgagtgnnnnnggctcnnnnccatagctggagctcaccgcggtggcggccgctctagaactagtggatcccccggagtgcaggaattcgtctcacccctagaatcagcaacgggcgctaccgcagcgcctggcaccgcgtgctgcccatgcgcgacggcaaccgccgctccatcgcttccttctacaacccggccaacgaggccaccatctcgccggcggcggtgcaggccagcggcggcgacgcataccccaagtacgtgttcggcgactacatggacgtgtacgccaagcacaagttccaggccaaggagcccaggttcgaagccgtcaaggttgcagcgcccaagtcatctccagcggcataaataaatggaagggaccaattattaaatacattataatttatttgtttgaataaaacagcctttaccacccccccgataatggtgatgggaaggtatatataattaaccaccgggttaggaattcaagcgtgtttaacctttaggttgcatgggtataatgcatataattgttcgtagccaaatacaactctattaaggtattccgaaaaggggaaaaagaagaaaaaaataaagctgagacgcttcggaggggaccccacttcgccccctataagtgaagtcggaaattccgcccaacttccctgggaccggccattttaccaaagtcctgggatatagggagaaaaccaggggaggttcgcccaatattgatacccctctcggataaagtaatcgcccctgttcacccaacgtggggcggtaataaacgggaaaaggtccaggcccctggtctctgccttctctcaaaggatggtggctcagg

SEQ ID NO: 67605 - protein, 72 aa, Zea mays
  misc_feature: Ceres CLONE 1542445
  misc_feature: SWISSPROT Homolog: EC 1.14.17.4 Aminocyclopropanecarboxylate oxidase
MRDGNRRSIASFYNPANEATISPAAVQASGGDAYPKYVFGDYMDVYAKHKFQAKEPRFEAVKVAAPKSSPAA

SEQ ID NO: 67606 - DNA, 808 bp, Zea mays
  misc_feature: Ceres CLONE 1542447
  misc_feature: Encodes the peptide sequence at SEQ ID NO. 67607
tccccgcggtggcggccgctctagaactagtggatcccccgggctgcaggaattcgtctcacccctagaaaaagacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaaacgctgccaccatgaacatgtgctccaagtgccacaaggagatgataatgaagcctgagcaggcccagttggctgcctcctccatcgataacatcgtcaatggcggcgataatgggacaggacctgacatggcggccacctggagggtgtggcagtttcttcaaggcaaggacaagactttccgccgtggcagcctatttcttggtccctgaaaccatgtgaaggcttcatgcttcgatagcgccgaagggcccagggcaaggcccccaatccggctgctgcaccctgtctatgaacccccgtctggggtttcaccggcttttcagaaccgccgagatagcggggactccagttcagcatgcgagggcccttgactaattccggaattctaccgtatcccgtctacctcccatcaatacagtaacggccgtaatagaggaacggccctgtgcggcttacgtgctaagtcacgattgggtgtcaagtggccgaccatcacttcttcaagatcccttcaatacgctcccccactttggcctttacctcttcttcctgtgttggccgca

SEQ ID NO: 67607 - protein, 95 aa, Zea mays
  misc_feature: Ceres CLONE 1542447
  misc_feature (14)..(38): Pfam Name: zf-A20 Pfam Description: A20-like zinc finger
MEHKEAGCQQPEGPILCINNCGFFGNAATMNMCSKCHKEMIMKPEQAQLAASSIDNIVNGGDNGTGPDMAATWRVWQFLQGKDKTFRRGSLFLGP

SEQ ID NO: 67608 - DNA, 887 bp, Zea mays
  misc_feature: Ceres CLONE 1542448
  misc_feature (14)..(14): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (681)..(681): n is a, c, t, g, unknown, or other
  misc_feature (811)..(811): n is a, c, t, g, unknown, or other
cggcgctggggacnttttgtcctctccccacccagccnnnagacgagagcaccccccgcggtgggggccgctctacaacagtggatcccccgggctgcaggaattcgtctcacccctagaaaaaaatccatcggaggtgctctcctcttcggcttccttcggcttcggttgcaagaaagaaaaaggtcacctcttaacaccaggccgccgccattgctgctccctttgttcgtttcccggcaccctcgatcccgagcggggttaatccacacattgaccggcgaacgccaccatatcccattcctgaaataccgtccgcgctcgcccgtcgtggccggggttcgtcaaaacccactcgcctgtggtggaccccaaccgcgccgtccgggaccccaccccccccgtcctggtatgccccccccccctcggggggggggggggggggcacgccgcgattccctctcggttaattcaccaccggcgcccctcccactcactcctgggacggctccccatggcatccacgcgtgcccccggccagtcgggcccctcgcggacgccaatgcggcttccacacagcgtgcggacgaccgccggagagccgtctaaatcgcgctttggcctcctactgtctgataaggttcgtgcccgctggctcaggcgagagacccgctcagtccnccatcccatgtctctcacgggggtcggccgccgtgtgcgagccgagacatcgctctcttacgcgcttcacgcgcctggtcctcacagtgccatatgtggctgaaaataccacggtgcctttcgaagtaanaattgagacacccgctgcccgacccttccgttccccctcgcctaggcgcttaggcggtgcacccggtggagcctcc

SEQ ID NO: 67609 - DNA, 738 bp, Zea mays
  misc_feature: Ceres CLONE 1542452
  misc_feature: Encodes the peptide sequence at SEQ ID NO. 67610
  misc_feature (688)..(688): n is a, c, t, g, unknown, or other
aaagctggagctccccgcggtggcggccgctctagaactagtggatcccccgggctgcaggaattcgtctcacccctagaaaaagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcatcactgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccaagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccggaagacaccacgtaacgcgagaagccgaccaagtacgcgggcagccccaagagcaacgctccccgcgtgatccaccaacctcgctaggttcgcctggggaactcatcaggaatgctgctgcccctcttgcagncttgctcttggctgcccgcgctgtcatggtctgctctttcaagccgaaga

SEQ ID NO: 67610 - protein, 134 aa, Zea mays
  misc_feature: Ceres CLONE 1542452
MSAVAVSSSLNPDAPLFIPAALLQVEDFSPQWWDLITTTAWFRDHWSRERAHLDEMAKQIDAAGLLPDDEDLFYDDQLEQGPVAAALKTDSVLKALNMTSPKGGGDAPRGFRKTPRNARSRPSTRAAPRATLPA

SEQ ID NO: 67611 - DNA, 842 bp, Zea mays
  misc_feature: Ceres CLONE 1542458
aaagctggagctccccgcggtggcggccgctctagaactagtggatcccccgggctgcaggaattcgtctcacccctagaaaaatctctctctgcgccgtcccgtgctccctccgctagttctcccaattccttccccacctcctcggtcgtcgcctcccccagagagcaggagccgcctcgtccctgccggtcccgaccccgacccccatccggtcgcgttcaacggcatgaatcccgaggacgactacctccttcagctggtcctccttcggggactcccgggttgggaaagccttgcctgcttcctaaaggtttccggataaattcatattccgggaaaggttttttcggtcctttttggatttttatttttaaaaccccgcgcgggggggggagaaaatggaaaaacacatataagtcgccacaatttgggggaaactggctgggcgccacaacagcttttaagggacactttcaattatgggcggcccccccccgtgggggcaccactgtggtggtaattcttttggttttactattgatctttccactggccccacgcggcgaaggcttttttacaagtctcgcgtcacactcgcggtgtcgtatatagaaaaattcttcacgtgacttaccccgcggtgagaagagcgtgaaccgaacgttcttctttgcgtggggtgaccaataaattgcttcctccttcttgaacataaggacgtaagaattttgtttttctaaaagttggcggttactggctgctctctcccgtgtcacacctctgtgataatttgcctctgctcgctggatgtatatcacacataggccgcgataacgagc

SEQ ID NO: 67612 - DNA, 955 bp, Zea mays
  misc_feature: Ceres CLONE 1542459
  misc_feature: Encodes the peptide sequence at SEQ ID NO. 67613
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
atcctttgcacaccnnannnnnnnnnnnnaagatccnnnnngaataaatggagctcaccgcggtggcggccgctctagaatagtggatcccccgggctgcaggaattcttctcacccctagaaaaatctcgtcgctcggtccaccacctcagctccgccgcttgcccgcttttgctctctccctcccggctctcggcttcttctacacgctagcggctcacagccgtaaacgcccctcccggatcccgctagttcgccaccgccgcccgcccgcccgccgttcgcctcaacatgggcgccctcgccgaccgccacctccggccactacttccccctcaaaggaggccaagcggcaaagaactttgaccttctgcccctaccaaaggggaaaatctcctttccccttactttttcttcccccccccccccgggggggggggggggggggtccactattatcctgaatactggttcccaccccccactaaaagggtacaatgaaaccctactcccctccaaatgcgcgggcgaggtcctcttgccaaatcaatttctgtcgttgactacgagacccttgactaatacataatatgaggaaactgtgctcctcctcgtgtctctgccaccccctctccctagcgagtccactaaccggaccaccgcttcctatgctacacagccgtctattatggaccaggtgcacactcaatcgcaacagacgtctcatgccgtcacgcaaactactgaaatgcataacatggaagttggtactgattctgctatgcgaccactccgtctattctgatcataacataatacaaccaagaagattacagaatcgcagaaccaaatcgcttactaacaaatgtatgatcatcgcggcagacacgtacctacatacaaacacatacctaccacctataataactcgtaccatcgcgagtctcgaccgcgg

SEQ ID NO: 67613 - protein, 38 aa, Zea mays
  misc_feature: Ceres CLONE 1542459
MDQVHTQSQQTSHAVTQTTEMHNMEVGTDSAMRPLRLF

SEQ ID NO: 67614 - DNA, 752 bp, Zea mays
  misc_feature: Ceres CLONE 1542466
  misc_feature: Encodes the peptide sequence at SEQ ID NO. 67615
aaagctggagctccccgcggtggcggccgctctagaactagtggatcccccgggctgcaggaattcgtctcacccctagaaaaactggtcggcggctggtggcatagggatggagacggcggcggcgatgctggagggcggggtggggcggttctcgcgggcgccggcgctggccgcggcgctgctggcggagacgtgggcgccgctggccgtggcgctcgcggcgctggccacgctgcccagcctgctgcgccggctgcaggtcatcgtgctgcgcctccgctcccgcgggaaggaggccatccagtcgcacatcgggacctaccactactcgtcctgcgacgaggatgacggcgacagcgacgaggacgagagctccgacgacgaggcggaggccggctcctccggcgacgaggaggaggatctggagcgggtcgggttctacgaggggcccgcagacggcgtcctcccctggggcggcgccgtggtccggacctggcagggccgcttctccggctgcgcctcgggcgggggagctgtcggcggcgccgccagcggagcagcgtcccccgccgctgtcaggctgtggggcgccggcacggccagcggcgagcctttggtgggctgcctgcaccgcccacaaaagctgctgggcgcgaccggtgcggcccccggaggcggaccgggtccggggccggggtggccggcccagagcacgccttccccaccacggccggggggacccgggggct

SEQ ID NO: 67615 - protein, 214 aa, Zea mays
  misc_feature: Ceres CLONE 1542466
METAAAMLEGGVGRFSRAPALAAALLAETWAPLAVALAALATLPSLLRRLQVIVLRLRSRGKEAIQSHIGTYHYSSCDEDDGDSDEDESSDDEAEAGSSGDEEEDLERVGFYEGPADGVLPWGGAVVRTWQGRFSGCASGGGAVGGAASGAASPAAVRLWGAGTASGEPLVGCLHRPQKLLGATGAAPGGGPGPGPGWPAQSTPSPPRPGGPGG

SEQ ID NO: 67616 - DNA, 662 bp, Zea mays
  misc_feature: Ceres CLONE 1542467
  misc_feature: Encodes the peptide sequence at SEQ ID NO. 67617
  misc_feature (662)..(662): n is a, c, t, g, unknown, or other
cgcggtggcggccgctctagaactagtggatcccccgggctgcaggaattcgtctcacccctagaaaaagtcatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcccgggcgcggcgacgcctcgcccctcgacggtctcgccccccacgaccccggcggtgtccagccggcgtcccacctgctcaagtacgactccacgcctcggcatcttcgacgccgacgtcaagccccgtcggggaacaacccccttcttcgttcaaggccaggttcttccagggtcctgtcccgaaccgcaaccccccaccaacctggccggtgggggcgaagtttggcaattgaaccttctttattcaaggggcacccgggggttcctttcttctcaacccccaaggggccccctgggaan

SEQ ID NO: 67617 - protein, 186 aa, Zea mays
  misc_feature: Ceres CLONE 1542467
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTHAVGTSGGSRRAPTEAKLKVAINGFGRIGRNFLRCWPGRGDASPLDGLAPHDPGGVQPASHLLKYDSTPRHLRRRRQAPSGNNPLLRSRPGSSRVLSRTATPHQPGRWGRSLAIEPSLFKGHPGVPFFSTPKGPPG

SEQ ID NO: 67618 - DNA, 661 bp, Zea mays
  misc_feature: Ceres CLONE 1542471
  misc_feature: Encodes the peptide sequence at SEQ ID NO. 67619
atagctggagctccccgcggtggcggccgctctagaactagtggatcccccgggctgcaggaattcgtctcacccctagaaaaaaagcccaccttttcttcttcccatctcgtctctctcttcattgcgtaaggatctcttcgtcagggagagaggaccaaggaagcgcccgcggatagagatggggctggcgatcctagcgaggcggcgggctgcagcggccgtgttgcggcggccgcagacggcggcgggggcggccgtgtccgcctggaaggagtactccgcggcgggcgacgagagcgacgtggtggaggcgggcggcgggccccgacggtacgtggcggcgatcaaggacgcgcagctggggctcaagaccacctgcatagagaataggggcactctcggcgggacctgcctcatcgtcggatgaatcccatccaaggctcttttgcattcatcacatatgtatcatgaatcagacagttcttttgcacaccatggagttaagctttcaaatctggaactggacctcccagccatgatggctcacagagacaaagctgtggactgactaacaaacggaattggagagctctttagaaagaacaaggtgacttatgtctaaggctttggaaaactgtcatccccctcagaagtgtca

SEQ ID NO: 67619 - protein, 82 aa, Zea mays
  misc_feature: Ceres CLONE 1542471
  misc_feature: SWISSPROT Homolog: EC 1.8.1.4 Dihydrolipoyl dehydrogenase
MGLAILARRRAAAAVLRRPQTAAGAAVSAWKEYSAAGDESDVVEAGGGPRRYVAAIKDAQLGLKTTCIENRGTLGGTCLIVG

SEQ ID NO: 67620 - DNA, 723 bp, Zea mays
  misc_feature: Ceres CLONE 1542472
  misc_feature: Encodes the peptide sequence at SEQ ID NO. 67621
aaagctggagcttccaccgcggtggcggccgctctagaactagtggatcccccgggctgcaggaattcgtctcacccctagaaaaaacctcagtctttgaagcttctttaagagctacacttgccaggattggaacaaacttttctgtttctggatttggctcaagcctggataaatcacctgcagcaactgctgatgagaatgcagacttgtcttttgctgggagggctgcgctggacattgcagctattcgcttaagtgatctgccagataagtctaagaagttcttaactgtgctagaacagtcaaaagatccaagattccatgctctttctctcacatcacaaagagttgcagccttctcagacacagtaaaatgaactcgtctatgatgtgctcatatctaaaggtccgcagcgtctcagtgaagtccgcccccttctcattctggtcatcccgggaagaaacaggggggtcttcctcttccaagctttaatggcctacccccaaggatactgaacccgggttgggggaatattcccctcccttttacccccgaaaagtgggaccccccccgggaaagggttcccccgggaaggggggttgggaacccaaaaaggccccattttcttttgcccccaaagggaaatttttaaggggcccccaagggggccccctttttttttctcagggacacccctccagaaagatccccctctttcc

SEQ ID NO: 67621 - protein, 125 aa, Zea mays
  misc_feature: Ceres CLONE 1542472
SWSFHRGGGRSRTSGSPGLQEFVSPLEKTSVFEASLRATLARIGTNFSVSGFGSSLDKSPAATADENADLSFAGRAALDIAAIRLSDLPDKSKKFLTVLEQSKDPRFHALSLTSQRVAAFSDTVK

SEQ ID NO: 67622 - DNA, 653 bp, Zea mays
  misc_feature: Ceres CLONE 1542474
aagctggagctccccgcggtggcggccgctctatcctagtggatcccccgggctgcaggaattcgtctcacccctagaaaaaacaactcctctgcattaccttttggagtactcaggtttcatttatctccatcgttctgagttgcgatctgtaaatcatgcaaagcgctgtaatgcccgatctctgcctcgtcgtctggcagaagcttctgccaggtctttggagccatcgatgcacgccgcaagcaactgagggtgtatcgctagcaccacgtgcacgactgctgcctctgcgccgcgcactgtctagtgtccgcactacgccggcccttcttctgcgagtggtaatcgccgggctcgccgccgacctcgacatagagcagcacctgggtgatgacgacgtctccgtaccgcacagcggcctacgctgctagagtcatttcttcgcgagtgacagaatctcacctatctcccatgcaggacattacagctcctggtaggagtaccgtactggtccaggattctgaccatcttccggttttgtttcctcgtctccgggagatttccactggcgatatcctacggttcgggttccaaggtcccagggagattcctggtaaggggcccgccaaaattttaggggatttttgccg

SEQ ID NO: 67623 - DNA, 712 bp, Zea mays
  misc_feature: Ceres CLONE 1542475
  misc_feature (23)..(23): n is a, c, t, g, unknown, or other
  misc_feature (84)..(84): n is a, c, t, g, unknown, or other
  misc_feature (163)..(163): n is a, c, t, g, unknown, or other
  misc_feature (248)..(248): n is a, c, t, g, unknown, or other
  misc_feature (251)..(251): n is a, c, t, g, unknown, or other
  misc_feature (255)..(255): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (405)..(405): n is a, c, t, g, unknown, or other
  misc_feature (408)..(408): n is a, c, t, g, unknown, or other
caccgcggtggcggccgctctanaactagtggatcccccgggctgcaggaattcgtctcacccctagaaaaaagtttgccgtcnggccacaccgcatcgaagcgccgccgccactcgccctcccctgccatctctcgccggccgccgcctcccgcccaccggncaccgcagcgtgttatatttcagcccctcttgatcggccacccgaaacccgcaggagagaggctaaggaacgatgggggtggaangcnccanaaaaagcttcatcaggctattggaaagggccttgcgagggagaacaacgttgatgatcattaataggcaaagaacaaggggaatccgggctccttatttttttccccccccccccggaggaaagaaagggggnnnnanncnnnnaccttntcnttaaacccattaaaaaagaaaaagagccccccgtggggggggcgggggtcaaaacccccctctaatgcccccaatggccccgtgggctttaccccactccctcggaaaacaagtaaagatggctcacccctatcctggaaacacgcaaacaaaaccccgtggaacccatcgaaaaaagcctcgccagtgcggttccttacaaccccccgtgagaaaaaattttgtacaaggttaacccaagtcctccttgattcccctctgtacaccaatgcaccgaccttgaacagtcccacaatgccagagt

SEQ ID NO: 67624 - DNA, 815 bp, Zea mays
  misc_feature: Ceres CLONE 1542476
  misc_feature: Encodes the peptide sequence at SEQ ID NO. 67625
  misc_feature (36)..(36): n is a, c, t, g, unknown, or other
  misc_feature (44)..(44): n is a, c, t, g, unknown, or other
ttttgttatcatttatcgaattaatttttttccttnttcctctnggaggaaactggaactcaccgcggtggcggccgctctatactagtggatcccccgggctgcaagaattcttctcacccctagaaaaattttctgattgagcaatgcccccccgttccgccttcataccctgctcgtcagcccggataaaataacgcccatctgcacgggccacgcgaagcgttcgaactcctcccacggcagccatggtcaccgccaccacctccccgctcttctccctctcctccctccgcgcctccctcccttcccccacccgatttcacacgtctctctcgctccgagccctctccccacgtgcccggtctctctgcctcccctccctttcgcctccccactcgttttcaggcgggtaacggaacctgccgccggccactttttgtggccttccccacctcaacggttgaataacggtccaccccctggcaggtggatgtttgataaagcttaccactatggacaaatgctccggaaactctcgtttaaacgaaacatatgtattcgtccaaaaaacttgacatgccccctgtttttaccgaaaaatcccccgccccgtctaaaggcccaaacaatttcccaccctgtcggatttaataaaggggccctatagccacctctcttcatacagtcttttgtggaagagaaccctggtacatcgcaaaccttggtaaaaaattttattcaacataactcactatattgaatttctctgtcgggcgttatcccgacgcctcttttgattccagcaacgtgtg

SEQ ID NO: 67625 - protein, 55 aa, Zea mays
  misc_feature: Ceres CLONE 1542476
MVTATTSPLFSLSSLRASLPSPTRFHTSLSLRALSPRARSLCLPSLSPPHSFSGG

SEQ ID NO: 67626 - DNA, 749 bp, Zea mays
  misc_feature: Ceres CLONE 1542477
  misc_feature: Encodes the peptide sequence at SEQ ID NO. 67627
  misc_feature (477)..(477): n is a, c, t, g, unknown, or other
  misc_feature (486)..(486): n is a, c, t, g, unknown, or other
  misc_feature (708)..(708): n is a, c, t, g, unknown, or other
aaagctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctnggcgcgctncgctgcgtcttcccggagctgctcgcccccgcacgcgtcaaagtcggcgaggccgtgtggttcaagggccgctcccagatcttcagcgagggtggactggactacctcgggaacccgagcctcatccacgcgcagagcatcctcgccatctgggcctggcaggtcgtgctcatgggcgccgtcaagggctaccgcatcgccggcggcccgctcgggaaggtntccaacccgcttcttcccggcgggagcttcgacccgctcgc

SEQ ID NO: 67627 - protein, 198 aa, Zea mays
  misc_feature: Ceres CLONE 1542477
  misc_feature (65)..(198): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALRCVFPELLAPARVKVGEAVWFKGRSQIFSEGGLDYLGNPSLIHAQSILAIWAWQVVLMGAVKGYRIAGGPLGKVSNPLLPGGSFDPL

SEQ ID NO: 67628 - DNA, 651 bp, Zea mays
  misc_feature: Ceres CLONE 1542478
  misc_feature: Encodes the peptide sequence at SEQ ID NO. 67629
tggagctccccgcggtggcggccgctctagaactagtggatcccccgggctgcaggaattcgtctcacccctagaaaaaaaaaaaaaaaagggggaggtgcaagagactgattgcggacttcttgcagagtggaacaatgcagtaccagacacgagatatatctttcaaagaagaaggcttttttcgaataagccaattgatttgggaccttcggatccattctttttcctattcaaagatcaggcctttgtctctgtgttttcacgtcgagaattctttgcagatgaagatgaagagatggcaaagcggcttagtaccagtacctgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatccct

SEQ ID NO: 67629 - protein, 108 aa, Zea mays
  misc_feature: Ceres CLONE 1542478
GAPRGGGRSRTSGSPGLQEFVSPLEKKKKKGEVQETDCGLLAEWNNAVPDTRYIFQRRRLFSNKPIDLGPSDPFFFLFKDQAFVSVFSRREFFADEDEEMAKRLSTST

SEQ ID NO: 67630 - DNA, 917 bp, Zea mays
  misc_feature: Ceres CLONE 1542480
  misc_feature: Encodes the peptide sequence at SEQ ID NO. 67631
  misc_feature (1)..(1): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (900)..(900): n is a, c, t, g, unknown, or other
ntttttggttttctgccatatctctntnnnnnnngggggggnnnnnngacaccggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaacacatcgacctcctcttgaccggccgctgtggttccccggcgccgtgccgcccgactacctggaacagtctcccgggctcggcggactatgttttcccccccccccgcgtgggggggggggggggtggaagtacctcgtatcttcaagtttgggaatctcttggagcccctataacctgggcccattgaatcgactgccttgttgtgtttctcttaagcagcatcggctgcgaagatccttcctatactagtccgtctacttctgctatacgcacctcaactcccaaccgctcatgttttatgatcctcctccacttatcggacgcgttctcgcgcctgtatctgtttattgtctttctacccttcttcgccgaccatgcgccccatcgcattgcaaatcctctgatggtcactccccctctattcctctttaagtctgagctagaatcgctactgcttcctgcgacggcttcacaatccacgatgacgtggtttgtacgtatgtggttacgcccgtagctccttccacatagtctgagtttaccttacttaaccctcctccgttactcctctctatctgatcnagctcacctcccatccc

SEQ ID NO: 67631 - protein, 53 aa, Zea mays
  misc_feature: Ceres CLONE 1542480
MASSVAAAASTFLGTRLADPAPQNGRIVARFGFGLGGKAKPAPKKVANTSTSS

SEQ ID NO: 67632 - DNA, 745 bp, Zea mays
  misc_feature: Ceres CLONE 1542482
  misc_feature: Encodes the peptide sequence at SEQ ID NO. 67633
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (745)..(745): n is a, c, t, g, unknown, or other
gcctgcccgcttttttgaacaaacaaaaacaaaccacacaaccccagannnnaaaaaaatggagctcaccgcggtggcggccgctctagaactagtggatcccccgggctgcaggaattcgtctcacccctagaaaaaagatgccaaatttagggagcgaagtaccagatgttgcaaaagaaattcctgcccctctggtacaaggtccagcaattgtgaccggaataccttcacctgtcaaagaggttccaggcctgagagaaattcctgtgccactgaacgaagcaccaactttattggcagaatttccttcccctcaaaaagatccctctgctattacagttgaacatgcctctaatgttacaattgagcatgcccctgctatttccattgaatccccacctttgaaacaaagtgttccagtttttaaggaatctcctctgaaacaaagcgttgcagtttttaccgcccctcctcctttgaaacaaagcatttcagtttttaaggaatctcctccactggaggaaactactcctaaagaagctgttatgctaagtgaccgaaggctttttcaatgtgcagaaatcctcaaattatccccatggtaacagaaagatgttccagaaaaattgaaacccaaagccttccaaaaaatctttgaaaatccaaaaattggcaaaaaaggcctcggaaaaaaaattgaattaatataaagggctttaaccgaagaaacaaagaagcccan

SEQ ID NO: 67633 - protein, 155 aa, Zea mays
  misc_feature: Ceres CLONE 1542482
  misc_feature: SWISSPROT Homolog: EC 2.7.11.1 Non-specific serine/threonine protein kinase
MPNLGSEVPDVAKEIPAPLVQGPAIVTGIPSPVKEVPGLREIPVPLNEAPTLLAEFPSPQKDPSAITVEHASNVTIEHAPAISIESPPLKQSVPVFKESPLKQSVAVFTAPPPLKQSISVFKESPPLEETTPKEAVMLSDRRLFQCAEILKLSPW

SEQ ID NO: 67634 - DNA, 710 bp, Zea mays
  misc_feature: Ceres CLONE 1542486
  misc_feature: SWISSPROT Homolog: EC 3.2.1.23 Beta-galactosidase
  misc_feature (44)..(44): n is a, c, t, g, unknown, or other
taaaaacatttacattataaaacaccaacaaaaacaaaaaaaanggttttttgttcaaaactggagctccaccgcggtggcggccgctctttaatagtggatcccccgggctgcaggatttcgtctcacccctagaaaaatttttttttgtatttggtcatttcgtcgtaggagtccgaccccttctccaaggaaaaagggcagtgttgagagtcattgttgtgtatgtaaaaccaaacacttgagcttgtagtaccttattcgatttcttatttattcctgtctgttcggagtgagaataacactaagctttcgtagatgcaaaataaaaacgagacgctcgaggtacccaattcgccctatactgagtcgtattacgcgcgctcactggccgtcgttttacaaggtcgtgactgggaaaaccctggcgtttcccaacttattcgccttgcagcacatccccctttagccagctggggtaataccgaaaaggcccgcaccgatcgcccttcccaacagttgcgcagcctgaatggcaaatggaaattgtaagcgttaatattttgttaaaattcgcgttaaatttttgttaaatcagctcatttttttaaccaataggccgaaatcggcaaaatcccttataaatcaaaagaataaaccgagatagggttcgaagtgttgtttccagtatggaaacaatagtccacttt

SEQ ID NO: 67635 - DNA, 735 bp, Zea mays
  misc_feature: Ceres CLONE 1542487
  misc_feature: Encodes the peptide sequence at SEQ ID NO. 67636
  misc_feature (534)..(534): n is a, c, t, g, unknown, or other
aaagctggagctccccgcggtggcggccgctctagaactagtggatcccccgggctgcaggaattcgtctcacccctagaaaaaacatcacatctgaaacagaaacagctagaagacatattcaacagattcagagaaagcacatatagatagagagagagagaggcaaaaaaagagcgagagagagctgcggattaattatcaaaacccggccgcttccatggagagagttgcatcaagctgctgcgtcagcctcctagcacaaaggagggcctacactatggccgcggccatggctaagaagggagccgccgcacggagggtcgacgagaagaaggcggcggccgcgctgaccaagcgcgtgatgggcaagaaggaagtgaacacggctgccgctgcggcagctgaggagaaggcgtgggtgccggaccctgtcactggctactatcgcccagcaggtagcgccaaggaggttgacgcggcggagctacgctccaagctgctgacggaggctgcggccaactgattcatcangcagtcactttgtcgacctacagcatgagttggctctgtccacctagcttctcctgctttaagatccgcgctcgttgatccccgagctccttggcctaaagcttttatatactcagtgatccatatataatatgtagcgggggacatatcggggcatataagtttttttatagaaaaatggggcacaggaactaccaagtt

SEQ ID NO: 67636 - protein, 101 aa, Zea mays
  misc_feature: Ceres CLONE 1542487
  misc_feature (21)..(96): Pfam Name: LEA_3 Pfam Description: Late embryogenesis abundant protein
MERVASSCCVSLLAQRRAYTMAAAMAKKGAAARRVDEKKAAAALTKRVMGKKEVNTAAAAAAEEKAWVPDPVTGYYRPAGSAKEVDAAELRSKLLTEAAAN

SEQ ID NO: 67637 - DNA, 736 bp, Zea mays
  misc_feature: Ceres CLONE 1542488
  misc_feature: SWISSPROT Homolog: EC 3.2.1.23 Beta-galactosidase
  misc_feature (12)..(12): n is a, c, t, g, unknown, or other
aaaagaaataanaatttaaaatataaaaaaaaaaagaaaaaaaaaaataaaaacaaaacaggagctccccgcggtggcggccgctctagaactagtggatcccccgggctgcaggaattcgtctcacccctagaaaaagaatgccatcaagaaaattttcataaaatgtgcagtaaacagcacttcgcaaggctgccgatcatataagccgccttcggcctttttattgtccaaaaaaaaaaaaaacacaaacaaaaaaaaaaaaccaaaaacaaaacaaaaaaaagaaagaaaaaaaaaaaaaaagccgagacgctcgaggtccccaattcgcccaataaagaccccaataacacgggctcactgcccgcctttttaaaactacgcgactggaaaaaccctggcgttccccaacttaatcgcctagcaacaaatccccctttcaccagctggcgaaaaagcaaaagaggcccgcaaccgatcgcccttccaaaaatttgcccatcctgaatggcaaacggaaatcgaaccgcaaaaattttgctaaaattcaccaaaaaattttgttaaatccacctccattttttttaaccaatagcccagaaaaccggaaaaaacccctttagtaaatcccataaaaaacaaacccccaaaaaaccgcctaagaaaagtttttcttcccaaatttttggaaaaaaaaaaacatccccctctattttaaacaggaaaccggggg

SEQ ID NO: 67638 - DNA, 645 bp, Zea mays
  misc_feature: Ceres CLONE 1542496
  misc_feature: Encodes the peptide sequence at SEQ ID NO. 67639
aatagctggagctccccgcggtggcggccgctctagaactagtggatcccccgggctgcaggaattcgtctcacccctagaaaactagcccgacaggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatctcagcacaaatcatatctgctagtatagcaggtgatatggttcttgcttctgctgacggggatgagttgccacgatatggtctcgaagttgggctgaccaactatgcagctgcctactgcactggccttctgttggctccccctgtgctcaaaacccgtggtttagaataaagaatatgaggggcatgttgaggcccccggtgaggacttctctgctgagcccactgatgaaaggaggccttttcctgcccctcttggaaggtgggccttattagaactaccacctgggaacccgggccctttggttgcccccaaggg

SEQ ID NO: 67639 - protein, 117 aa, Zea mays
  misc_feature: Ceres CLONE 1542496
  misc_feature (27)..(118): Pfam Name: Ribosomal_L18p Pfam Description: Ribosomal L18p/L5e family
MGGFVKTHKSNAYFKRFQVKFKRRRAGKTDYRARIRLINQDKNKYNTPKYRFVVRFTNKDISAQIISASIAGDMVLASADGDELPRYGLEVGLTNYAAAYCTGLLLAPPVLKTRGLE

SEQ ID NO: 67640 - DNA, 766 bp, Zea mays
  misc_feature: Ceres CLONE 1542504
  misc_feature: Encodes the peptide sequence at SEQ ID NO. 67641
  misc_feature (35)..(35): n is a, c, t, g, unknown, or other
  misc_feature (39)..(39): n is a, c, t, g, unknown, or other
  misc_feature (766)..(766): n is a, c, t, g, unknown, or other
ggggagaaagaaaataaatttctccggacgaaaantccnaaaaaataaaacacaaatggagctccccgcggtggcggccactcttttttagtggatcccccgggctgcaggaattcgtctcacccctagaaaaagggactgtcctcaggacaatcgccaaaaccccccgagccaacacctactacgccgccgcgccgccgcgtcaaacaacggcgagaggacgcctatggcattcacttcccaatccctaatcttccgggcacccgcctcgccctcttgtgcccgcataaccccgtcatccggtcgcgtcaccctccgggaccgcagcgccgttttcccgctcgtcgcggcggcctccacctcgatggcgtcctcggagagcgaagataagagggaaaccaagctgtggggcgggcggttcgaggaaggcgtcaccgaagcccgtggagcgctttcacggagtccatatcctacaactgggcagctctccaaatactacatagtgtggcacccaggggccaagccttccttgtctccctgggacaggggtttgataacacgcctactgaaagggccataaaacacttaaagaagacctttgaaagataatacggacaggcgttgaattccacaaacaggccacacattttcttatcgggaagaaaaagaacccgagaatggaaatgggccacttttggaaacactttggaaagccaggattcactaaaattttgaaaaacagactattgattataaccacctatan

SEQ ID NO: 67641 - protein, 71 aa, Zea mays
  misc_feature: Ceres CLONE 1542504
MASSESEDKRETKLWGGRFEEGVTEARGALSRSPYPTTGQLSKYYIVWHPGAKPSLSPWDRGLITRLLKGP

SEQ ID NO: 67642 - DNA, 769 bp, Zea mays
  misc_feature: Ceres CLONE 1542505
  misc_feature: Encodes the peptide sequence at SEQ ID NO. 67643
  misc_feature (388)..(388): n is a, c, t, g, unknown, or other
  misc_feature (403)..(403): n is a, c, t, g, unknown, or other
aaagctggagctccccgcggtggcggccgctctagaactagtggatcccccgggctgcaggaattcgtctcacccctagaaaaatggagcactcaccagtcaccactcagcagcgatcgcagcaccgcggcgagataatgagcagcctgtcctccggcatctctgcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggggtggtggtggtgagggccgggcctgggccgctgtcggagatcgagccggacctccacgaggacgcgggggaggtgtaccncaccaacggcatcanccccgaagacttctagtacgggaagtatgaccgacaccacccctatttcgaaggtccagaccagaagggctcctgggaggatgtctcccaatgggcaccaaaaaagctgaacccccctcagggctttcaagccactcatctcctggggcattccctccctgcgaacctcctccgggatggcttttcatggggcccgggggaatccctggacctctcggggcggcccccttcgtccgggggtttctggccctcccaaatgggtaagcctcacaagctccccaatcttctagccgtgaaatttcttctaggtggaggccggtccctcaaaaatctctacccgccacaaattcccagggagatccgggg

SEQ ID NO: 67643 - protein, 111 aa, Zea mays
  misc_feature: Ceres CLONE 1542505
  misc_feature (102)..(102): Xaa is any aa, unknown, or other
  misc_feature (107)..(107): Xaa is any aa, unknown, or other
MEHSPVTTQQRSQHRGEIMSSLSSGISASPSAAPSTARRRHDAAPQQLRVKAAARPQLLHAGRRRSSVGRRPGGGVVVVRAGPGPLSEIEPDLHEDAGEVYXTNGIXPEDF

SEQ ID NO: 67644 - DNA, 899 bp, Zea mays
  misc_feature: Ceres CLONE 1542508
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (62)..(62): n is a, c, t, g, unknown, or other
  misc_feature (63)..(63): n is a, c, t, g, unknown, or other
  misc_feature (226)..(226): n is a, c, t, g, unknown, or other
tttttctcccccccccnnnnnnnnnnnngcgccaacnnnnnacacccacggacctcacccgnntggccgccgttttgaagtagtggatccccccggctgcaagaattcctctcacccctagaaaaaactggcacactgcccctctaccctgcctgccgtttccatctccatccagttctccgcacccacccacgcattttttctcagtctgtggggaagccagggnctccccccaccttcgcctccggcaccccgtaatcaaatatcccacctgggccaccttagcctaccaccacccagccttttcaagcacatgccccagtccattctagacctccccccccacgcgcgaaaatacaccctccacttagtctcccctttctctccccaccccaacttataacttaaactctttttctttccccccccccccccaggggggggggggggggtcaaccactcactcagacccaaattccaacccccaatcccctctcccaacacactcccctcattgcccggtcctcaacacggtgtcttcccgtcttatatctgaccccccctcccccatgtacccctcacgttctctctttccttctctctccttctccctccacatcgcctcacgttccctccgttcctccgtctctgccaccccccacaccctactgtcacctcatagctacatcgttctttattacaccctgattggactgcctgacagagatcataacccacccctcatcccctccacccctctagtctttgtcatatcgaaactattcaccctacagttatcttcgtgcctcccccgtggcccgtcatcctctcattcgcggccatcaccctgccctctttacccctctaccggctccaccccaccatccttccgacgcccc

SEQ ID NO: 67645 - DNA, 754 bp, Zea mays
  misc_feature: Ceres CLONE 1542509
  misc_feature: Encodes the peptide sequence at SEQ ID NO. 67646
  misc_feature (398)..(398): n is a, c, t, g, unknown, or other
  misc_feature (754)..(754): n is a, c, t, g, unknown, or other
caaagctggagctccccgcggtggcggccgctctagaactagtggatcccccgggctgcaggaattcgtctcacccctagaaaaagcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagacaagccaccggcggggctaggtgcaancagagattacaatgtagacatggttccaaagtttatgatggcaaacgggactttgggttcgcactctcattcacactgatgtgacaaaatatttggccttcaaagctgttgatggaagctatgtcttcaccaaacggaagattccccagggttcctgcccccgatatggagggctctcaaatctccctttgagggggccattttgaaaaaaccaaaagccaggaaccttttttgtttacgtccgaattaccaaggacaccgaaccccgtgccccctccgggggtgggacccccccagggattccgccttggagatttgtttttgaagcatggatgggggggtcgccactgcgggtn

SEQ ID NO: 67646 - protein, 93 aa, Zea mays
  misc_feature: Ceres CLONE 1542509
  misc_feature (68)..(68): Xaa is any aa, unknown, or other
MDEEYDVIVLGTGLKECILSGLLSVDGLKVLHMDRNDYYGGDSTSLNLNQLWKRFRGEDKPPAGLGAXRDYNVDMVPKFMMANGTLGSHSHSH

SEQ ID NO: 67647 - DNA, 620 bp, Zea mays
  misc_feature: Ceres CLONE 1542513
  misc_feature: Encodes the peptide sequence at SEQ ID NO. 67648
tggagctccccgcggtggcggccgctctagaactagtggatcccccgggctgcaggaattcgtctcacccctagaaaaagtctgtgactgagaagatacctccatacacctacctctctattaactacctggcgccggagaaccctatagcgctcgaccatggatccgctgcatgcggagtctgtcagtttcctctgcggatattgcgaagctgatagctccctgaaacccggagatgtcatcctctgccttgaatgtggctaccacatcctctacaataagcggacccccctgattgtccaatatgaacctcgctgatgagagaacactagggataacactgtagatgcgttgatctattactccccactttacctatgtgaactgtcttctgagagaaatgaacatgtcacacttcacatttgtatgtcgcgcgcctcctttgaacctgatctgtataatttgtatcgcttgaactgcggactgatttgagaactgatacactgcttctatatgtcgatgggtcctaatcggcgaatctcctgattactcgttataccaacggtatttttggggagtaatgatcaaaaaggagcaacacgagtgcctacttatccacg

SEQ ID NO: 67648 - protein, 52 aa, Zea mays
  misc_feature: Ceres CLONE 1542513
  misc_feature (11)..(42): Pfam Name: DNA_RNApol_7kD Pfam Description: DNA directed RNA polymerase, 7 kDa subunit
MDPLHAESVSFLCGYCEADSSLKPGDVILCLECGYHILYNKRTPLIVQYEPR

SEQ ID NO: 67649 - DNA, 642 bp, Zea mays
  misc_feature: Ceres CLONE 1542514
  misc_feature: Encodes the peptide sequence at SEQ ID NO. 67650
cgcggtggcggccgctctagaactagtggatcccccgggctgcaggaattcgtctcacccctagaaaaaacaagtccccacagcactctccccgaccttgccgtccagtcgtccaccccaccgccgcagcctcgccccgaggagacaggagaacagcaggatgccggcgacgccgacgatcatcggcgccctcctgggactgggcactcagatgtactccaacgccctccgcaagcttccctacatgcgccatgatgatgaatagctgttcagatttgtttgtcagtgacctgtatttttttgcaacatgttgtcagtacacatggtcaggactgtggatcccccatgacttagttgttgcctcagcttccacatttcaactgtggccttgtaataaaatgtcgttgcccaatggatctgatggatcacaattgtaagctacaaattatgggctttgaatatgatcgcttactttctctgatgcaaaattactcagttggtcgtcccccgcctcaattatcctcgcaaaaattattaccctttactcatatccccataccaccccaccccgactaaaaaaataatcacccagcaccctccggggaaccccaattccgcccttataggaggggccctatttcc

SEQ ID NO: 67650 - protein, 34 aa, Zea mays
  misc_feature: Ceres CLONE 1542514
MPATPTIIGALLGLGTQMYSNALRKLPYMRHDDE

SEQ ID NO: 67651 - DNA, 718 bp, Zea mays
  misc_feature: Ceres CLONE 1542517
ccccgcggtggcggccgctctagaactagtggatcccccgggctgcaggaattcgtctcacccctagaaaaatgataaagcacatgatcacaaacttagctgtgaacttgacactataagtggctcgttcctacccaattgtgctcaaatgcgctacttagaagcattgctagacagaggatcgaaagatgggttagtactgattaaaaaatggcttattgaagccttgcagcatgggaagctaacatctgcatccaaaggttggcaaggagccacttctgtttcagagattcgatctatggtgcaaatgctttcccgagaccagttgtcattgttaaaaaacaggggtgttatccagttagcactagctgctgaaatgactctacgggagcctcaaagttctcgctgggacgcctttacaagtgccgagagaatattaagtgtgacatctgcagagacacctcaaagtcttgccagtgagcttcgtgatttcatcaacactagcactttagttgaatcacacacacaaactacttcaatggagtcttcacagggcctacttagtttccaggacgtactgcttctaacgattatagggtatatcttagctggtgaaaatttccctacatctatggctggtggtccattttcttgggaagatgagcggtctcttaagatgttatagtggactctatccttgaaacgacatcatctgtga

SEQ ID NO: 67652 - DNA, 898 bp, Zea mays
  misc_feature: Ceres CLONE 1542518
  misc_feature: Encodes the peptide sequence at SEQ ID NO. 67653
agtctcaattcacaagcgccttcaaactttcagaacacgcacttctgctagctagtagccatggcttccgcagtctcgtctctcttcttcgccacggcgctcgtgatgatgacgctcatgatcatgctcgagggcagcaccacatgccacgccgcgcggcatcttgccgacacgacgaccgccccgaccgctgctcctaccgccatcccggccattcctgccatgccgaagccgccggtcgtgcccaccgtgcccgcggccacccttccaccgatacccgccgtgccgacgtcgacggtgcctgcgctgggcgtgccaccgatccccgcgttacccaagatccccgcggtgccccctatgccggctgtacccgcattgccaaaggtgacggtgacgctgccgccgccgatgcccgccgtcgtcgtcgtccctaaggttggcgccttgccgccgatgcccgccgtgcctaagttgacactgccgccgatgccctcgatcccgggcgtgcccatgccgtttgtggcgccgcctccttcggcataattcaattcaccaatgtctgatagattgtccatatatctgagtattcgagttgatctcactctcgatcaatccatgtgtacgatcttcgctgggcacgcatgctgcagatttacctaattggtgtatgtatgtgattctatatacttctatatattgttgtattcagtctttttcaaagttataatgttgtgtcaagctttgtcagttcattttctttcatttttttggttggaggtcgtcatttgttgtaatctgtaagtggatacgtatgtacagagtgctcgactaccccttgtgcagttttttcatgtatttgaatttgcttttggtactttgttaaaaaaaaaaaaaaaaa

SEQ ID NO: 67653 - protein, 160 aa, Zea mays
  misc_feature: Ceres CLONE 1542518
MASAVSSLFFATALVMMTLMIMLEGSTTCHAARHLADTTTAPTAAPTAIPAIPAMPKPPVVPTVPAATLPPIPAVPTSTVPALGVPPIPALPKIPAVPPMPAVPALPKVTVTLPPPMPAVVVVPKVGALPPMPAVPKLTLPPMPSIPGVPMPFVAPPPSA

SEQ ID NO: 67654 - DNA, 625 bp, Zea mays
  misc_feature: Ceres CLONE 1542523
  misc_feature: Encodes the peptide sequence at SEQ ID NO. 67655
  misc_feature (40)..(40): n is a, c, t, g, unknown, or other
  misc_feature (204)..(204): n is a, c, t, g, unknown, or other
  misc_feature (206)..(206): n is a, c, t, g, unknown, or other
  misc_feature (209)..(209): n is a, c, t, g, unknown, or other
  misc_feature (259)..(259): n is a, c, t, g, unknown, or other
  misc_feature (415)..(415): n is a, c, t, g, unknown, or other
agtggatcccccgggctgcaggaattcgtctcacccctanaaaaaaacgcaagctcaaacacgagcgatccgatccgatccggaactgtgccggccagccctggctactaaggttttgctcaccgccctcctcctcgccttcctcctcgtcgccacccctttccccgcccgagttgctacagctgattcggaggaagatgctgncncanctgaagttgttgaaggggctgatctatgaattgtgcgtgatgatgcacangtttcctgagatgcacctttaagccctgctcctggtgtagcaacagcaggtgtattccacctacatgctggcaaaattgtactatccggtgaacaaactgaattactagttgggtctgccccatgagggtgaatcgacttcgaatgtcgttgctgntcgttcaactcttcctctttcttttgcaccctccaatgtatgggccaacaccttaccgtttcaaaattccttcaaaaaatcatgccatggttcctggtggaggcacaatgccgacctaagttcccctgttaacaccctttttgaagacggccgcatatgaacgcatttcgggccctaatggaattatttcgaaccacgccccttaggggt

SEQ ID NO: 67655 - protein, 78 aa, Zea mays
  misc_feature: Ceres CLONE 1542523
  misc_feature (13)..(13): Xaa is any aa, unknown, or other
  misc_feature (68)..(68): Xaa is any aa, unknown, or other
  misc_feature (69)..(69): Xaa is any aa, unknown, or other
  misc_feature (70)..(70): Xaa is any aa, unknown, or other
VDPPGCRNSSHPXKKTQAQTRAIRSDPELCRPALATKVLLTALLLAFLLVATPFPARVATADSEEDAXXXEVVEGADL

SEQ ID NO: 67656 - DNA, 787 bp, Zea mays
  misc_feature: Ceres CLONE 1542526
  misc_feature: Encodes the peptide sequence at SEQ ID NO. 67657
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnnnnnnnnccccggaaaccccccccctttttnnnnnnnnnnaaaacnnnnaaaaactggagctcaccgcggtggcggccgctctagactagtggatcccccgggctgcaggaattcgtctcacccctagaaaaaaagtcgtgctcgtcttcgtccacctcccgacccgactgagtagcaagcaattctccaaattagggtttctttccgcttgctttccagtttgcgggatcagtcggtggcgcctgcaatggagtctctgttcggccaatcgcagcggatgaggagggcgggcggcagcggcttcgaatcgctcaagcgactggggcacatctcacccgctggggaggccaacctcaaaactggggtacctctccctatggcccttccctggccttgtccgctttcggacttttttcctcccccatccggggggggggggggggagggggtccctccaccaaccttgggaatgcctgttgcccccccgggcgaccgtaccttcatactcctcctgacccggctttcctcgagggggcaaggaaaaatgacaacccttttttcgggcccgggccccccggggtaaggcccttagcacccccttccaaactcttcgggaacatcattgggtacccgaaccccctcgtgaccggcgggtccataaattgcctaagacttcccccacatgagttcccgcgatcgtcagaacttgtgccttcccgtgttccccccccgtggcggcattttctgcaataaagcttcggtagagaaaaccctccccgctct

SEQ ID NO: 67657 - protein, 111 aa, Zea mays
  misc_feature: Ceres CLONE 1542526
MESLFGQSQRMRRAGGSGFESLKRLGHISPAGEANLKTGVPLPMALPWPCPLSDFFPPPSGGGGGEGVPPPTLGMPVAPPGDRTFILLLTRLSSRGQGKMTTLFSGPGPPG

SEQ ID NO: 67658 - DNA, 654 bp, Zea mays
  misc_feature: Ceres CLONE 1542530
ggagctccccgcggtggcggccgctctagaactagtggatcccccgggctgcaggaattcgtctcacccctagaaaaaattcaggcaacgttgttttttgtgccgccgtcgcaggcgccagctgacgtcgtcctggacattccggatcagagaatatgctggtgaaaaagatgcgccataaccgtcccatcccctaatgaatccgcttgcgccctgacaatgccatctggtgcaacgcctagcgcaggcactggccccgctccaagctcggcttctgcgcgtcaggattggccggctgctgcttcggaaggctagacgtctcgaagctatcttctgtattcaacaatgtctctgtttctgaaccctagcaagtgatgctctgatgcttttattaatgttctgatgagtggcccacccccagagaaaattgcgcagtactgtgttggacctcaccattccttgcaatattgctatgctcagtaacggatccttcttcttattatctatgtagtgttcccggctaatgttaaatgtagacgttaatcgctgcataaaagccagaacataagacgcttgaggcccccgattccccctatcgttacccctattaggcgcattgcccggtatgccgttttcaactgcccggccttggaa

SEQ ID NO: 67659 - DNA, 648 bp, Zea mays
  misc_feature: Ceres CLONE 1542531
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaatcctggatgttcattggtcaatgacgatgctgcactgctgcagctcgggtagtttttgctaagctggaggtgcagcagacaagacaacaagcaagaggaggcaactaaggagtagtactatatactgatgccactaacactaagcaagagctcggttgaggaagctcatggatctcgttgtaccgaactatctcaaaaacatagtgcatgtttgtctggatagctgctcggccacaggcacagagcgtgtttggacgcagattcataggcctgtaaagcaaacacgtcccaattatctgaactcggaattattgacgccttggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaat

SEQ ID NO: 67660 - DNA, 650 bp, Zea mays
  misc_feature: Ceres CLONE 1542532
  misc_feature: Encodes the peptide sequence at SEQ ID NO. 67661
  misc_feature (207)..(207): n is a, c, t, g, unknown, or other
  misc_feature (209)..(209): n is a, c, t, g, unknown, or other
  misc_feature (212)..(212): n is a, c, t, g, unknown, or other
  misc_feature (463)..(463): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (504)..(504): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (626)..(626): n is a, c, t, g, unknown, or other
  misc_feature (631)..(631): n is a, c, t, g, unknown, or other
  misc_feature (632)..(632): n is a, c, t, g, unknown, or other
  misc_feature (646)..(646): n is a, c, t, g, unknown, or other
  misc_feature (648)..(648): n is a, c, t, g, unknown, or other
aaagtggagctccccgcggtggcggccgctctatcctagtggatcccccgggctgcaagaattcgtctcacccctagaaaaaaaaatccaccggtatgacggccccatcttccgctccgacgatcccggggactttccagtaagtagcagcctcaagcaccaattcgtctctctgcctaagttaccaagggcaccccagttctggcncntgnaaagaggcaagtttagatttaggtgagaacctaacgagccttccgagatcctcttagggaagcccagagcgaattggcgccggcggccgctcggcctttcccttgtgtttggggtgtggcccccagcctatattccccgttgtgttcctcaaagggttttttcccccccccaaaaaaaaaaacaaaacaaaatttttttagatagagggaagaaaaaaacttttgtgggcctttaaaaaaccccccccccncnnnnncccnnnnccccnnnnnnaatnnnnnaaaatnnntntgnnnnnggaannnnnnnnnnnnnnnnnnnnnnnnnnnnnnnnaagggggaaattgaannnnagctatcnnncttcacctcnnntagtgannnnnggnnnnnnnnnnnccaaannnctgagnagggnnccatattcatatananaa

SEQ ID NO: 67661 - protein, 78 aa, Zea mays
  misc_feature: Ceres CLONE 1542532
  misc_feature (69)..(69): Xaa is any aa, unknown, or other
  misc_feature (70)..(70): Xaa is any aa, unknown, or other
  misc_feature (71)..(71): Xaa is any aa, unknown, or other
KWSSPRWRPLYPSGSPGLQEFVSPLEKKIHRYDGPIFRSDDPGDFPVSSSLKHQFVSLPKLPRAPQFWXXXRGKFRFR

SEQ ID NO: 67662 - DNA, 635 bp, Zea mays
  misc_feature: Ceres CLONE 1542535
ggagctccccgcggtggcggccgctctagaactagtggatcccccgggctgcaggaattcgtctcacccctagaaaaattgatggtacgtgctactcggataaccgtagtaattctagagctaatacgtgcaacaaaccccgacttccgggaggggcgcatttattagataaaaggctgacgcgggctctgcccgccgatccgatgattcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatccctgttccctatgtttctgcttaaaaaaaaaaaaaaaaacgagacgctcgaggtacccaattcgccctatagtgagtcgtattacgcgcgctcactggccgtcgttttacaacgtcgtgactggggaaaaccctggcgttaccca

SEQ ID NO: 67663 - DNA, 636 bp, Zea mays
  misc_feature: Ceres CLONE 1542537
  misc_feature: Encodes the peptide sequence at SEQ ID NO. 67664
  misc_feature (636)..(636): n is a, c, t, g, unknown, or other
agtggatcccccgggctgcaggaattcgtctcacccctagaaaaattggtgatatacggacacagcataaaagcagtagaactactattgatgtcaccgttgatagtgattctaaagtgtcgaccacagtcactgttgatgaagcactaactggtttgaagacttcattcgccttcaaggtccccgatcacaagtctgggaagcttgatctgcaatatgcgcacaatcgtttttcattgaactcgaccattggtttgacaacaacacctttggttgacctggctgcccctgtccgcccaaatgaacttaacattggcgctgaggttggatttgatagtacttgagctgcggttactaataaactctcatgaattgcacacaacatattcgatttctccccttccttacaactggctgataaaggatagactttgaacgctacttacgtttcatttgttctaccccaccaatggaacctaccgtttgcactccaaggcaaaaccacaactctggtgaaccagaagaaaaacaatttcccacctgggcgaagctcccaatgtccccttgattcctttccacatttgtttatatcaccaaaaatttaaataacctcctgcggaaacgcccgagtctttn

SEQ ID NO: 67664 - protein, 113 aa, Zea mays
  misc_feature: Ceres CLONE 1542537
WIPRAAGIRLTPRKIGDIRTQHKSSRTTIDVTVDSDSKVSTTVTVDEALTGLKTSFAFKVPDHKSGKLDLQYAHNRFSLNSTIGLTTTPLVDLAAPVRPNELNIGAEVGFDST

SEQ ID NO: 67665 - DNA, 745 bp, Zea mays
  misc_feature: Ceres CLONE 1542538
  misc_feature (51)..(51): n is a, c, t, g, unknown, or other
  misc_feature (52)..(52): n is a, c, t, g, unknown, or other
gcgtacagaaatagataacataaactcatctaactcccatccccccccttnnaaaaaaactggaactccccgcggtggcggccgctctatactagtggatcccccgggctgcaggaattcgtctcacccctagaaaaaccacccaccaacccaccatccccgatcgcccttggagatggagatggtcggcggcagcgccgacgccatccccggcctcttgtcatacggctgggccgggctctggtccaagctggcgagcctcctgttcctgtggaccatggtgcaggaccacctccctttccagctcgaggagcagctgtccgcactggcgcgccgcgccctccccgccatcaccccctacgtccccatcaccactcgacgagcacgacgccgactccttcggccgcagcgaggcctacctcgccgcgaaagcctacctgggcgccaccttcgccggccgcgccagcaagctcctcgccgagctcccgggcggacacccaccgcttcagcctcgaccgtcgacgacccacgtcgaggtcccccgaccgcccttcccgcggcgccacaaatgctggtgaggagcaagcactcagcaactcctccgcccccggatcaaccccgattcgatttggcaactccgccgggaaaggacaaatcatcccccgaccttactggccctcacccctttcccatccgaacagaacaaccaaacgacggcctcctatccaagcacccggcccttact

SEQ ID NO: 67666 - DNA, 858 bp, Zea mays
  misc_feature: Ceres CLONE 1542539
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (826)..(826): n is a, c, t, g, unknown, or other
attgcacaagttttcaatacccacaaacaaaaaaannnnccccaaattatataaaactggcactccccgcggtggcggccgctctagaactagtggatcccccgggctgcagggattcgtctcacccctagaaaaaaccctacccagtcacagtctcacgctactatccgctatctagagctaccgccgtcactgacaggagctagaactatatctgccgggaacaagaagaaggaggaggaggagaagatgagggcgtccgcgctggtctgcttcgtggcggtgtcggcgtgcctaacgtgcaatcgcgcatggtggcaacttctaccttgacacggagatgacctgggggcatgggcctctgcaaggtggtagaaccgctgttcgccggcttgtaccttgaaacatggacaagaacctcccggttcctggttcccaatctcgaggaagaagtactctgttccgggaaggatcggagtatggccccaccgaaaactgggtgccctggctaaaatcaggcggggaaggcccgaaggaaagcccatatgataacttggtctaattaaaaggggctggaccccctcgcccaacgaacgtatcgaacccgtagaggtgtcataggggcgcaaagtcggtaaggtgcgcagaaccccataaacgccggggcaccaaaggaaaactggggctgcagtagcggaggggggacgggagttaaaatccggggatacactgcaacacttttaggcaccccttagagttcccgccaacgccctatttgtcccgaactttttctacttatatcaacatcttcggtggattgtatggnatataactgtaaggagtcaaaaatcatatgtg

SEQ ID NO: 67667 - DNA, 623 bp, Zea mays
  misc_feature: Ceres CLONE 1542540
  misc_feature: Translation starting site: 111
  misc_feature: SWISSPROT Homolog: EC 3.2.1.23 Beta-galactosidase
  misc_feature (623)..(623): n is a, c, t, g, unknown, or other
agtggatcccccgggctgcaggaattcgtctcacccctagaaaaaaaaaaaccctagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagtacggattaccttgtgcctatgttcattaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacn

SEQ ID NO: 67668 - DNA, 702 bp, Zea mays
  misc_feature: Ceres CLONE 1542543
  misc_feature: Encodes the peptide sequence at SEQ ID NO. 67669
  misc_feature (16)..(16): n is a, c, t, g, unknown, or other
  misc_feature (26)..(26): n is a, c, t, g, unknown, or other
  misc_feature (29)..(29): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
ttattttttttttttnccacgttttnccncggccggtagggnnnngggggggnnnnngcaaactgagactccccgcggtggcggccgctcttcaatagaggatcccccgggctgcaggtacccgtctcacccctagaaaaaatccactcccgtcgtcctggactcgcagttcatcctcgacccaccgaagctcaatggccacgttcctgggaagctcaccggcgctcctcgctcgtcccattgccaagccgcacatctcctgcgcgcagacaccgcgcccggcaattgcccagaaccagccgccgtccagcgagcagccggaaccacagaaacagcggcactccgtgcaagcgcagccacagcaagcggcggcggcggcgaggccgaagcacgcgggcgtcgcggactccactgactggatagcctcggcggtgaacgcggcggcccggaatcggggagggggctggcccgagccggcttcctggacgcccgccgtcgtggcggagcagctcaagaacccccttcgagggcgcgcaggatcaggccaactcccatggacgtggaaccaggggcccaaggttcttgtggcccccggggatcccggtcctgctgaaattaccgtccgggggggggcaaacttcccctggagcggggcgaccctcgagggaaaccgacccgtccgggccccgggggggctgggat

SEQ ID NO: 67669 - protein, 169 aa, Zea mays
  misc_feature: Ceres CLONE 1542543
MATFLGSSPALLARPIAKPHISCAQTPRPAIAQNQPPSSEQPEPQKQRHSVQAQPQQAAAAARPKHAGVADSTDWIASAVNAAARNRGGGWPEPASWTPAVVAEQLKNPLRGRAGSGQLPWTWNQGPKVLVAPGDPGPAEITVRGGANFPWSGATLEGNRPVRAPGGLG

SEQ ID NO: 67670 - DNA, 696 bp, Zea mays
  misc_feature: Ceres CLONE 1542549
  misc_feature: Encodes the peptide sequence at SEQ ID NO. 67671
aaagctggagctccccgcggtggcggccgctctagaactagtggatcccccgggctgcaggaattcgtctcacccctagaaaaactttttgcgccgccgcagccccaaaccctcatcccccatcaacctcaggggtgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaggaggaagagaagtgggttcccgtcaccaagctcggccgccttgtcaaggagaacaagatcaccaagatcgaggagatctacctccactcgctccccgtcaagggagcaccagatcgtcgagaccctcgtccccgggggctcaaggacgaagtcatgaagatcaccgcccgtccaaaaacagaacccgtgccggggcagcgcactccctttcaaggcccttcctcgttttccggcgaagggggaaaggcccacctccggcctgggggaactcaaggggccccccaaggaggggggccaccccgccctttcgggggggggcctatcatttccctaggccaaaggtttctccccctttttttcccccggttaagggaaaaagggggtctctgggggggggaaacaaaaaatag

SEQ ID NO: 67671 - protein, 175 aa, Zea mays
  misc_feature: Ceres CLONE 1542549
MAERGGERGGERGGFGRGFGRGGRGDRGGRRGGRRGPRQEEEKWVPVTKLGRLVKENKITKIEEIYLHSLPVKGAPDRRDPRPRGLKDEVMKITARPKTEPVPGQRTPFQGPSSFSGEGGKAHLRPGGTQGAPQGGGPPRPFGGGPIISLGQRFLPLFFPRLREKGGLWGGETKN

SEQ ID NO: 67672 - DNA, 773 bp, Zea mays
  misc_feature: Ceres CLONE 1542553
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (385)..(385): n is a, c, t, g, unknown, or other
  misc_feature (386)..(386): n is a, c, t, g, unknown, or other
gctctagaactagtggatcccccgggctgcaggaattcgtctcacccctagaaaaaatacgaggccgtcttctcctctgtcagaattcggaaacacaccaaagctagcctccgctccctccccttccagcttcgtctagacagagtccagcagacacggccaacagttaaaaccggttgctattagtacgcgcccgccaccacgctcgcacagacacagacacacacacacacacacactcaacagcaacagctaatcctctcccacaagagagcaacatggctgaggaagaggtctttaatgtggaggtggaggtcatcaaggatccctttttttccccccaccccccggggaaaagaaaaggagaannnttctcttccccccnncctcccccccccttaataaaaaaaaacaaaataaacttattccggggggcgggggcgttctcccacacaatcttttcacatgcattctcgcccctccatcaagcctccccccccggtgaaattcatggggtaacccagctgtctctcgctccctcccgctctctccacatagcgtccgagactcccgaaattgtaattccttcttcttcccctttttccccatacaaatctcgtgtcacgggccgccttacaccgttagctgcggtctggaactcttgcatcctacctctctgccttcgcaacctgctagatccctttccatagtgacgtattctggctacctaatgttctaggtaccgatcgtcttaaccacttagacaccacttc

SEQ ID NO: 67673 - DNA, 660 bp, Zea mays
  misc_feature: Ceres CLONE 1542556
  misc_feature: Encodes the peptide sequence at SEQ ID NO. 67674
aaagctggagctccccgcggtggcggccgctctagaactagtggatcccccgggctgcaggaattcgtctcaccccctagaaaaagtacgtccaacaataatccaacaatggaggccgcggaggagcggccaagaagacgccctgccggcctcggcgtcctcgccctactctgctcgtcgttgcttcttaacgtgctcttcctcgcgtactactacttcctctcgccgccgtcccagcttgccgatggtggcagctgcgggctgagctgggcgctgcgggcggccagggatgccgaggcgttggccgccacggacagctgctccggccacgggcaggtgttcttggacggcgtcgtcggcgaggacgggcggcctgggtgcgagtgcaatcgctgcttcgacgggccgcactgctcgatccgaacacccaactgcactgccgatgctaccagcggggacccgttgttcctggagccctactggaagcggcacgcggcggccagcgccgtgctagtgcccggatggcatcgtctgagctacgccaccaccgacggcctcttccaatccgtcgagctcgagaaccacatccggcggctgcacagggccgtcggcaacgcagtcgtggacggcaagcgcttggtgttcggcgccggctccacg

SEQ ID NO: 67674 - protein, 184 aa, Zea mays
  misc_feature: Ceres CLONE 1542556
  misc_feature (52)..(109): Pfam Name: EGF_alliinase Pfam Description: Alliinase EGF-like domain
  misc_feature: SWISSPROT Homolog: EC 4.4.1.4 Alliin lyase
MEAAEERPRRRPAGLGVLALLCSSLLLNVLFLAYYYFLSPPSQLADGGSCGLSWALRAARDAEALAATDSCSGHGQVFLDGVVGEDGRPGCECNRCFDGPHCSIRTPNCTADATSGDPLFLEPYWKRHAAASAVLVPGWHRLSYATTDGLFQSVELENHIRRLHRAVGNAVVDGKRLVFGAGST

SEQ ID NO: 67675 - DNA, 627 bp, Zea mays
  misc_feature: Ceres CLONE 1542558
  misc_feature: Encodes the peptide sequence at SEQ ID NO. 67676
ggatctccccgcggtggcggccgctctagaactagtggatcccccgggctgcaggaattcgtctcacccctagaaaaatgcagaaaaccattctcgagagaaaaggacccccaacatttttatgcgctgttgagatgatatcgaaaactgaatgtcgagttcatcacaggttagatgccacagtggatgctattcttgcagggaagcctcctaagtttgaagctcgcaagatgcataataagtctaccgagtttgaaatgccgttggtgatacctgatagagagtatgaaatagaatcactgccactctatcaggaagttatggtcacgaggtcattatcatcagatggcaacttcagcaatgattttgctgcatccaggcaaacaaaaagcaagagtatgccatcagaagataattttggtgatagttttgtttacacaaggaaagcaaaagggaataaacctgtgcatggaaagtctctagtccaagtatacacataccagatttcagaagctgatattttacaagtagcaacaatgatgggatttgatgatgaactagatgtaacagatgacattggagcagctgatgtgattcttgcatcgagttctgaaatgaagcagaatc

SEQ ID NO: 67676 - protein, 183 aa, Zea mays
  misc_feature: Ceres CLONE 1542558
MQKTILERKGPPTFLCAVEMISKTECRVHHRLDATVDAILAGKPPKFEARKMHNKSTEFEMPLVIPDREYEIESLPLYQEVMVTRSLSSDGNFSNDFAASRQTKSKSMPSEDNFGDSFVYTRKAKGNKPVHGKSLVQVYTYQISEADILQVATMMGFDDELDVTDDIGAADVILASSSEMKQN

SEQ ID NO: 67677 - DNA, 644 bp, Zea mays
  misc_feature: Ceres CLONE 1542562
  misc_feature: SWISSPROT Homolog: EC 3.2.1.23 Beta-galactosidase
ggatcccccgggctgcaggaattcgtctcacccctagaaaaatattttgtgcaccttcctttcaagcaaactattctgtatgtaacggtgggtgcccatgaaattgcgctggtgctccaccatcgttgtatatgctgcatcttgagttgcttgctgtagctgaagggaagttcattctgtacgttttgagtatgagttttgtatatccgtatatgcctatgactatgagccgtgctggaacactatgatcagaaactgcgaaatggagcccagaatgttcttgtcaaaaaacaacataaaaaccagacgctcgatgtacccaattcgccctatagtgagtcctattacacgcgctcactggccgtcgtattacaacgacgtgactgggaaaaacctggcgttacccaacttaatcgccttgcaagaattccccctttcgccagctggcgtattatctaagaggcccgcaccgatcgccctttcccaacatttgctcatcctgtaatggcgattggaaaatttcaagcctctattatttttgtttaaaattcgccgtaaattctttgttcaaatcccgctccattttttttaaccaatgatgcccgaaatcccgccaaatttcccctttattatattctaaaaga

SEQ ID NO: 67678 - DNA, 704 bp, Zea mays
  misc_feature: Ceres CLONE 1542563
  misc_feature: Encodes the peptide sequence at SEQ ID NO. 67679
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
tgggttgtggttntnnccccccctccccccgcataagggnnnnnnnannangtcatagctggaactccccgcggtggcggccgctctagactagtggatcccccgggctgcaggaattcgtctcacccctagaaaaacgtgcagcgagcgcactccgaccatcgccatgtcgaggcgcggcgactgggtctacgagaacaacggcgggacctgcgtggccatcgccggcgctgattactgtgtcgtcgctgcggacacccgcctctctgtaggatacagtatcctcacgcgtgatcactccaagatctgcgacctggctgacaaatgtgtactggcatcttctggctttcaaggtgatattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccaagtcctggacaatccactaaaaatcaccaaggtccctctatttactcccctgtcagggaatgctggtcacaccatttgtccggaa

SEQ ID NO: 67679 - protein, 179 aa, Zea mays
  misc_feature: Ceres CLONE 1542563
  misc_feature (10)..(174): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPSPGQSTKNHQGPSIYSPVRECWSHHLSG

SEQ ID NO: 67680 - DNA, 790 bp, Zea mays
  misc_feature: Ceres CLONE 1542567
  misc_feature: Encodes the peptide sequence at SEQ ID NO. 67681
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (145)..(145): n is a, c, t, g, unknown, or other
ttgagttggtggggtggtggattccacaccaatattaaagncaaaannnnnnnnnnngtggagggcacggggaggggggcgcgcggtttctctcccacccccgagcagaaggaattctcctcacccccagaaaaaagaggaaganaagagatgtgctgaagctgaacggtggccatgcccaccggacgcacagaggaggccgccgggagcgcggagacggcgtgcgtgacgggcgccggcggatacatcgcctcgtggctccgtaagctcaacctctcacggggctacaccgtcgacagcaccgtaccacgatcttcatcgataataagcgcggtcatctgaaccggataaagaatggtttcgcacaacctccaggttctttttagctagaagaacctggagcacgaccacctgggtatgttttttcccccccgataaaaaggggggggagcagcagcatcaacttcccgtgattggtttggtgccaccccccccacaaaaccccaagagatgagtctgccaaggatcccccccggtaaaatcaacacacactaagagaacgattgaagggctcgacaagaacatccacataagcgacatacccaacataaaaatacaaaataacaaacatataataaacaaatcacgacaatccaatcaatcgcacataatcccaccaaagccgcacccacaggatttacagatttacccagttgggtcagtgctcccgcatactcaacccctatcgcgcccaaagcgggttggggaactagtgccacttctcatgtta

SEQ ID NO: 67681 - protein, 55 aa, Zea mays
  misc_feature: Ceres CLONE 1542567
  misc_feature: SWISSPROT Homolog: EC 1.1.1.219 Dihydrokaempferol 4-reductase
MPTGRTEEAAGSAETACVTGAGGYIASWLRKLNLSRGYTVDSTVPRSSSIISAVI

SEQ ID NO: 67682 - DNA, 827 bp, Zea mays
  misc_feature: Ceres CLONE 1542569
  misc_feature (29)..(29): n is a, c, t, g, unknown, or other
  misc_feature (37)..(37): n is a, c, t, g, unknown, or other
  misc_feature (827)..(827): n is a, c, t, g, unknown, or other
tttggttgtgtttggtctcttttttattnaccccacncgccaacccccccaaacatggaactcccgaggaggcggccgctctattttagtggatcccccgggctgcagagattcttctcacccctataaaaaatcctcccgccgcggcgacgccttcccctccctccttcctccgtcccatgctccgccgctgacacgttcgcccgacttaaccttacgatggccgccgccgcctccgccatcaccgccgtctacggagttgtgtttcccctaatcttcctatcccaccgattgatgataccgtaggacctaacccgtggccctcctcattccgaccggttctccttggggaacttcccttcaacaaattctcttctttacttcctccgccgctaatgccagcggcaaaagctgggataaaccaggaccctgaccctggctttcacgggaagtcctcaattatgaaggtgggacataactaccccccccctccattgtggcggagaagcgatgtactataaccccaatttcctacagttaagataatctgcaacaaaggtccacgattccccgagtaaacatctaatgtgtctaattccataacacaagcgctgtgttacgagagcgggagggatctagacaatcgtgctctcttatatattatcccccgagaaccttcaaacaactttttgtataaattactcatttcatcaccataacaaaaatatacgtccataccacataaaaatgtaatagtggaccctccacctgtcgtgaattatacaaatcaccaaaataacccataaagatataggagaacatacacn

SEQ ID NO: 67683 - DNA, 831 bp, Zea mays
  misc_feature: Ceres CLONE 1542572
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (82)..(82): n is a, c, t, g, unknown, or other
  misc_feature (195)..(195): n is a, c, t, g, unknown, or other
  misc_feature (253)..(253): n is a, c, t, g, unknown, or other
  misc_feature (328)..(328): n is a, c, t, g, unknown, or other
  misc_feature (329)..(329): n is a, c, t, g, unknown, or other
  misc_feature (334)..(334): n is a, c, t, g, unknown, or other
  misc_feature (352)..(352): n is a, c, t, g, unknown, or other
  misc_feature (359)..(359): n is a, c, t, g, unknown, or other
  misc_feature (362)..(362): n is a, c, t, g, unknown, or other
  misc_feature (372)..(372): n is a, c, t, g, unknown, or other
  misc_feature (373)..(373): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (444)..(444): n is a, c, t, g, unknown, or other
  misc_feature (447)..(447): n is a, c, t, g, unknown, or other
  misc_feature (448)..(448): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (479)..(479): n is a, c, t, g, unknown, or other
  misc_feature (520)..(520): n is a, c, t, g, unknown, or other
  misc_feature (831)..(831): n is a, c, t, g, unknown, or other
nnttcccttccnnnacgcaccgagaactccccncnntggccgccgctctaaactagtggatcccccgggctgcaggaattcntctcacccctagaaaaaaccaacacaaagccaaagcgcagcgcagccagagtaagcagagagttgcacttggggaaaaattaccgtgcttcttcagttcttcgggggaggtgnactcgcttgtgaggcgtggcaatggctacggctacggctatggtggttaccgcagcancaatccccatatgaactaccaccgccaaaacaccgagtccgtgaccacccttcccccaggagaggaggcgaatgnncctcnacaatttttttctgctancggcggnggnttgtaaaaannattttttttttcccccccccccgggggggagggggggggnnnnttnnnnnnnnnnnnnnnnnnnntnntnnaannaaaaaaaaaaaaaaaaaaannnnncaccttnggtgggggggggcctcttcttccttccccccctccacaaancatttctcctaaaatatttttttatttatccaccatccatcaaaaaaactccctcctctcctacattcactcctccctccctcccccctatcccttacaacacccctcccccttctcccaaaacaccatccctcatctccctccacatctctttccacttctatctccatacataccctcttcctccccatcttctccctccctccatccccccccactcctcaccataacacacctcaatccctctcctctctcacttttattaactcacttccaccctctcccccatataccacccccctctcccatcn

SEQ ID NO: 67684 - DNA, 649 bp, Zea mays
  misc_feature: Ceres CLONE 1542573
  misc_feature: Translation starting site: 149
  misc_feature: SWISSPROT Homolog: EC 2.3.1.162 Taxadien-5-alpha-ol O-acetyltransferase
accgctggagctccccgcggtggcggccgctctagaactagtggatcccccgggctgcaggaattcgtctcacccctagaaaaactactacaaccagaagttgctcctgtaccgcgccgcccccgactttccggacgccgtggcgcgcatgacggccgcgctcgccgacgcgctccgcgtcttctacccgctcgccggccgcatccgccaggacgacgacggcggcgcgctggcagtcgagggcgacgagggcgccgaggtcttcgaggccgaggcccagggcgtcgccgtcgacgacctcgccggatgggactgcagcgacgaggcggagaaggtcttgcagcacctcgtgccctactccggcgccctcgaactggggggggcggcgccgcccgcttctcgccgtccaattcacaaagctcaaggacggtctgggggtggggtgcgccttccaccacgcggtgctggacggccccccacgtggcacttcatgtcctcatgggccgaagtctgccgcggcgtacccctgtccctgcaccccatccccgaccggtcccctgtcccgctccctgcgcctggcgactggagctcccggcctccccccgaggcccccgataaagaccggccccaaccgggccccaaaaaggcc

SEQ ID NO: 67685 - DNA, 752 bp, Zea mays
  misc_feature: Ceres CLONE 1542574
  misc_feature: Encodes the peptide sequence at SEQ ID NO. 67686
  misc_feature (10)..(10): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ggtgggggcntttcccttnnnnnnaannnnnnnnnnnnnagggaaannnnnagaagactggagctccccgcggtggcggccgctctatactagtggatcccccgggctgcaggaattcctctcacccctagaaaaaagccgccgccgctcttccacctacctctccccggcctcgcacccatggccacggctttgatggttgcagccaccacctcctgctccccgggccgcgccgcgccacgcctgaagccggtggcctcctcctcctccagcagcagcagcagcagctcggcgcggccgcggcggcccttggcgcagcagctcccgcggctgctggctacggcggcggcggcggcggaagcacccgcgccgctcccggtgctgggggaccagaaggagaaagccgcactgtttgacttccccctgacgcgcggggggggggggaaccaaatccctgctgctcatgcccccccctggaaaagctccaatacacgcccgctaggctagttcatggatgaattcgcaagcccaaaaaccccccggcgacccccgggaaatatccaagggcaccctcccaagggaggtgaaagtccgcctggagggaaacaggtcggcgggcccatcatcaaaaggtgggccgcgcccctcgaccaaatatagagtaggacgttttaacctgtgagggaataaagcggataccccccgcgccgctaattcctgccaagccccacgctatggtacccaatgtgatc

SEQ ID NO: 67686 - protein, 108 aa, Zea mays
  misc_feature: Ceres CLONE 1542574
MATALMVAATTSCSPGRAAPRLKPVASSSSSSSSSSSARPRRPLAQQLPRLLATAAAAAEAPAPLPVLGDQKEKAALFDFPLTRGGGGNQIPAAHAPPWKSSNTRPLG

SEQ ID NO: 67687 - DNA, 755 bp, Zea mays
  misc_feature: Ceres CLONE 1542577
  misc_feature: Encodes the peptide sequence at SEQ ID NO. 67688
  misc_feature (20)..(20): n is a, c, t, g, unknown, or other
tttttttgttgagggccggncacatatttttcccttaagctcatttataataaaacaggaagtccacgcggaggcggacgctctattctagaggatcccccgggctgcaggaattcgtctcacccctagaaaaaaaaagctagcttatttcccttcccttcacgcggcatgcggcggccggccttccgccgccatggccaccaccaccgcgcccgtcctcctcgtcttcctcgttgccattgccacgtccgtcgccccctcattccccatcctgacgatggcggcggacgcggacaacggcaccacccacctgagcttcttcatgcacgacatcacgtcgggcgccagcccgaccgcggtgaaggtgatctaggggcccggcgcgcgggccaccccgacggcgccggccctgggcatgacattcggcgacaccatggtgatcgaccacccgctgacggagtgacgcccccccccgcgtccgccgcgactggatcaattgcaaggacttactaatgctgggcgtcaccaaacggggacggccctttaagggtgtgccgccaaccctcgctggcctcccatccggggggccccccaatggggtaccccgcccccccccgagattagggatcgcaaacgaacactcggtgctaaagaagttcccgggaagaaaccccccgtccagagcggcagagcaatccgaggaaaccgtcacccgcgaatgtggcccgcgcgagaataaccgtggcctgtggacg

SEQ ID NO: 67688 - protein, 59 aa, Zea mays
  misc_feature: Ceres CLONE 1542577
MATTTAPVLLVFLVAIATSVAPSFPILTMAADADNGTTHLSFFMHDITSGASPTAVKVI

SEQ ID NO: 67689 - DNA, 647 bp, Zea mays
  misc_feature: Ceres CLONE 1542578
  misc_feature: Encodes the peptide sequence at SEQ ID NO. 67690
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (397)..(397): n is a, c, t, g, unknown, or other
  misc_feature (400)..(400): n is a, c, t, g, unknown, or other
ggagctccccgcggtggcggccgctctagaactagtggatcccccgggctgcaggaattcgtctcacccctagaaaaactagaaaatgatgtcacaatgtgaggtgttcaactgtgtctaactaataattattgtcttctcctatttgttgtacaggaaaagatagaatggaactcaaattttggtggttacactggtgtggagacttgaattcatgtatacacttagttagactcaatgttagtgcaaacagttgatgaccaagttttttaattagtattttagtttggatgtatagtacacttatgtatgagttatttgacaatgcttatttatgagatattgaatgacacttgtctatgttatattaattataatgttattcnnttcnccccanaanaaaaaaaaaacaaaaaaaaataaataaaaaaaaaaaaaaaaaaaaaaaaaaaaaaaaaaggaaaaaaaaaaaataacccgggcccctcgaggaacccatttccccctaaagggagccgaattaccccccctccctggccgtctttttaaaacctcgggacgggaaaaaccctggcgttacccaatttaatccccttgaaaaaaatccccctttccccagttgggttaataccaaaaagccccccccc

SEQ ID NO: 67690 - protein, 33 aa, Zea mays
  misc_feature: Ceres CLONE 1542578
GAPRGGGRSRTSGSPGLQEFVSPLEKLENDVTM

SEQ ID NO: 67691 - DNA, 990 bp, Zea mays
  misc_feature: Ceres CLONE 1542583
  misc_feature: Encodes the peptide sequence at SEQ ID NO. 67692
aaaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaacagaaaaaaaaaaaaaaaaa

SEQ ID NO: 67692 - protein, 252 aa, Zea mays
  misc_feature: Ceres CLONE 1542583
  misc_feature (30)..(215): Pfam Name: Ribonuclease_T2 Pfam Description: Ribonuclease T2 family
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAMDN

SEQ ID NO: 67693 - DNA, 700 bp, Zea mays
  misc_feature: Ceres CLONE 1542584
  misc_feature: Encodes the peptide sequence at SEQ ID NO. 67694
ctggagctccccgcggtggcggccgctctagaactagtggatcccccgggctgcaggaattcgtctcacccctagaaaaaaatctcccccttaacaactccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacgggactgaggacgaaccgggccaccgagtcgggatactggaaggcgacgggcaaggacagggagatcttcaggagcaaggccctcgtcggcatgaagaagacgctcgtcttctacacgggggagggcgcccaggggaggcaagaccggctgggtcatgcacgagtaccgccttcacggcaaggacgccagcagcagccgcctcatgccgtcttcggtcaaagctggcgcgtcaaaggacaagg

SEQ ID NO: 67694 - protein, 161 aa, Zea mays
  misc_feature: Ceres CLONE 1542584
  misc_feature (13)..(132): Pfam Name: NAM Pfam Description: No apical meristem (NAM) protein
MEHDVHHQQAMELPPGFRFHPTDEELITHYLARKAADARFAPRAVGEADLNKCEPWDLPSRATMGEKEWYFFCVKDRKYPTGLRTNRATESGYWKATGKDREIFRSKALVGMKKTLVFYTGEGAQGRQDRLGHARVPPSRQGRQQQPPHAVFGQSWRVKGQ

SEQ ID NO: 67695 - DNA, 739 bp, Zea mays
  misc_feature: Ceres CLONE 1542589
  misc_feature: Encodes the peptide sequence at SEQ ID NO. 67696
  misc_feature (1)..(1): n is a, c, t, g, unknown, or other
  misc_feature (17)..(17): n is a, c, t, g, unknown, or other
  misc_feature (18)..(18): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (739)..(739): n is a, c, t, g, unknown, or other
ntttttttccattttgnnttggccgccttaacacccaaagcgcgannnaaaggaaggagacaaaggatgcggcaaacgatttttttcccccccatccacgggctgcaggatagtcctccccctacaaaaaatcgtgaacagtctaaaatttccaacgaaagtcgtacgagcctgcgagtgctaactgctaaaactgcaatggcggccgcacgcgagctgcagctgctgagctcatggtacagcccctacgtgatccgcgccaaggtggcgctggggctgaacgggctcacctacgagttcatcgaggaggacctcttcagcaagagcgacctgctgctggagctcaacccggtgcacaagaaggtgcctgtcctgctccacggcaggccgcccccgtgtgcgagtttttttgccatccccccaatagggggggggagagactcgaccaacacagcacacgggaacccctctccccttccttgtcgaagacacaagaacggcgccaacgggcacgcgtttcggggcaaccctacatctaccaaacaatttcctgcaaggcagtgcaatccaacttgccatgtgtccgaccaacgcccccaataacgccttcgaaagatccccccgcaagaccaggttctcccgcagctgggaaaacccatgaggacatgagattcctaaggataggcttcaccaggggaaaatcccccttttccagcgcggaaaaaaacgacaaggcttn

SEQ ID NO: 67696 - protein, 134 aa, Zea mays
  misc_feature: Ceres CLONE 1542589
  misc_feature: SWISSPROT Homolog: EC 4.4.1.5 Lactoylglutathione lyase
MAAARELQLLSSWYSPYVIRAKVALGLNGLTYEFIEEDLFSKSDLLLELNPVHKKVPVLLHGRPPPCASFFAIPPIGGGRDSTNTAHGNPSPLPCRRHKNGANGHAFRGNPTSTKQFPARQCNPTCHVSDQRPQ

SEQ ID NO: 67697 - DNA, 755 bp, Zea mays
  misc_feature: Ceres CLONE 1542590
  misc_feature: Encodes the peptide sequence at SEQ ID NO. 67698
  misc_feature (657)..(657): n is a, c, t, g, unknown, or other
caatagctggagctccccgcggtggcggccgctctagaactagtggatcccccgggctgcaggaattcgtctcacccctagaaaaaacaagtgcccccctcctcccgcgctcccaaatcactccctctctgtctctccactccactcgccgccgccgcccgaatctcaatggcgtccgcggccgccccgccaacctccctctccctcgcggcccgtgcggcaagcagggcggccgccgccccgctccgcaggggaggcctcgccgcggcgcgccagccggcgcggtcgctggcgttcgcggcgggcgacgcgcggctcgcggtccacgtcgcgtcgcggtgccggcaggcgtcctccgcgcgcggcacgcgggccatggccaccatggcgaagaagagcgtcggggacctcacggaggccgacctcaaggggaagcgcgtcttcgtgcgtgccgacctcaacgtgccgctcgacgagaaccagaacatcaccgacgacacccgcatccgggccgccatccccaccatccagtacctcctcggccagggcggccaagtcatcctctcaagccacttgggtcgccctaaaggttttacacccaagttttagcttagcccccccttgttgcacggttggctgagccttcttggcattcangtggccaaaaacccaaccatgttatttggccctaaaatttgaaaaacctggtggcccgcctttccccaatggggggggtttttgcccccttgaaaaag

SEQ ID NO: 67698 - protein, 146 aa, Zea mays
  misc_feature: Ceres CLONE 1542590
  misc_feature: SWISSPROT Homolog: EC 2.7.2.3 Phosphoglycerate kinase
MASAAAPPTSLSLAARAASRAAAAPLRRGGLAAARQPARSLAFAAGDARLAVHVASRCRQASSARGTRAMATMAKKSVGDLTEADLKGKRVFVRADLNVPLDENQNITDDTRIRAAIPTIQYLLGQGGQVILSSHLGRPKGFTPKF

SEQ ID NO: 67699 - DNA, 632 bp, Zea mays
  misc_feature: Ceres CLONE 1542591
  misc_feature: SWISSPROT Homolog: EC 6.3.2.19 Ubiquitin--protein ligase
ccgcggtggcggccgctctagaatagtggatcccccgggctgcaggaattcgtctcacccctagaaaaaaccccctctttgtgctgtttcttctatccgccgccgtgcgccgggggagacactaggagtcgcaaaccggtaacgtcccgcgccgcatcagctgtggtgccggagcctaagccggcgttggaagcagttctctaagggcgcgtcagggccactcggaggtgcggcggttgcagtccgatctgatggcgctgatgatgggtggtgaccctggagtgttggggtttcccgagggggacgagatgctccatggggtgggcaccaactagggttccgccgggatggtctacgagggcacctcctaacgcctcgcgttggccatcaaatccaaggatgatcaaggtgacactgttgcgcctgttcatgacatctgcttccatgtcaaagtcgatgtgcacggacacatgtacgttgaaatgatcgcagagtagtgggcatcgacctaacaactgagtgccatagctacctctggcatgagtgagcatgtagagccgaacaatgactatgttcaagttgcattggatcgcattgtctgtgctactgacgaggaagttcataagatggtg

SEQ ID NO: 67700 - DNA, 699 bp, Zea mays
  misc_feature: Ceres CLONE 1542592
  misc_feature (521)..(521): n is a, c, t, g, unknown, or other
  misc_feature (529)..(529): n is a, c, t, g, unknown, or other
  misc_feature (615)..(615): n is a, c, t, g, unknown, or other
aagctggagctccccgcggtggcggccgctctagaactagtggatcccccgggctgcaggaattcgtctcacccctagaaaaacctcgtgtctctgtttggctgcattggagcagggacaagaaacacctgctgtttgtgtttctatgccttcttggtcatattgttgatccttgctgaagctggagctgctgcattcattttctttgaccatagctggaaagatgtaattccagtggacaagacacataactttgatgttatgtatggctttctgaagaaaaactgggagattgcaagatgggttgctcttggcgttgttgtttttgaggcagtgctctttctattagctctggttgtcagggcaatgaacaaacctgcggagtatgacagtgatgatgaaattattgcaattggccgaagccctaccatgcggcagccattgatccatgcccaaaatgtgccggccaccggtgttcctgtcccacactcgatcagcgttcaagtagaaatgatgcctgnagccaaangatgcgagagaagtatggtctggacacgaagcagttcacgtacaacccctcagacccagcaggtaccagcagaatggcgctcacangctgaagaaagagtcgatgccctataatgtgaagaatcttcatgacgcctacgcctaattgttttcttgaacggctaccccact

SEQ ID NO: 67701 - DNA, 730 bp, Zea mays
  misc_feature: Ceres CLONE 1542594
  misc_feature: Encodes the peptide sequence at SEQ ID NO. 67702
  misc_feature (688)..(688): n is a, c, t, g, unknown, or other
ggagctccccgcggtggcggccgctctagaactagtggatcccccgggctgcaggaattcgtctcacccctagaaaaaggtttagaagcagaggcatctctgttgacacaattgatggtcaggtttacaagcagactcatctggtagtcagtgttgtgttgtaaattaatgagtgttattgaattaccgaacctatttcttgtaccatgcatgacaagcaacgacactagttatgatcatgacgaatcatgtaacagacctgtttactgcagtgcagtgtttaatgttagaccgggttatttgctctgttcctaccatctaccaacacctgcaccgcagaaccaaacctagctgcgcttcctccagatctcggcgctctggccccatggccaccctcgttactagctccagtctctccgctcaccgcccttgcgccctctagctccggatcgcccgcgcacacgaggccatggagcccgcagccgaggacgttgcagccgccgcgccggactcgtgggaatcggccgacatcgacgggcccataagccggcttatcctctccgcgcgccgcgtgtcctcctcgccggacctcgctgacaacccggacccgccccagccgccgcctgcgctgcagccgcagggcccgccttcggttccctcggctgcgcgcgaggatttgatggctcangtcgatcagttcctacgagaggctctagagaagccgagggag

SEQ ID NO: 67702 - protein, 87 aa, Zea mays
  misc_feature: Ceres CLONE 1542594
  misc_feature (73)..(73): Xaa is any aa, unknown, or other
MEPAAEDVAAAAPDSWESADIDGPISRLILSARRVSSSPDLADNPDPPQPPPALQPQGPPSVPSAAREDLMAXVDQFLREALEKPRE

SEQ ID NO: 67703 - DNA, 789 bp, Zea mays
  misc_feature: Ceres CLONE 1542598
  misc_feature: Encodes the peptide sequence at SEQ ID NO. 67704
  misc_feature (179)..(179): n is a, c, t, g, unknown, or other
  misc_feature (213)..(213): n is a, c, t, g, unknown, or other
  misc_feature (216)..(216): n is a, c, t, g, unknown, or other
  misc_feature (219)..(219): n is a, c, t, g, unknown, or other
  misc_feature (222)..(222): n is a, c, t, g, unknown, or other
  misc_feature (225)..(225): n is a, c, t, g, unknown, or other
  misc_feature (246)..(246): n is a, c, t, g, unknown, or other
  misc_feature (308)..(308): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
ctccccgcggtggcggccgctctagaactagtggatcccccgggctgcaggaattcgtctcacccctagaaaaactcagacgccacctgttcttccttcctctcctctctgcaacgcgtcgggaagcagctgccagccatggcaatggcgtcgtcgtcgagcgggctgaggagctgcancgcattgggcgtgcccagcctgctggcgccgtcnacntcntcntcntcccggtccggccgcctgccnttctgcgcccacgccaccacctccggccgtgtcaccatgtcgggaggagtggatgccccggncagccccttcccgcccacctcgaagggtcctcgccgggtgtcttttccccccccccccggggggagagggggggtgttttaaaaactttcannnnttcaaagacccccaacaaaaacacaggccgttggggcactgggggggggggcggcggttttctctggtacctttaacgtccgtgtgggtcggccacgacggggtggtacgtcctggggcgggggcgcgggcgggcgcgcctggtcgtggggcggcgccgcttcggcgggccgtgtgtggtctgggggccgcgttcggccgctgccgtagtggacggcggcaggtgctgggggtggtgggaggcccccgggcggggaggttgggtttgtggcggaggccgcccccggccgttggcggcgccggggagggggtggcggcgcggcaccggagcggtcgttacggcaggttggcgccatgggggctgtgcgcgtgctttcgcgcgtgggg

SEQ ID NO: 67704 - protein, 83 aa, Zea mays
  misc_feature: Ceres CLONE 1542598
  misc_feature (14)..(14): Xaa is any aa, unknown, or other
  misc_feature (57)..(57): Xaa is any aa, unknown, or other
MAMASSSSGLRSCXALGVPSLLAPSTSSSSRSGRLPFCAHATTSGRVTMSGGVDAPXSPFPPTSKGPRRVSFPPPPGGRGGVF

SEQ ID NO: 67705 - DNA, 830 bp, Zea mays
  misc_feature: Ceres CLONE 1542600
  misc_feature (1)..(1): n is a, c, t, g, unknown, or other
  misc_feature (21)..(21): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nattttttttatgttctcccnacacataanacnnnggcaccnnnggggagcaggactccccgcggtgggggccgctctataactagtggatcccccgggctgcaggattcgtctcacccctagaaaaatccctaattaagccaaaaggcactgaagaaaccagtcaatagcgagttctactactagtagctagcctgctgatctgttctgttgtttagttcgcaaagccttctgtttcggcgaccatggatgatgacaggaacacccagccccaccatggcggtgaggcccacccagacgcccccgaatcagtggacgtgaaggaatagggggctcccgcactgcccttcctcggcaggaaaaaccaccaaccactaccatgcaaaagaaaaatcaaaccggataagctgggtaatccgtctcgcccaaggggagggggggggcggaacctcaccaaccaccgtttaacaccccccccccctatcccaacgttcttccggaaaaaaaaaagggaggggcctttttccaccaaacctttcccccccccaccactattaccccctctcataacactccggaaaaggccgactcataagaatacagaaaccccgcatagcaaaagacacaccgagcgaagaccttatccatttaactgaaaacaataaatgaaacatcgcggctcctctgataggacaaaacctccacggggaaaaaaacctctccccgtgacaccggaatggcaccccccacctcacgaaacggcagctgccttattattacacccggcgcaccctggcccgcccatgtgatatataactactcactcccag

SEQ ID NO: 67706 - DNA, 875 bp, Zea mays
  misc_feature: Ceres CLONE 1542602
  misc_feature (12)..(12): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (514)..(514): n is a, c, t, g, unknown, or other
  misc_feature (839)..(839): n is a, c, t, g, unknown, or other
  misc_feature (875)..(875): n is a, c, t, g, unknown, or other
tgtgtgtttggnttgttgtgcccccccccggccccccccacnccgccnnnnnaacaacaatggaactccccgcggtggcggccgctctatactagtggatcccccgggctgcacgaattcgtctcacccctagaaaaaaactgtaaaacaggtcatttatctgcaagcatggtacatatattggccacggtaatttgagaggcttgctgttaagcaataggattgctggctgtcaaaattgtcgatgcgcttttctttttgggttttcctgccaaggaattctttcttttctataatctcaaaaaatattattttttttgtatgcggctgggttctaatgtactaaaaaagagattgtgaaaggttattacccttaccgtggtaccatcaaaataatatacgcgcacgtgcaacaatatttcaacgaatacttgttaaaactcatgcgcaaccacccgcccaaccacaacaaataaacctgcaaactactaatagtccacccaccccttttttnttggaaatattttttacatttattagtattaaaccatatatctaacaacaccggagaaccgtcttacaataagtatacacacaaattctctcccaattactaaatcaagacccgataaattacagcggtaaaatttaacatttggcactcattcataattgaaacatactatccgcgtggaacagagagacaaaaacacctcggagcagttccacacctcgcccttaacctcccaccacccgcaccctccaagcactcgcgccctttagagaccgcaacgaatgccttatttattatgtactataaataaagtccacatcctatnaaaacattgttccctttgcccactcacctttgatgn

SEQ ID NO: 67707 - DNA, 856 bp, Zea mays
  misc_feature: Ceres CLONE 1542610
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (21)..(21): n is a, c, t, g, unknown, or other
  misc_feature (39)..(39): n is a, c, t, g, unknown, or other
  misc_feature (40)..(40): n is a, c, t, g, unknown, or other
nnnnncccccccaggaccccnattaacataaaactcccnncccgcaaaatatttcccctcgcgctccccgcggtggcggccgctctagaactagtggatcccccgggctgcaggaattcgtctcacccctagaaaaagagggacgcacaggccatacatactacattcatgtgctgcgcgccccacgtggcgaacgcggagggacgagggccctgtcgttgctgcggcggcggtgaggatgacgacgaggacggccacccgccggcagcggtgtgccgaatgctatcccggtaccaccgcagcccgcaggcatccatgatggcccacccgctggccaccgctcttccctcccgggggggcggggcccggcaaaagcccctttctcttccatcctccaagtagatcccctgaaaccccaccggtttttcttcccccccccccccccggggggggacgcagggggggggcccctctctttccttaacacccgtcctccccccttccagcaccggctaccaccccacataataccccccttacacccggcgggggagcctccctccccctcccaccacaccccctctactcccccccctaatacccggacataaacaaccccgacctccccccgacccaccgccgcctaacaaaaccagcgacccaccccccgatacaactgccccatccaacacccgtccatacagctcagaagtaggaaccgtggatgaacccacgtctactgacctctcgcattccagccgcccgcccacccccctacatttcgcctcagccacccccacaccagtgcacacccacaccattaccgccccatgcccccggtcccccccccctcccc

SEQ ID NO: 67708 - DNA, 587 bp, Zea mays
  misc_feature: Ceres CLONE 1542616
  misc_feature (267)..(267): n is a, c, t, g, unknown, or other
  misc_feature (285)..(285): n is a, c, t, g, unknown, or other
tggagctccccgcggtggcggccgctctagaactagtggatcccccgggctgcaggaattcgtctcacccctagaaaaaactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatagagaagagagcagtcttggatagctgaactgaagctggtcnggtgagtatgggctgaangtgcagcgtgagctttggagggtcagtatgcacggagcaggattcggtaatgcctggcaggggaccctgggttccacccctgtgaaaaaaaaaaaaacacccccccccccgaaatcttttggggagggggaaggggccttttttttcccccccaaaaaacccctttggggcgcgtttggtgagagggggaaaaaaaaaccttttgtttatttttttttttcccccccccccccccgaaaaaaaaatttccccccccggggggggggggttttaaaaaaaatttttttttcccaggggggggg

SEQ ID NO: 67709 - DNA, 755 bp, Zea mays
  misc_feature: Ceres CLONE 1542617
  misc_feature: Encodes the peptide sequence at SEQ ID NO. 67710
tctgatccatagtctttttgcgctgcaggaattcttctcatctatacaaaaagtgagcttcgttcgttcagttcatccgtgttcttgtttgcgaggtccacagagagaggatgtcgtgctgcggaggcaactgtgggtgcggctccggctgcaagtgcggcaacggctgcggagggtgcatcaagatgtacccggacatggctgagcaggtgaccacccccccccaggttctcatcatgggtgtcgcaccctccaatgggccccccgaggggggggtccaagcgggcccccaaatttaaaactgctggttttaactagcccccgcctaattttttttccccccccccaggggggggggggggggtatttactcccccccttaatttccccccccccaccccaccaaaactcttcaccttcccacgcgtgcttcccgctctcctcccttccgctccgatacccctcgtctcctcatctcccttgcctctacgtggaccgtctcccccaccacctacctactaacctctcccacgccctcgattatccttatgctctccacccctttctgtcctccctcccctcgttcctgacccaacaccctacgttgtcttcgccgtttcatccttctcgcccgtcgccctatttctacctcttgctctgcctcacaccctcacgttcttccccataacgctcattcctgcatcgtctctgccctgccgctgaacttcttgttgtttctggcgtgcgacagtccg

SEQ ID NO: 67710 - protein, 62 aa, Zea mays
  misc_feature: Ceres CLONE 1542617
  misc_feature (1)..(58): Pfam Name: Metallothio_2 Pfam Description: Metallothionein
MSCCGGNCGCGSGCKCGNGCGGCIKMYPDMAEQVTTPPQVLIMGVAPSNGPPEGGVQAGPQI

SEQ ID NO: 67711 - DNA, 638 bp, Zea mays
  misc_feature: Ceres CLONE 1542618
  misc_feature: Encodes the peptide sequence at SEQ ID NO. 67712
gatatggagctcaccgcggtggcggccgctctagaactagtggatcccccgggctgcaggaattcgtctcacccctagaaaaaggcccaccgctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaggaacgaaaagcatgtgaaccttatcaaggaataccgtgcgaagatcgaggctgaactgagcaatatctgtgatggcatcctgaagctgcttgactcccacctagtgccttcttctactgctgctgaatcaaggtcttctacctcaagatgaagggtgactatcacaggtatcttgcggaaattttagaatggtccctgagaggaaagaacctgctgaaaaccacatgatgggcctccaagctgcctcggaat

SEQ ID NO: 67712 - protein, 124 aa, Zea mays
  misc_feature: Ceres CLONE 1542618
  misc_feature (3)..(124): Pfam Name: 14-3-3 Pfam Description: 14-3-3 protein
MAREENVYMAKLAEQAERYEEMVEYMEKVAKTVDVEELTVEERNLLSVAYKNVIGARRASWRIVSSIEQKEESRRNEKHVNLIKEYRAKIEAELSNICDGILKLLDSHLVPSSTAAESRSSTSR

SEQ ID NO: 67713 - DNA, 730 bp, Zea mays
  misc_feature: Ceres CLONE 1542619
  misc_feature: Encodes the peptide sequence at SEQ ID NO. 67714
  misc_feature (5)..(5): n is a, c, t, g, unknown, or other
  misc_feature (6)..(6): n is a, c, t, g, unknown, or other
  misc_feature (15)..(15): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ggggnnaaaaaaaangaaggaccaccacacaacccttgntnnnnnggaactnnnataatacaggaactcaccgcggtggcggccgctctcccataaaggatcccccgggctgcaggaatccgtctcacccctagaaaaaaccagcggcatctatagcaaccggtccagcactttcacgctcagctccagcaatggctgtctccaccatggcgatctcctccacggcgatggccggcacccccatcaaggagggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacagctgggaaaccgccggggctgtccgccgaccccgagaccttcgccaagaacccgccccccttggagtgatccacctccccgctgggccatgcctcggaggcggtcggctgaagactttcccgaagctgcttctcccgcaacaggccacaagttccggcgaagcccgtcctggatcaaggcccggctccccaaaatcttcaatcaaaggggagggcttgaaataaccgtcgggaagacccccagccctgaacccccgccccaagaacagtcccctcacccatcctgaggccttgccaaggagcaaggattactggga

SEQ ID NO: 67714 - protein, 148 aa, Zea mays
  misc_feature: Ceres CLONE 1542619
MAVSTMAISSTAMAGTPIKEGSFGEGRITMRKTVGKPKVAASGSPWYGPDRVKYLGPFSGEPPSYLTGEFPGDYSWETAGAVRRPRDLRQEPAPLGVIHLPAGPCLGGGRLKTFPKLLLPQQATSSGEARPGSRPGSPKSSIKGEGLK

SEQ ID NO: 67715 - DNA, 799 bp, Zea mays
  misc_feature: Ceres CLONE 1542624
  misc_feature (46)..(46): n is a, c, t, g, unknown, or other
  misc_feature (47)..(47): n is a, c, t, g, unknown, or other
ttttttttttgagttgtggttcccacagatttacttgttggttacnnaaaaccccatcctggtactctccgcggtggcggtcgctctatactagtggatcccccgggctgcgggaattcgtctcacccctaaaaaaagacgccaaacggtatccgtcagccagcaacatctccaccacaccctccccgtccccgatgaagaagcacagcggagaggcggccgaagccgacgcctcaccaagtcaccagtagcttctccgcgctcgtgcgcgccttcccgcacttggatgctccctgcgccggcgcctagagcggcggccgtctagcgggcgcccggagggtgaacccaccgatggccgacgctctccttcctagccgcttcctcgcgccgttgtcagacgtatccggagcctcttcctcagcctcttcgtccccgccgtgtcttttgaggtgctctcggtcacccgggttcccccccgtcggacggggtcttggagagcggatcacccagcaatccccgggggttctccgggtttacttccggacccaagaaattaatgcactcataatccctggttgaacctacctggctaagggtgggggaggtaaaaaccgcccggggaccattaataggaattggaaactatcaaactccaccaagcggggaaattttcttcgggggaggcccactttgacaaaaaatcgcctgggaagaaaccaaaccccttggagttaattgaggcttataagcacatccatactagcagaacacctcaagacggtgggacactatccagttg

SEQ ID NO: 67716 - DNA, 612 bp, Zea mays
  misc_feature: Ceres CLONE 1542625
  misc_feature: SWISSPROT Homolog: EC 3.2.1.23 Beta-galactosidase
tgtggatcccccgggctgcaggaattcgtctcacccctagaaaaaatcgtgtggctctgataggaggaaacttcagcatcaacaacaaccaacaacgacatcgtttcttgggactattttgatatgtgtttggcaccaaaaagagccaagcggacggtccggccctggagccggacggtccgcggtccggacagtccgcgcctgtgggccgaacggtccgtgcctgcgcagaataggttagggttccgagttttatgcaatgtttgttagctatattcgcggatttagctcggaatccggttgtgtaaagggtccagcccccctcctctataaaaagagaggtctacggccgatttgtaatcatcaatcgaatcaatacaacttctatttcccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaat

SEQ ID NO: 67717 - DNA, 655 bp, Zea mays
  misc_feature: Ceres CLONE 1542629
  misc_feature: Encodes the peptide sequence at SEQ ID NO. 67718
atcagtggagctccccgcggtggcggccgctctattcctactggatcccccgggctgcaggaattcgtctcacccctagaacccgaagcacatcccgtcgcatcccatcccactaccacccatctcgtcgtccgccgattcgatccggttcttcccacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgctttgccagaaggtggagttctggctcctagagaatgttagattcctccaggaggaagaagaagatcgaacctgagtttgctaagaaactagcatctgttgctgacccttattggcaatgatgccttttggaccggcacacaaaactcatgccttcaccg

SEQ ID NO: 67718 - protein, 121 aa, Zea mays
  misc_feature: Ceres CLONE 1542629
  misc_feature (3)..(122): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLAPREC

SEQ ID NO: 67719 - DNA, 660 bp, Zea mays
  misc_feature: Ceres CLONE 1542630
  misc_feature: Encodes the peptide sequence at SEQ ID NO. 67720
  misc_feature (600)..(600): n is a, c, t, g, unknown, or other
atagctggagctccccgcggtggcggccgctctagaactagtggatcccccgggctgcaggaattcgtctcacccctagaaaaaatctctctctacataaacaaaacccagtcctttgttcttcccccggcacgcctagcgccagtcaccaaccttccactccctccctccgtcgccatggcgcgcaagaagatccgggagtacgactccaagcgcctcctcagggagcacctcaagcgcctcgcgggcatcgacctcaccatcctctccgcccagatcacgcaatcaacggacttcgcagagcttgtgagccagcagccatggctgtcaaccatgaagctagtggtgaagcccgatatgctgttcgggaagcgtgggaagagcggcctcgtggctctcaacttggatttcgatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggagggattgagatcgangagaactgacaagggtaagactattttccttcctactgagaagccaatgacgtctgattc

SEQ ID NO: 67720 - protein, 143 aa, Zea mays
  misc_feature: Ceres CLONE 1542630
  misc_feature: SWISSPROT Homolog: EC 2.3.3.8 ATP citrate synthase
  misc_feature (141)..(141): Xaa is any aa, unknown, or other
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIXEN

SEQ ID NO: 67721 - DNA, 630 bp, Zea mays
  misc_feature: Ceres CLONE 1542637
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaattcttcatttggtgcggcgtcaccaccgcaaggctcgccggtatcttcctcttgggcggcaaggagaaattcaatggtaatctgtgccgacaaggcgaaaggcttaggcagcaggacaaaaccgcgatgggccgaagctaatcgttagcttctttggtatctcaagggagcaatagcccttctaaatttcataagattcctgcgtccctaccataacatagtccctatctagggactatcatggaatccatccttctgcatgatttcactttcctgatagtaacagtaacgataaattgacactaatttgtgatcttctgcaaccttctaggatcccaggtttcgcataaaaaaaaaaaaaaacgagacgcctccaggtacccaatttctccctatagtgagtcgtattacccgcgctcattggccgtcattttacaacgtcgagactggcaaaaccctggcgttacccacctttatcaccttgcggcacatccccctttcgcccgctggcgtaatatcaaagaggaccgtgcccattcgcccttcccag

SEQ ID NO: 67722 - DNA, 743 bp, Zea mays
  misc_feature: Ceres CLONE 1542638
  misc_feature: Encodes the peptide sequence at SEQ ID NO. 67723
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ccccnnnnnnnngnnnnannnnnnaaaanannnnnnnnnnnnnnnnnnnnccatagctggagctccccgcggtggcggccgctctagaactagtggatcccccgggctgcaggaattcgtctcacccctagaaaaaattttcatcctgtcgtgggatcccagccaccgacgctagaagaagagctcggcgattcgcaggtcccgcgagattatgccgaagcagatccatgaaattaaggacttcctcctcaccgcgaggaggaaggatgcccgctcagtgaagatcaagaggagtgaggatgttgtcaagttcaaggtgcgctgctccaagtacttgtactcgctctgcgtcttcgatgctgataaggcaaacaagttgaagccatctcttcccccaggtttgaccgtctaggaggtctgattggatacatggcgacggcgagttgaactacccaagcttctttaccccccccagagcatgctactctatgtacttttggaacccaagctattagacccgccactgtcggatgcctgggatcttggatttttggacaattacccgtctacctcggtcgtggatgccgaaaataaaccaaacaccgagacccctcgaggggaccccaagtcgccactttccgtagaggccgcaattgggcgccgctcccctggcgcgcccttttttcccaacccgccctgccccggaaaaaaaccccggagtgtttaaccgaaccttctgtccg

SEQ ID NO: 67723 - protein, 66 aa, Zea mays
  misc_feature: Ceres CLONE 1542638
  misc_feature (2)..(67): Pfam Name: Ribosomal_L38e Pfam Description: Ribosomal L38e protein family
MPKQIHEIKDFLLTARRKDARSVKIKRSEDVVKFKVRCSKYLYSLCVFDADKANKLKPSLPPGLTV

SEQ ID NO: 67724 - DNA, 644 bp, Zea mays
  misc_feature: Ceres CLONE 1542641
  misc_feature: Encodes the peptide sequence at SEQ ID NO. 67725
  misc_feature (634)..(634): n is a, c, t, g, unknown, or other
ggagctccccgcggtggcggccgctctagaactagtggatcccccgggctgcaggaattcgtctcacccctagaaaaaacctcgtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcttgtggaggttgaccagatctatcaccttgcttgccctgcttcaccaatcttctacaagcacaatcctgttaagaccatcaagacaaatgttattggtaccctcaacatgctgggacttgcaaagagagttggagctaggattttgttgacatncacatctgag

SEQ ID NO: 67725 - protein, 151 aa, Zea mays
  misc_feature: Ceres CLONE 1542641
  misc_feature: SWISSPROT Homolog: EC 4.1.1.35 UDP-glucuronate decarboxylase
  misc_feature (148)..(148): Xaa is any aa, unknown, or other
MAQKETNGSNGEHISTRPPPTPSPLRFSKFFQANLRILVTGGAGFIGSHLVDRLMENEKHEVIVADNFFTGSKDNLKKWIGHPRFELIRHDVTEPLLVEVDQIYHLACPASPIFYKHNPVKTIKTNVIGTLNMLGLAKRVGARILLTXTSE

SEQ ID NO: 67726 - DNA, 647 bp, Zea mays
  misc_feature: Ceres CLONE 1542648
  misc_feature: Encodes the peptide sequence at SEQ ID NO. 67727
  misc_feature (361)..(361): n is a, c, t, g, unknown, or other
  misc_feature (370)..(370): n is a, c, t, g, unknown, or other
  misc_feature (371)..(371): n is a, c, t, g, unknown, or other
  misc_feature (373)..(373): n is a, c, t, g, unknown, or other
  misc_feature (374)..(374): n is a, c, t, g, unknown, or other
  misc_feature (379)..(379): n is a, c, t, g, unknown, or other
gcatttctcctccatcccccgggctgcaggaattctctctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgactttctacataacggggttcaccgtccttaacgcgaacctccgacgctgcagtgacgggatgcaccaaccaaatttctttctcaccctcaccgggggggaaaganagggggggnntnnaatantacctccaacaacatcaagagccccaaaaaaaaaaagggtaaaagccgcgtggaggagcgcctgaaaaaaaggccgggaccccgattcccgacttttgcccaaaaagactactcccccaactggacctatggtatcggaatcccgaacccaacgcccggccttttgacttagcaaggaacctcggaccctgagcctcgattatcccggatcatcccgccctacagaggtttttccccgagacgtttctagcaaccaacccccctctcg

SEQ ID NO: 67727 - protein, 70 aa, Zea mays
  misc_feature: Ceres CLONE 1542648
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFLHNGVHRP

SEQ ID NO: 67728 - DNA, 590 bp, Zea mays
  misc_feature: Ceres CLONE 1542649
  misc_feature: Encodes the peptide sequence at SEQ ID NO. 67729
  misc_feature (310)..(310): n is a, c, t, g, unknown, or other
  misc_feature (311)..(311): n is a, c, t, g, unknown, or other
tggagctcaccgcggtggcggccgctctagaactagtggatcccccgggctgcaggaattcgtctcacccctagaaaactacccctacgagtatccaagtccaaccagcaagaggggaggcgctgcacgcaggtcacgcggcgatggacatatgcgatgtttgagcaggcggtggcagatttctgctggcatgcgagggaagtagtgtcgtcagggatggggctctggggttggccgtgggggcgacgtgggccgtcgggcttcggctccgcgtccaccgccgaggaggtcaccgccggcgtcgacgcanngcacatcactgccatcgtcacaggagcgacgaatggcattggaaaagagacagccagagttctagcacctgagggaagcccaggtatcctaccagctaggaccctgggagagtggccctcaagttgaaggaaaactccgcgattgaggcccaagctccaagtacccgtatggaaatggactgaagtgtttcactccgtccggaacttccaagggcctttattcttcccccaagcttttgaccctctccataacaatgccggaatcagggcccgcccctt

SEQ ID NO: 67729 - protein, 93 aa, Zea mays
  misc_feature: Ceres CLONE 1542649
  misc_feature (52)..(52): Xaa is any aa, unknown, or other
MFEQAVADFCWHAREVVSSGMGLWGWPWGRRGPSGFGSASTAEEVTAGVDAXHITAIVTGATNGIGKETARVLAPEGSPGILPARTLGEWPSS

SEQ ID NO: 67730 - DNA, 654 bp, Zea mays
  misc_feature: Ceres CLONE 1542653
  misc_feature: Encodes the peptide sequence at SEQ ID NO. 67731
  misc_feature (260)..(260): n is a, c, t, g, unknown, or other
  misc_feature (456)..(456): n is a, c, t, g, unknown, or other
aagctggagctcaccgcggtggcggccgctctagaactagtggatcccccgggctgcaggaattcgtctcacccctagaaaaagcgacgaactcatcactgcactggtggtgtccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcnatgacttggctaacccacccaaggtagaggagaagcttggtgctgtccctcatggcctgtccaccgactctgaggttgcccagagggaagccgagtctatctctaggaagactctcaggagctcagccgagaagtttgagttccaagctgaagtttccagactcatggacatcatcatcaactcactctacagcancaaggatatcttcctgagggagctcatatctaatgcctctgatgcgttggataagattaggttcctttcccttactgataaggaagttctggggggagggggacactgcaaagccttgagattcagatttaagttggacaaagagaaaaaaatcttctccatttcgggatagggggtattgggtatgacccaaggaag

SEQ ID NO: 67731 - protein, 156 aa, Zea mays
  misc_feature: Ceres CLONE 1542653
  misc_feature (35)..(35): Xaa is any aa, unknown, or other
  misc_feature (100)..(100): Xaa is any aa, unknown, or other
MRKWALSSALLLLFLLTTLPDPAKKLQVNAEESSXDLANPPKVEEKLGAVPHGLSTDSEVAQREAESISRKTLRSSAEKFEFQAEVSRLMDIIINSLYSXKDIFLRELISNASDALDKIRFLSLTDKEVLGGGGHCKALRFRFKLDKEKKIFSISG

SEQ ID NO: 67732 - DNA, 629 bp, Zea mays
  misc_feature: Ceres CLONE 1542656
  misc_feature: Encodes the peptide sequence at SEQ ID NO. 67733
  misc_feature (487)..(487): n is a, c, t, g, unknown, or other
tggagctccccgcggtggcggccgctctagaactagtggatcccccgggctgcaggaattcgtctcacccctagaaaaaggccaaaccaaccatcgtctactcggcggctgggctagcaccctccctaccaccatggcggccgtcgtgcctccgcccgacaacctggacccgcagccggctactcccccagccgccgctccttccgccacgctcaccccgcctcccgccgccacctccaccccaccaacccccttgacgccgggccccgcggcgcctagcccaaaccctaacctaccccctgcccctgcccctgcccctgcccccgcccccgcttccacgcctccggcggcagtcgcgccaccgatgcccccagctccgatctccttcgctgctaccttccgtccactcggtggccccagcgccacccgccgccgtaacaggtcccgcagtacgtcgcggtgccggcaaacccggctaccgatgcangcgccgggcgtccccgtcgtatggctccgggcgccctgcggctgccgccatgtacgggccgcccaacccggaatatactggcgaaaaaggggctgcaatccccaatcccgggggggccggcgcaccatttatcccccaaaaa

SEQ ID NO: 67733 - protein, 165 aa, Zea mays
  misc_feature: Ceres CLONE 1542656
  misc_feature (118)..(118): Xaa is any aa, unknown, or other
MAAVVPPPDNLDPQPATPPAAAPSATLTPPPAATSTPPTPLTPGPAAPSPNPNLPPAPAPAPAPAPASTPPAAVAPPMPPAPISFAATFRPLGGPSATRRRNRSRSTSRCRQTRLPMXAPGVPVVWLRAPCGCRHVRAAQPGIYWRKRGCNPQSRGGRRTIYPPK

SEQ ID NO: 67734 - DNA, 605 bp, Zea mays
  misc_feature: Ceres CLONE 1542657
  misc_feature: Encodes the peptide sequence at SEQ ID NO. 67735
  misc_feature (416)..(416): n is a, c, t, g, unknown, or other
aaagctggagctccccgcggtggcggccgctctagaactagtggatcccccgggctgcaggaattcgtctcacccctagaaaaagagatttcgccccctcccccctagaaacccctcttcgtttgttgtcccaccgcacacttcgtttccaaatccattccccactatccctgccctccccgctagggttttgccaacatggtcgccgctaccgctcggaggctcctctcccgtcgtgcctcctcgtcctccctctctgtgatcctccgccgtggtgctgtccaggagtagtcattgccgctgtgcccagccatcatcgcgacggcttccaggctagagcaagacgaggaggcgacagactccagacaagtggtgtgacagaggatggagaggacacatgcgagggagccctgtangcacgtggtttcaatcatcatcgcgatgaggattgtcggcacattcacactatgccattgcagaacgttggagcctctcagaactctggaagctgcctaccaccgtgcaccctaagatagggcatatctgtgttagccgcctaccacatactgaaatatgggcatatacaccatgtattcttctctcag

SEQ ID NO: 67735 - protein, 48 aa, Zea mays
  misc_feature: Ceres CLONE 1542657
  misc_feature (11)..(11): Xaa is any aa, unknown, or other
MERTHAREPCXHVVSIIIAMRIVGTFTLCHCRTLEPLRTLEAAYHRAP

SEQ ID NO: 67736 - DNA, 719 bp, Zea mays
  misc_feature: Ceres CLONE 1542659
  misc_feature (320)..(320): n is a, c, t, g, unknown, or other
atcgctggagctccccgcggtggcggccgctctagaactagtggatcccccgggctgcaggaattcgtctcacccctagaaaaggcccctcaccagtgccactgtctcgtcgctccgtagaccccgcgcctccgcctccccgccactcgccggaggctgccgccaccgttatgccatggccgtcatcctctcctccgcggcgccaacgatactgactcgtcccacgcgccctcggaggcagccgaggagcggcctccgcgggggcctcgcgcgcctctcagctgcgctctgcctcgcgcacgcgggcgccggcgccggcnccgcactcgccgcgccgctctcctacgaggagatgctgggcctttcttcccccctcccgcgggggggggggggggggggttccactccccaaacttcaccctcaaccggcttcgttgaatttcctcaaccaagacccctttctcgtcgggggggggcgggctttcccggcccttcccaattggcccctttctcctttgcgtcagctttttccggccgagcgggggggccccctcctaagcccccaccccccgctctttgttcttcccaaggggcgacctacccctcccggatctgctctctggaagctcccccctttcccgctctctttgcccaccatattgggcccttctttccaccgtatgtctccccgccaaagcatcgtgtctccccccaattat

SEQ ID NO: 67737 - DNA, 598 bp, Zea mays
  misc_feature: Ceres CLONE 1542668
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (303)..(303): n is a, c, t, g, unknown, or other
nnnnnttttnnnccttcttattgtatattaatcattttattnnccgttnnnncaaaactggagctccccgcggtggcggccgctctagaatagtggatcccccgggctgcagattcgtctcacccctagaaaaactccctgggccctggcccctgtgctccccttgccaccgaacgagagccaaaagcctcccgccccacgacgcgcccgccccggcggcgacgccccggaggacgtttcccgcagcgaccggcgaccaagccttgattgcctccgccccatggctacccgggggcgcggggncgtttaaaccccgccgccctcgggcccgcaaccaagggtttcggtcccgcccccccccttccgggggaattttctggttttcccaggtcggaattcgcggccgaaaaaacttccgttccttcccaaaattccgaaaaccccccccccccccccggggggggaaaaaacaaagggcgttccccccgggtccccccaaaagggggaattttccgggggaaaattttgagaaacccggataaaccccccggggaaaccccccttgcccaataataagggggggggggcttcccaaaaa

SEQ ID NO: 67738 - DNA, 773 bp, Zea mays
  misc_feature: Ceres CLONE 1542670
  misc_feature: Encodes the peptide sequence at SEQ ID NO. 67739
  misc_feature (1)..(1): n is a, c, t, g, unknown, or other
  misc_feature (9)..(9): n is a, c, t, g, unknown, or other
  misc_feature (16)..(16): n is a, c, t, g, unknown, or other
  misc_feature (17)..(17): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (773)..(773): n is a, c, t, g, unknown, or other
ntttttttnttttcgnntgctccacgccacccgggtgtatatnnnnnnnnaaaactggagctcaccgcggtggcggccgctctagactagtggatcccccgggctgcaggaattcgtctcacccctagaaaaaaatccactcggtttcagacttggtacaacccaaaatcaccattccttttggttcgcacaaccaaaaaattattctgaaggtctacaggaagataaaaaaatacggaattgtatcaagaagtatatacaaaagaataggaaaaaaggctcgaatagaaaaatggaatcagactcaagttctgaagtaattacacatatagaaattcaaaaagaaatcgatacaatccacgtcataatccatattggattccccaacttattaaagaaaaagggagcaatcgaagaatcagagaaagatcctcccaaaaaggaaagttaattcctgtaaaccagagacctaatatttgctatccgaaaaggttaaagaaccttatagaccaaccctaatatttcctggcggaataaattagccttccccaattaaaaaaataaaagtttcattccccgaaaaaaaaaaaaaaaaaaccgaaaacgcctcggaggaaccccaattccgccccttattagggaggtcgtaatttacggcggcgcctcaactgggccggttcattttttacaaaaccatccatgaccttggggaaaaaaccccccggggggttttcaccaaatttattaaattccggccctgtgcaaacacaaan

SEQ ID NO: 67739 - protein, 52 aa, Zea mays
  misc_feature: Ceres CLONE 1542670
MESDSSSEVITHIEIQKEIDTIHVIIHIGFPNLLKKKGAIEESEKDPPKKES

SEQ ID NO: 67740 - DNA, 644 bp, Zea mays
  misc_feature: Ceres CLONE 1542675
  misc_feature: SWISSPROT Homolog: EC 1.11.1.6 Catalase
  misc_feature (186)..(186): n is a, c, t, g, unknown, or other
  misc_feature (194)..(194): n is a, c, t, g, unknown, or other
  misc_feature (195)..(195): n is a, c, t, g, unknown, or other
  misc_feature (202)..(202): n is a, c, t, g, unknown, or other
  misc_feature (203)..(203): n is a, c, t, g, unknown, or other
  misc_feature (207)..(207): n is a, c, t, g, unknown, or other
  misc_feature (208)..(208): n is a, c, t, g, unknown, or other
  misc_feature (395)..(395): n is a, c, t, g, unknown, or other
  misc_feature (469)..(469): n is a, c, t, g, unknown, or other
  misc_feature (544)..(544): n is a, c, t, g, unknown, or other
  misc_feature (546)..(546): n is a, c, t, g, unknown, or other
  misc_feature (556)..(556): n is a, c, t, g, unknown, or other
  misc_feature (572)..(572): n is a, c, t, g, unknown, or other
  misc_feature (625)..(625): n is a, c, t, g, unknown, or other
tccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacngacggtgnnacgacgnnacgnnaacgcggggcgcctcctggtgtggaacgacaacgaggcgctgactgtggggcctcgcggtcccatcctgctggaggactaccacctgatcgagaaggtggcgcactttcgccgcgcggagcggccatccccgggaagccccggtgggtgccaacccccccgccggggggcctccgcccaagggcttnctccaggtgcacccacaacgtggacgttcccttgaaagtggcgcccaaaattccctggggccccgccccccggngtaggcgagcaccccccgggaatccgtggcctttcccgaccgggggaattccccccagccggggggggttccccncnccccgcgggngggggggggaaaaaanccccagaaattattttcccccgcggcggggaaaaaacacaccccgcggggggncgggccgcgggggggtttt

SEQ ID NO: 67741 - DNA, 679 bp, Zea mays
  misc_feature: Ceres CLONE 1542679
  misc_feature: Encodes the peptide sequence at SEQ ID NO. 67742
  misc_feature (335)..(335): n is a, c, t, g, unknown, or other
  misc_feature (396)..(396): n is a, c, t, g, unknown, or other
  misc_feature (399)..(399): n is a, c, t, g, unknown, or other
  misc_feature (400)..(400): n is a, c, t, g, unknown, or other
  misc_feature (411)..(411): n is a, c, t, g, unknown, or other
  misc_feature (413)..(413): n is a, c, t, g, unknown, or other
  misc_feature (423)..(423): n is a, c, t, g, unknown, or other
acgagctggactccccgcggtggcggccgctctagaactagtggatcccccgggctgcaggaattcgtctcacccctagaaaaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggctgcgtccgggagcccgtggtacggccccgaccgcgtgctgtacctggncccactgtccggcgagccgccgatctatctccacccccccagtggggaagaaggggggggnttnnaacacccgcgngncttttctccnaaacccggaaacgttcccccaagaaccggggagctgggaaggggacccccctcccccctggggcccaggctgggcccccccttcgcttgcttctaccccggaacctggctccccccccaaaccggcgtcaaagttcccggcgaagcccgtgtgggttccaaaggccccgcctccccaaatcctttcacccgagggtcggagatgggccctaccccccgggtaacccccaatcctcctccccagccccccaaaaaag

SEQ ID NO: 67742 - protein, 174 aa, Zea mays
  misc_feature: Ceres CLONE 1542679
  misc_feature (60)..(60): Xaa is any aa, unknown, or other
  misc_feature (81)..(81): Xaa is any aa, unknown, or other
  misc_feature (82)..(82): Xaa is any aa, unknown, or other
  misc_feature (86)..(86): Xaa is any aa, unknown, or other
MASSTMALSSTAFAGKAVNVPSSSAFGEARVTMRKTAGKAKPAAASGSPWYGPDRVLYLXPLSGEPPIYLHPPSGEEGGGXXHPRXFSPKPGNVPPRTGELGRGPPSPLGPRLGPPFACFYPGTWLPPQTGVKVPGEARVGSKGPASPNPFTRGSEMGPTPRVTPNPPPQPPKK

SEQ ID NO: 67743 - DNA, 638 bp, Zea mays
  misc_feature: Ceres CLONE 1542682
tggagctccccgcggtggcggccgctctagaactagtggatcccccgggctgcaggaattcgtctcacccctagaaaaagacggtagacggaggagctagcttgccaattgccattgcactgcgcgcgcgcacctcacatccgccgccagcaggtgccaccgccatctctgctttctctctctctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgggccaagaaggccgcggtgtccgtgtccgtgtcgtccgcgctggcgggcgccttcttctcggcgctggcgtcgtcggacgcggcgctggcggcgcaacgcgtggcggacgtggcggcggcggccgacgccgggagcgacaaccgagggcagctgctgctcttcgtggtggcgcccgccatcgggtgggtgctctacaacatcctgcagccggcgctgaaccagctcaaccgcatgcgcagccaggcccgtggtcgccggcctgggcctcggcgccgccgccgccgggatggcggccgcgctcgaagcc

SEQ ID NO: 67744 - DNA, 724 bp, Zea mays
  misc_feature: Ceres CLONE 1542684
  misc_feature: Encodes the peptide sequence at SEQ ID NO. 67745
  misc_feature (1)..(1): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
ncccggcctcaaagggggcggcagccgattatatcgcggtcatnntgangtagcatcaaagtgggactcaccgcggtggcggccgctctataactaatggatcccccgggctgcaggaagtcgtctcacccctagaaaaatccgccttcgcctccaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccaggggtctgaagaaggagtttcagctataacaagattcctcaaggatctgaaagaaggaaattctgctgcaaatggtactgtagttcaggacccagagctaggccaaggtcatttcaagctcccaaggtgatcaacgcaagaatgttgctactttccctagttcaggctggggattggcgaagaaaggagaaacatcaagatttcccggggttcctaagggacactgcaaaaatgccttgtgccccctataattgtgggggccctccccccttattgggggaaaccttggaagccattcgaacagtttggg

SEQ ID NO: 67745 - protein, 92 aa, Zea mays
  misc_feature: Ceres CLONE 1542684
  misc_feature (27)..(93): Pfam Name: SUI1 Pfam Description: Translation initiation factor SUI1
MSDLDVQLPSAFDPFAEANAEDSGAGPGTKDYVHVRIQQRNGRKSLTTVQGSEEGVSAITRFLKDLKEGNSAANGTVVQDPELGQGHFKLPR

SEQ ID NO: 67746 - DNA, 791 bp, Zea mays
  misc_feature: Ceres CLONE 1542686
  misc_feature (1)..(1): n is a, c, t, g, unknown, or other
  misc_feature (45)..(45): n is a, c, t, g, unknown, or other
  misc_feature (51)..(51): n is a, c, t, g, unknown, or other
nccccttttttaattgccaaggatatataagcattaataaaacanattaanagtcaaaattggagctccctgcggtggcggccgctctagaactagtggatcccccgggctgcaggaattcgtctcacccctagaaaaacgtacgaagattttggtgccttgcagtttttgtaagcttgcccttcccagactgattcaaggtggcactgcccctcgttgttattcaaggaattttggggctggcggggttgtttgtaagagcattgtaaaataacttgtttcattttttggtttctgtaacatgaatacatgacatgtgatagttgtatataagatctgtggactgggggcgtatcagcgcattctacacagctaatggttgcatagttgcgaaaactgaagcatgtaaaatgtctttataactggtcttctgtttgagatgcattaatcactgctgtttctggaaataagacatgtcctgccttttttggggtgtacttcttttatatcacctattacattactcaacttaaaacgttttttaacttcccctctccctcacgagtttataatacacattaaatcttcctacacagttatagaacaaacctactctacaattaactctacataagcgtcaacacatgccaccttagcagcctccatacactccaccactaaataaaaaaacaccccacaattaacatcaccgctctctacgctgaccatttatttcatccaccctatattgttcggttcaaaaaccaaccctctcgaaatatatatcactt

SEQ ID NO: 67747 - DNA, 682 bp, Zea mays
  misc_feature: Ceres CLONE 1542690
  misc_feature: Encodes the peptide sequence at SEQ ID NO. 67748
tccccgcggtggcggccgctctagaactagtggatcccccgggctgcaggaattcgtctcacccctagaaaaaaagtcagttgaggagttgagttccgctccgccacaccaaaaagaaacaaaagcctacggcgatcgatcgagaagctggtcatcgtcaggatgtcatcgccgcagtcagcagcgccgcccgtgaagctgatcacggcgttcggcagcccgttcgcccaccgcgtggaggtggcgctcgctctcaagggggtgccgtacgagctggtcgtgcaggacctagccaacaagagcgagctgctgctcattcacaacccaatcccccagtcggtccctgtcctcctcctcgccccccccccctggggggggggggggtcgtcatcttcaaatacctctaccaaacccttcaccatggcccggcgcccgggggatcctcccgggggaaccccaactaccacgcccaccccccccttcttgggcttaacttcctccgacaaccaagggctttcgaaacccacagagggctgttgaaatttgaaaggaaacgacgaagccccactaccccgtctcccctcgggttaaacacaaagaaaaacatcggggttggtgtgaccctcctcactccccgcgggtaaaaaaatattattccccccggcgaaattatttttaatat

SEQ ID NO: 67748 - protein, 125 aa, Zea mays
  misc_feature: Ceres CLONE 1542690
  misc_feature: SWISSPROT Homolog: EC 2.5.1.18 Glutathione transferase
MSSPQSAAPPVKLITAFGSPFAHRVEVALALKGVPYELVVQDLANKSELLLIHNPIPQSVPVLLLAPPPWGGGGSSSSNTSTKPFTMARRPGDPPGGTPTTTPTPPFLGLTSSDNQGLSKPTEGC

SEQ ID NO: 67749 - DNA, 638 bp, Zea mays
  misc_feature: Ceres CLONE 1542691
  misc_feature (638)..(638): n is a, c, t, g, unknown, or other
atagctggagctccccgcggtggcggccgctctagaactagtggatcccccgggctgcaggaattcgtctcacccctagaaaaacaaagaaaaagagggcaggcagaaggaggagaaagacagtaaactgaaggacgagttccacaagttactgaatgggaaccatgcggatcctactgatcggcgacagcgggcacagatgaacgggaggcacgacgaagacatcaatcacgcgctctccgaggccactgccaacggcacgtaagggcccgtcggcatctgcttttcaccgggggctttgtccttggcgctcggaggagaatcctcgcgggggtcgagaaaacctgcctggtgtggtgccccgccccgccagccgcctttttctgaattctgaagctgtccgagattccagcgatccagccaatcacatcatgcatctttctgaaccgctgttgcgttgcgttgccccaaaattcaaaacctcctggccgttcccccgttacagatttgcacccatactttccgtcccaaatgacctttttttccaaaaaaagggccgggggggggaaaaggaacccttggtacctcaaaaaaaaaaaaaaaaaaaaacccgaaacccccccccgggagttcccccn

SEQ ID NO: 67750 - DNA, 700 bp, Zea mays
  misc_feature: Ceres CLONE 1542696
  misc_feature: Encodes the peptide sequence at SEQ ID NO. 67751
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnccccnnnnnnnnnnaaaatcgtcgacggggactcggcgntnntttnnnnnntcatactggagctcaccgtggtggcggccgctctagaactagtggatcccccgggctgcaggaattcgtctcacccctagaaaaaagtcaaccagcgtgaacaaacaggagacgcatccagcctccagcagagggctccagagatccagcaagatgaaggagggcacggcgaactgtgtggacatcctcatcgccatcatcctgcccccactcggcgtcttcctcaagttcggatgcaagaactccatcgattcgcaggtcgagttctggctctgcctcttgctcaccttcctcgcctatcttccggggatcatctacgcgatctacgccatcaccaaggactagcgcggttccagttgggtgcgagctgcaggctcctccttctcttctcagctgtgaagctactactactagtctactacggattgatgaacctgtcgcttcgttcgtctccttcgatcgctctctggttatattggtcgtggatcttgttattaccgatttatttatcaaacagtaacttgtagcaaaaaaaaaaaaaaaaaacgagacgctcgaggtacccaattccgccctatagtgaatccgtatttacgcgcggctcactggcccgtcgttttttacaacagtcatggactgggaaaaac

SEQ ID NO: 67751 - protein, 63 aa, Zea mays
  misc_feature: Ceres CLONE 1542696
  misc_feature (6)..(62): Pfam Name: UPF0057 Pfam Description: Uncharacterized protein family UPF0057
MKEGTANCVDILIAIILPPLGVFLKFGCKNSIDSQVEFWLCLLLTFLAYLPGIIYAIYAITKD

SEQ ID NO: 67752 - DNA, 533 bp, Zea mays
  misc_feature: Ceres CLONE 1542697
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (479)..(479): n is a, c, t, g, unknown, or other
aaagctggagctccccgcggtggcggccgctctagaactagtggatcccccgggctgcaggaattcgtctcacccctagaaaaagtacccggcagtggcgacgaatctcgcggggcggaggtggtggcgcgactgaggcggtgtcgactccgacgaactcgcagccaccgggggatacgcagcagcagcaccggcgtactccatcgacgttcatatttaaggacttggtttggataattctactcgtcaacaaaagtgattaaaaaatggtgggttccttgcagctttcattcgttttcaaaggccggggaaaaaagcccttggtttttcaaaaaaaaaatttttttgtgaaaaaagtgctccccccccccaaaaaattttgggggggttttttgtggggggggtccccccaaaaatatggggggggaaaccgggggaaaaaaaaccccccccccccttttttctnnntgtggggccgnaaaaaaaaaaaaaaaaaaaaaaaggggggggggggtttttttttttacaccccc

SEQ ID NO: 67753 - DNA, 707 bp, Zea mays
  misc_feature: Ceres CLONE 1542701
  misc_feature: Encodes the peptide sequence at SEQ ID NO. 67754
  misc_feature (11)..(11): n is a, c, t, g, unknown, or other
  misc_feature (15)..(15): n is a, c, t, g, unknown, or other
  misc_feature (18)..(18): n is a, c, t, g, unknown, or other
  misc_feature (47)..(47): n is a, c, t, g, unknown, or other
  misc_feature (48)..(48): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
ttttttttttntttnttnttttttttttttttttgttggtttttttnnccccctnnttnccaaaactggaactccccgcggtggcggccgctctagaatagtggatcccccgggctgcaggaattcgtctcacccctagaaaaacaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcaactgcatcgcccacagcggcgacatctacagcgtcaccaccggacttcagcggcacctcccaccgcccgccccaatggaagggccccgcgccccaggccccagcctgccctagccttctcaaccgccggaaatcttcggcaccccgctgtctacggggaacaccgctgcccgccaggaaagtcaaccctcctcggtgtaata

SEQ ID NO: 67754 - protein, 123 aa, Zea mays
  misc_feature: Ceres CLONE 1542701
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASAKDASGVAVELDEEARPRVKASSEWILNCIAHSGDIYSVTTGLQRHLPPPAPMEGPRAPGPSLP

SEQ ID NO: 67755 - DNA, 656 bp, Zea mays
  misc_feature: Ceres CLONE 1542703
  misc_feature: Encodes the peptide sequence at SEQ ID NO. 67756
aaagctggagctccccgcggtggcggccgctctagaactagtggatcccccgggctgcaggaattcgtctcacccctagaaaaacactttcagctgcccagccgccgtccgtccgcgcttcactatccttcattccctcccctgtcagcgacgactgggtaggctaccgccgccgccctacgctaggtgcccatctcttcgccggcgaacagcgcccaccaaactccggccaagggcgtgatggcgagctgtacgcagcttgaaaccagggatggaaactcttcatgtgcaggactacaaggacacgcctccagccaaggccgcgagtagagagcctccagccggcgatggagagtctgcatgtgcaggattacaaagacacacctccggacaaagacgtggccgccgccgccaccgtaaggagcttgcagccggaggcggagaacctgcaggtgcaagactacaaagacgctaacatgtattatggtgcttaaccggcttatgcctaaggagcctatggtggctggggagagtacccatacctgaaccatgatggaacacagacaccaactgctggaacctatgctgacatgtactatggctatgctccatatggtgttgcaaccatggggcatgatggacatatttatgggtca

SEQ ID NO: 67756 - protein, 48 aa, Zea mays
  misc_feature: Ceres CLONE 1542703
MESLHVQDYKDTPPDKDVAAAATVRSLQPEAENLQVQDYKDANMYYGA

SEQ ID NO: 67757 - DNA, 660 bp, Zea mays
  misc_feature: Ceres CLONE 1542705
  misc_feature: Encodes the peptide sequence at SEQ ID NO. 67758
aaagctggagctccccgcggtggcggccgctctagaactagtggatcccccgggctgcaggaattcgtctcacccctagaaaaaatctagctctcccgtttctgctcgcaagtcacacacacagctccggtagatccggccctcgcctctggctccatgaagagattaacttcagacggcagggatcgatactagcaagcaagcaagcgtggcgcacgacttgtgcgaggacttggagctcgtcgccgacgacggcggcagcttcgatgactactactgggacgacgacttccatttccacgacgacggcttctccgcctcccctacgacccccggcagcggtggtgcgccccgccagcagcagcagatgggtgatatttcagcctcggactacaaagaaggcgaagacatgcacgggataccctgggaaagactcaactacaccagggaccagtatcgtccgatgaggctcagagagtacaagagctaccagaacctcacgaggtcgcacaacgggctacaacaacaggaatgcaaacaggtggagaggaaggacacattctacgagttccatctgaacaccagagccgtcaagtcaacgatagtgcatttccaggtacggcttcaactcggtacttctctgtccacacacctgaccga

SEQ ID NO: 67758 - protein, 97 aa, Zea mays
  misc_feature: Ceres CLONE 1542705
MGDISASDYKEGEDMHGIPWERLNYTRDQYRPMRLREYKSYQNLTRSHNGLQQQECKQVERKDTFYEFHLNTRAVKSTIVHFQVRLQLGTSLSTHLT

SEQ ID NO: 67759 - DNA, 649 bp, Zea mays
  misc_feature: Ceres CLONE 1542707
  misc_feature: SWISSPROT Homolog: EC 2.7.13.3 Histidine kinase
atagctggagctccccgcggtggcggccgctctagaactagtggatcccccgggctgcaggaattcgtctcacccctagaatatatgcttaaactacttacagaacagcgccggactgccttctccctgcctattctttctcccgttcaccccgcgtgcacgctctttcccttcctcgtgccgacgaccgggcgaccgccgcgccccggcccgcgcccccttgtctcgggccactcgccggcaacgagcagcctcctggatatgttgtgaggactgatgcaataactaagcttgctggatggacggatgcgattgcatcgagccactatggcctaccgacgatctccttgtctagtatcagtacatctcagacttcttcatagccctcgcgtacgtctctattccgttggagctcatatatctcgtgaagaagtcgtccttcttcccgtactgatgggtcttgattcagcttgatgcagttatagttctctgtggggcaaccatctgatatactgtggacgttcaccccactgcaaagaccgtgcgatggtcatgacgtagcaaggcttctacagcattgggtcctgtgcactgccttgagcttgttctttcctccccgacttatgagcgtgaaaactacaagttgtcc

SEQ ID NO: 67760 - DNA, 649 bp, Zea mays
  misc_feature: Ceres CLONE 1542711
  misc_feature: Encodes the peptide sequence at SEQ ID NO. 67761
  misc_feature (424)..(424): n is a, c, t, g, unknown, or other
  misc_feature (440)..(440): n is a, c, t, g, unknown, or other
  misc_feature (463)..(463): n is a, c, t, g, unknown, or other
  misc_feature (519)..(519): n is a, c, t, g, unknown, or other
catagctggagctccccgcggtggcggccgctctagaactagtggatcccccgggctgcaggaattcgtctcacccctagaaaaaatccccgcttgattagcggcagccactctctccctctccactcttggtgtccgagtcccttggccgtacgctctgcctcactccgtctcttgcttctcctgccgccggcgtcggagagcgagcttctcggcgggcggcggcggcgcgcggcgctgggtgcggatcggccgcgggtgcatggtggaagccgccgccgggcgccggtcaggcaccagccgtcggcggcctagcggcagcggaggggagcaccagcgcctggttgcgctcgccgtcgccgcgcgcttcgccatggtcagcacccggtctgcgggtccagcagtggcgggaggagatggagcnggagctgctggaacangcgccagccccgctgccggtagncggacgatgcatgggagacttcttcgactgcctcctcggctttgctcgcgcgttangcatgacatgtgctacggcgcggccccagcgggagccgctccccgcgctgcctcgcggggttgggggcggggctggagcaaccgaagcccggcggttcccagcggggctcagggccaccccgggcggatc

SEQ ID NO: 67761 - protein, 77 aa, Zea mays
  misc_feature: Ceres CLONE 1542711
  misc_feature (3)..(3): Xaa is any aa, unknown, or other
  misc_feature (8)..(8): Xaa is any aa, unknown, or other
  misc_feature (16)..(16): Xaa is any aa, unknown, or other
  misc_feature (35)..(35): Xaa is any aa, unknown, or other
MEXELLEXAPAPLPVXGRCMGDFFDCLLGFARALXMTCATARPQREPLPALPRGVGGGAGATEARRFPAGLRATPGG

SEQ ID NO: 67762 - DNA, 673 bp, Zea mays
  misc_feature: Ceres CLONE 1542714
  misc_feature: Encodes the peptide sequence at SEQ ID NO. 67763
  misc_feature (1)..(1): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (414)..(414): n is a, c, t, g, unknown, or other
  misc_feature (447)..(447): n is a, c, t, g, unknown, or other
  misc_feature (449)..(449): n is a, c, t, g, unknown, or other
  misc_feature (469)..(469): n is a, c, t, g, unknown, or other
  misc_feature (476)..(476): n is a, c, t, g, unknown, or other
  misc_feature (495)..(495): n is a, c, t, g, unknown, or other
ngacctggagctccccgcggtggcggccgctctagaactagtggatcccccgggctgcaggaattcgtctcacccctagaaaaacatactgcatacacaacgcagagcatcagaagcagctgcgatctgatcgacatggctgccgccaccatggctatcacctcccgcgcgctcgtcggcaagccggcggctggcacgagggacgtcttccgcgagggccgcatcaccatgcgcaagaccgccgccaagcccaagccggcggcgtccggcagcccatggtacggtgccgacccgcgcgtggacctgggcccgctgtccggctctcccctgagctacctgaccggcgagttccccggttattttttccccccccccccggggggatgaaaaggggannnnnaaaaccttccccanaaacccccacctccaaaaaaacacttccccctnanccatggggggggggggcccnggtcgcnttttccccgaagtggttcncccctaaacggcctccaatttgcggccaaggcggggtgagtttaaacgggggggttccggaattcttaacccaaggcgggataggaaaagtctgtgcgaacccccgacgacggcgccgcctggcccgtaaccccttgcccaacgtgcgtactgccacatgccccctacacacaaaggc

SEQ ID NO: 67763 - protein, 83 aa, Zea mays
  misc_feature: Ceres CLONE 1542714
MAAATMAITSRALVGKPAAGTRDVFREGRITMRKTAAKPKPAASGSPWYGADPRVDLGPLSGSPLSYLTGEFPGYFFPPPPGG

SEQ ID NO: 67764 - DNA, 627 bp, Zea mays
  misc_feature: Ceres CLONE 1542720
atagctggagctccccgcggtggcggccgctctagaactagtggatcccccgggctgcaggaattcgtctcacccctagaaaaacatgacccagttcacgaataacctcaacgtaccgccgccgctcgcctggtctcacctcgccggacaatagttagatcacaggacaaccccgtctccggggcgcaggtctcggcagcttccgtgacccaacgaccaatcctgcctcagctgccctccctcctcccctctgggcgtggccgagttgtacgcatcacggctagagttgcagccaccacggcgcggccccgcaagatgcccaggtggagcctcgggcaccatcgcctccgctgtcgcgtccagaccctctccgcacggcggtcgcggggcgctaccctcggtcggaggatacccggccgatctcctcttcctcgccggcggaggtcgcctctgtaccgtttctgtctctcaccttcttcctttcatatcttttaatcacttctgctactcccccggaccccgacttatgttctcacaccgagagtaactgaccgacctaccggcctggatattaagctgaccatcaaggaggtgccctgcgtcgtctccaactacctgaaggacgcc

SEQ ID NO: 67765 - DNA, 659 bp, Zea mays
  misc_feature: Ceres CLONE 1542723
aagctggagctccccgcggtggcggccgctctagaactagtggatcccccgggctgcaggaattcgtctcacccctagaaaaatttcccctgatctttccctcgttcctctactcccgttttccagctccggagatcccttctcggccgcctcctgtggcctccgggatacaagagggcagattccggcgaatacttgaagacaattgtccccctcacctcccatccatgcgattcctaacagttgtccttggttccccacgaatcccccggcttctattcgatcgagtcctacccagttgtatgtggtgagttgaggtgcgatgatccttctctcgctgcacttttcactttatcctcgctgtccctggtgtcttccattccatgcagtccccgcacgaatcctcacatcagcctgagattcacctcgctcttgccgcgaactcccgctgccgacttgtgcgtaacgacagcaggtcatctgctcccagcatcgcctgatgttttctctccactccacggacggagcacccgacgctcacgttgaggacatcgaagagctctcctcccgcctgtgcgtggtcatccttgccctcatgctcgtcaccttccttgtcgtcatcctgctcctgctgtccatggcttgcgcctgtggactga

SEQ ID NO: 67766 - DNA, 782 bp, Zea mays
  misc_feature: Ceres CLONE 1542725
  misc_feature: Encodes the peptide sequence at SEQ ID NO. 67767
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttttttgtgggttggttnncccccccggcantnnnnttttnnnnnnntcacagctggagctcaccgcggtggcggccgctctattttagtggatcccccgggctgcaggaattcgtctcacccctagaaaaaacaccggtgagccacatcgagagcacgatcgagcacacaagcacgaagactcgtttaggagaaacgacaaaccacgaagccgtgcaagcatcatggagtacggtcagtaggggcagcgaggccacggagcctcgggccatgtcgaccaggaaggaaacccagtcggcggtgtcgagccaggtaccggcggcatgaggcgcggaacgggaaccaccggagggatgggccagctgggtgagcacgggggccctgggatgggaggcggggggttcccagcctgcgaggggacgagcacaagaccgggggggatactagcattcgctccgggtagatccaccccccagcttcgtccggaagaagaacgtgcattgggcctgacagggaggaaggaaaggcaatcctagggttggacaatctacgggggcaagtttggcccccgggaggccacaagaggactaaccagggccctcctacggggggtcgaaacgggggggcccccctttgtgggcacggcagggaatgtcacccgggtagcccccctatcgggccacaagggggtaaatttcccggggggggcgtctttactcccaagagggattcccgagggggctctcggggagcaagaatacagggggttttttttgggg

SEQ ID NO: 67767 - protein, 70 aa, Zea mays
  misc_feature: Ceres CLONE 1542725
MRRGTGTTGGMGQLGEHGGPGMGGGGFPACEGTSTRPGGILAFAPGRSTPQLRPEEERALGLTGRKERQS

SEQ ID NO: 67768 - DNA, 647 bp, Zea mays
  misc_feature: Ceres CLONE 1542726
  misc_feature: Encodes the peptide sequence at SEQ ID NO. 67769
aagctggagctccccgcggtggcggccgctctagaactagtggatcccccgggctgcaggaattcgtctcacccctagaaaaaatacccaaacccaccgcaccgccgcctaggcttccacctctcccgctcaaactccggccactgaggtcgaacccgagcccgcgccgcatcggcacgatggtgaacgactccgcggcgatggccgtcgtgagggcggcgcgcccagccctccgtggcgcccacgatggcgtcgccttcgccgcccacgccgccttcctcgccgatgggtactcgctctgcgccggcggccctgccgcgctcgccgacccctcgcccttatgtgatgaggacgtggggattgatggtctggaacatcatggagaattgttacgcctttttgtctaacacggaggagaacggcaagcaacataagggtactagtgaaatgtctggtgatcggtgaactacttgcgattgatgtcttggatcttgaggcacaccatcacgcgccttataatatccagattaatgtgtcagacttctttgaccaagatcacctaagaattatcgggatatgtccaagacttttacacgtctcattgagactgtgaactctaatgtgtcgtgcacatcggatggagactg

SEQ ID NO: 67769 - protein, 75 aa, Zea mays
  misc_feature: Ceres CLONE 1542726
MVNDSAAMAVVRAARPALRGAHDGVAFAAHAAFLADGYSLCAGGPAALADPSPLCDEDVGIDGLEHHGELLRLFV

SEQ ID NO: 67770 - DNA, 525 bp, Zea mays
  misc_feature: Ceres CLONE 1542727
  misc_feature (75)..(75): n is a, c, t, g, unknown, or other
  misc_feature (76)..(76): n is a, c, t, g, unknown, or other
  misc_feature (169)..(169): n is a, c, t, g, unknown, or other
  misc_feature (249)..(249): n is a, c, t, g, unknown, or other
  misc_feature (255)..(255): n is a, c, t, g, unknown, or other
  misc_feature (256)..(256): n is a, c, t, g, unknown, or other
  misc_feature (297)..(297): n is a, c, t, g, unknown, or other
aagctggagctccccgcggtggcggccgctctagaactagtggatcccccgggctgcagggaaattcgtctcacnnccctagaaaaaaaccctccggctccaatggcatccctccggctcgtggcaacgctagcgccctccggtcctccgccgccaacctcgacgtaangcagcgggagaccgtccctccgcagtcccgtctgacaggtggggatggggcctgggcggcagctgctgccgttggcggcngccgcnngccgcttcaccaccgggcttcgcggcgctgcccaaccggcnaaacggctttctcctggccaacctggggccgtccacgttttccaaggtccccaaaatgggtaacgccatttggttggttttgagaatcccggcaaaaaaaagggctcccaagggtttgaaaaagcccccctccgggggggagtgtcccccttttttgggggaaaaaagtgtggtgtttctccccgggttttttttctccaaaaataaaaaaaatctcttttaagattt

SEQ ID NO: 67771 - DNA, 739 bp, Zea mays
  misc_feature: Ceres CLONE 1542728
  misc_feature: SWISSPROT Homolog: EC 3.2.1.23 Beta-galactosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (269)..(269): n is a, c, t, g, unknown, or other
nnnccccnnaaaaaaaaaaaaaacaaaaacaggggtcncggnnnnnccaaactggagtccccgcgtggcggccgctctatactagtggatccccgggctgcaagaattcgtctcacccctagaaaaagaaagaaagaaaatgtctcagcaactgcatgcatgtgttcctggtccctcactgctgtgacttacagagtattatatatatattagtactatgtatactggtcctcatttacatatcaaatggtatagggttttctatttcnccttacctataaattatacaaagaaaaaaaaaaaaaaaaacgagacgctcgaggtacccaattccccctatagagagtcgtattacgcgcgctcactggccgtcgttttacaaacgtcttgactgggaaaaacctggcgttacccaacttaatcgccttgcaacacttccccctttcgcaagctggcgtaataacaaaaaagcccggcaccgatcgcccttcccaaacatttgccccaccctgaatggcgaatggaaattgtcagccgtaaaaattttgttaaaaatcccccttaaaattttagtaaaatccaacctcattttttttaacccaattaagcccaaaatatccgggaaaaaaccccctttataaataccaaaaaaaaaaataacccccaataataacgggcttgaaaatgtgtttttctacacatgttttgggaaaaccaagaaaagttccctctcttattt

SEQ ID NO: 67772 - DNA, 648 bp, Zea mays
  misc_feature: Ceres CLONE 1542730
  misc_feature: Encodes the peptide sequence at SEQ ID NO. 67773
acgctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgccacggggtccagttcggcgaggccgtgtggttcaaggccggctcccagatcttcaccgagggcggggtgggacttacccgggaaaccaagcctcatccacgcccaaaacatccctggctatctggggcctgcc

SEQ ID NO: 67773 - protein, 165 aa, Zea mays
  misc_feature: Ceres CLONE 1542730
  misc_feature (65)..(165): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARHGVQFGEAVWFKAGSQIFTEGGVGLTRETKPHPRPKHPWLSGAC

SEQ ID NO: 67774 - DNA, 605 bp, Zea mays
  misc_feature: Ceres CLONE 1542731
  misc_feature: Encodes the peptide sequence at SEQ ID NO. 67775
aaactggagctccccgcggtggcggccgctctagaactagtggatcccccgggctgcaggaattcgtctcacccctagaaaaaatccggccaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaaggacaacctcatcaacaagctggtgtccgacgccgacatcccggagccgccgctgttcacggcatcgcacagctgggaagacaccccggagcagagcgtgcggctgaccaagcccgacctgtcggcggcggagcgggtccaggaggccgtgggctgcctcccggcgcggctggaggccgcgctggccgccgacgcgcgcggcatcatgcgctg

SEQ ID NO: 67775 - protein, 134 aa, Zea mays
  misc_feature: Ceres CLONE 1542731
MGLFSSPAKVYKPAADVDLGPGSDELYISPNVKAPRVAGLLVKIFVWILEMPIVGQIVLYILKKDNLINKLVSDADIPEPPLFTASHSWEDTPEQSVRLTKPDLSAAERVQEAVGCLPARLEAALAADARGIMR

SEQ ID NO: 67776 - DNA, 628 bp, Zea mays
  misc_feature: Ceres CLONE 1542735
  misc_feature: Encodes the peptide sequence at SEQ ID NO. 67777
tggagctccccgcggtggcggccgctctagaactagtggatcccccgggctgcaggaattcgtctcacccctagaaaaatgcccccctgttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcatcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggatgctgcagaggccacactcaagtacaatgtggctatcaagtgtgccaccattacaccagatgaaacaagggtaaatgagtttggcttgaaggctatgtgcaagagcccaaatggcccaattaggattattctgaatggcactgtgttccgaaaaccatcatctgcaaaacatcccacgggctgttccagggtggacaaaacccatttgcatccggagggatggattccgggatcagg

SEQ ID NO: 67777 - protein, 139 aa, Zea mays
  misc_feature: Ceres CLONE 1542735
  misc_feature: SWISSPROT Homolog: EC 1.1.1.42 Isocitrate dehydrogenase (NADP(+))
MAFNKIKVSNPVIEMDGDEMTRVFWKSIKDKLIFPFVDLDIKYFDLGLPHRDATDDKVTVDAAEATLKYNVAIKCATITPDETRVNEFGLKAMCKSPNGPIRIILNGTVFRKPSSAKHPTGCSRVDKTHLHPEGWIPGS

SEQ ID NO: 67778 - DNA, 705 bp, Zea mays
  misc_feature: Ceres CLONE 1542738
  misc_feature: Encodes the peptide sequence at SEQ ID NO. 67779
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ttttttttttttttttttnnnnntttgtnnnntnntgnnnagctctcccttcaaaactggtactccacgcggtggcggccgctctagaatagtggatcccccgggctgcaggaattcgtctcacccctagaaaaagcgatgcgacctcgtgttacatgctactacggccgtgtataaacagcgatcagtctaccgtgaccacccccatcctctctaacccacggaagcaaggcaaaaaagctcgtgctggacgacatctcccctgtcgatccacgaccatgatgcagcagctccgtcacagccagccgagcccgtgcctctgcggcctgcgggcggcacggcctatgctcgcgctcggcgcagcagcatcccgttcgcggcccgccggaaaactgcaaccgagcgcctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccgatcccgacgggcgcggggtgaaggcggaggcgtcggtgctggacgccgtcgtgggcagcgggaacagcgagctcgacgtggacctgatctgggacgaggcgctga

SEQ ID NO: 67779 - protein, 142 aa, Zea mays
  misc_feature: Ceres CLONE 1542738
MMQQLRHSQPSPCLCGLRAARPMLALGAAASRSRPAGKLQPSACLGLGHVAPAAARGQPRPRAVADSALGASPTSVHVGGKLLLQNFAADSQQRLKLSIQLVSATVADPDGRGVKAEASVLDAVVGSGNSELDVDLIWDEAL

SEQ ID NO: 67780 - DNA, 658 bp, Zea mays
  misc_feature: Ceres CLONE 1542746
  misc_feature: Encodes the peptide sequence at SEQ ID NO. 67781
  misc_feature (518)..(518): n is a, c, t, g, unknown, or other
  misc_feature (526)..(526): n is a, c, t, g, unknown, or other
aaagctggagctccccgcggtggcggccgctctagaactagtggatcccccgggctgcaggaattcgtctcacccctagaaaaaaaaaacaaacaattttccccatttgccattcccgacgagcaccttcaccgtctcctcccagtcccacctcgcgtggcacgccatggctttctccccgcgctcgccgtggtcgcgtgccaagaaaaccgacgtctactcaaccttcgttgtccacggcgatgacgatgaagacgacgcccgcggcggcaggggcccctccacgcgggcggaggaagacgaggaggaagacccctcctcgctgcctccgcttcttcagcggctccccaaggactttggcggcgcctcgttcgacgacgacgaggacccctactcctccgaccctgacgatgcttccctctctgcccacgcggtcttcaagagcggcgtcacggccctccgtcgatctccgtgcctggatctgcagagctcaagccccgcgctaccgatgacgaccngtactctnactttcgtcgtcattccaccacacgctcggggaagaactcctccagcctcgcggagccgcttcggaaaaattaatcgtcgcccgggaagtcgtctaaccctcgcaaatccttcctgggaaattaatccccgg

SEQ ID NO: 67781 - protein, 164 aa, Zea mays
  misc_feature: Ceres CLONE 1542746
  misc_feature (118)..(118): Xaa is any aa, unknown, or other
MAFSPRSPWSRAKKTDVYSTFVVHGDDDEDDARGGRGPSTRAEEDEEEDPSSLPPLLQRLPKDFGGASFDDDEDPYSSDPDDASLSAHAVFKSGVTALRRSPCLDLQSSSPALPMTTXTLTFVVIPPHARGRTPPASRSRFGKINRRPGSRLTLANPSWEINPR

SEQ ID NO: 67782 - DNA, 665 bp, Zea mays
  misc_feature: Ceres CLONE 1542758
  misc_feature: Encodes the peptide sequence at SEQ ID NO. 67783
aaagctggagctccccgcggtggcggccgctctagaactagtggatcccccgggctgcaggaattcgtctcacccctagaaaaatatctgcccccaattggtgtagtgcagaccctacgcgtccccttccgcagccggtactcaaccccaaccctatcctgtccgccgccgtcgcccggcgcctcctcccccacctagaaacccagaggctctaatcctagttatttctgtgcagtcgccgcccaattcccccacccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaagggctacgtcgggatccacagttccggtttcagagacttcctgctcaagccagagctgctccgtgctatccaggattgtggttttgagcatccttccgaaggtacactttcttctttggagaagaacatggtaacactttccattaacatggatccagaaagttaaacttttactcccagggttgctgctccaatttcttttggttcaagatcagtgcaacacgagtggtatccctcaagccattcttggaatggatg

SEQ ID NO: 67783 - protein, 93 aa, Zea mays
  misc_feature: Ceres CLONE 1542758
MGEAKENDVYEEELLDYEEDDDKTVDGSAAKPTGEVAKKGYVGIHSSGFRDFLLKPELLRAIQDCGFEHPSEGTLSSLEKNMVTLSINMDPES

SEQ ID NO: 67784 - DNA, 658 bp, Zea mays
  misc_feature: Ceres CLONE 1542760
  misc_feature: Encodes the peptide sequence at SEQ ID NO. 67785
aaagctggagctccccgcggtggcggccgctctagaactagtggatcccccgggctgcaggaattcgtctcacccctagaaaaattccttccctccccctccctgctcggtgctcgcacacgctggcgcggcttgcccccacgctgcgctcccaccaccaccactatataatccccgatcgcctcacgcacacgcaccgacccaccggccgacgaggggcgaccgccgcaacacaaatccacacgcccgccgccaccgccaccgccgccatacggacccactcctcctttgccctggtgcgagcaggcttcggcagcaaaccccgcagactgctcccggacgagggagaacgcgcggggctgggctagccgctacccgctagccaggggaccggggcggaggcagcgaggaggtacgtatggacaagtacgaggcggtgcgggacatcgggtcggggaacttcggggtggcgcggctgatgcccaaccgcgagactcgagagctcgtcgccgtcaagtgcatcgagcgtggccaccggattgacgagaatgtgtacagggagatcatcaaccaccgctcgctgcgccatcccaacattattcgcttcaaggaggtgatacttacaccaacacatcttatgattgtgatggagtttgca

SEQ ID NO: 67785 - protein, 80 aa, Zea mays
  misc_feature: Ceres CLONE 1542760
  misc_feature: SWISSPROT Homolog: EC 2.7.11.1 Non-specific serine/threonine protein kinase
MDKYEAVRDIGSGNFGVARLMPNRETRELVAVKCIERGHRIDENVYREIINHRSLRHPNIIRFKEVILTPTHLMIVMEFA

SEQ ID NO: 67786 - DNA, 779 bp, Zea mays
  misc_feature: Ceres CLONE 1542766
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
nnnnnttttggggaaggagtataacatttgtaggtttatgcgtttcgccacgcgcttcaaaccacatcacaccagggtggcggccgctctcccataaaggatcccccgggctgcaggaattcatctcacccctagaaaacagactgtcgatccgtccgggagaatccaggccaatgcctaattgacctcatctccctcaaaatctagaagaataaagtcgccgagtatgtgcacaagttagctcctcgccaacatgtgcgcatttagaccgacagagtcgctgtagtgaattcagctcgtgttagctcctggctaacgagctgaccatacggctttagttttgtgaagtgggcgcgatttcgtcatgtcatgcatgtgctagctccctggatacctgcaaatgcgtgtgttgagcgcaagtttttgtcaacatctgcgtcaacctcctggccttaacaacaagtggttcccacccccatttcccctgcgtcagaatcccagaaataacacaagaagttattttggtagaatcagttccttgaacataatacaccatctcttaaggctgagaaaaaaactaccagaaatttcttgtttgcctgtggaaaccttctaaaaaaatattcaatttaacattcccccattttctcatatttgtgccggtataaaaaagggtgcaaaaaacccgagccgcctcctctaaggatgacccacaaaattcccccccccttcataacgggagggtcagaaattatagggacaccgaaaactaatactgg

SEQ ID NO: 67787 - DNA, 648 bp, Zea mays
  misc_feature: Ceres CLONE 1542767
  misc_feature: Encodes the peptide sequence at SEQ ID NO. 67788
tggagctccccgcggtggcggccgctctagaactagtggatcccccgggctgcaggaattcgtctcacccctagaaaaagtctgtccagaaatacattagaaaaaagagccaaagaggagaacaccggccggcgaggtggacgaagcggcccgccgaggaaatggcgtcgatgcagagctggcgcaaggcctacggcgccatcaaggacaccaccaccgttagcctcgccaatctcaactccgacttcaaggatctggatgtggcgatcgtgaaggcgactaaccacgtggagtgcccgcctaaggagcgacacctgcgcagtgcgttgatttgttcttgtaccccgtgtttccgcgtatctaggcttcggcctaatttagtgtttttctattgggggcgggcggaattagatcgtgcctataagtggcgaggggaggctctgaaggggagggaagggcgtgcgtgcttttgggttcgtgcagtgtttaatgatggttgattgttgcgtggtggtatcacaggggttgttgcggcgacgtccatcaccaggcctcgggcagatgtcgcctactgcatccacgcgcttgcccgccgtcttgccaagacccgcaactggatcgttgctctaaaagcacttgtagtgatcc

SEQ ID NO: 67788 - protein, 112 aa, Zea mays
  misc_feature: Ceres CLONE 1542767
MASMQSWRKAYGAIKDTTTVSLANLNSDFKDLDVAIVKATNHVECPPKERHLRSALICSCTPCFRVSRLRPNLVFFYWGRAELDRAYKWRGEALKGREGRACFWVRAVFNDG

SEQ ID NO: 67789 - DNA, 662 bp, Zea mays
  misc_feature: Ceres CLONE 1542768
  misc_feature: Encodes the peptide sequence at SEQ ID NO. 67790
  misc_feature (645)..(645): n is a, c, t, g, unknown, or other
tccccgcggtggcggccgctctagaactagtggatcccccgggctgcaggaattcgtctcacccctagaaaaagagaggtcctgttcagcaagatgattagaagcattggcatggcttgttaattacattcgtggttcttagtctaaaatcacattgaagagggagacggacccaagtgatgcagttcatgtgttatctgtatcaatctctatttttataagctgtcatatattttctcgaaactatcttgtgttgattttgtgtgaagtgcacttttaatggcacgggccatgtatttcccttggaaacgaccatgagagtttgtatatggacttattttttttcccattttctttccctcccctcgcctgtgtagttgcttgaaaaaaaagggttggaattatccttttaaaaaaaaaaaaaaaaaacaaaacgcttcaagtacccccattccccccttaatgggagccgatttacccgcgcttcccgggcccgcctttttaccacctccttgacatgggaaaacccctggcctttcccccaatttaatcccccttgacaaacaatcccccctttttccccagttggggaaaaaaaacaaaaaaagcccccccccccaatgcccccttcccacaacagtttgnccccccccttagagggg

SEQ ID NO: 67790 - protein, 31 aa, Zea mays
  misc_feature: Ceres CLONE 1542768
PRGGGRSRTSGSPGLQEFVSPLEKERSCSAR

SEQ ID NO: 67791 - DNA, 609 bp, Zea mays
  misc_feature: Ceres CLONE 1542769
  misc_feature: SWISSPROT Homolog: EC 3.2.1.23 Beta-galactosidase
ggagctccccgcggtggcggccgctctatactagtggatcccccgggctgcaggaattcgtctcacccctagaaaaaaggaaaagactatttaaacccggataaattactatagagttgttgtcataggcaaagggcctggatgtaattttacatgggttgcgactcgtgcttataaatagatgaacagtactcccgtactgttcacgctgacttggcatccacttttgcgtcacgcctgtattctctttccttcaagccgaaggtacatttgtaatttatcattgttcacacaagtaatataaatgagaataaattcatcaacaacttacaaaaaaaaaaaaacgagacgctcgaggtacccaattcgccctatagtgagtcgtattacgcgcgctcactggccgtcgttttacaacgtcgtgactgggaaaaccctggcgttacacaacttaatcgccttgcagcacatccccctttcgccagctggcgtaatagcgaagagccccgcaccgatcgcccttcccaacatttgcacaccctgaatggccaatgaaaattgtacgcgttaatattttgtaaaattcccgttaattttttgtaaatcgcc

SEQ ID NO: 67792 - DNA, 703 bp, Zea mays
  misc_feature: Ceres CLONE 1542771
  misc_feature: SWISSPROT Homolog: EC 3.2.1.23 Beta-galactosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (56)..(56): n is a, c, t, g, unknown, or other
nnnnnnnnnccccnccaacaataatcaaaacggggagagcnacgnnnctatgcntntgaatactggagctccccgcggtggcggccgctctagaatagtggatcccccgggctgcaggaattcgtctcacccctagaaaaacgtagtagtgcccattctacacagcttatactgggcagtgggttgcatagttgccagaagcttgtacatgtctttaaaccgccatcggattgcgatggagtagtattactgaaagggaaatgtgcccttgagccatttctaagtattttggtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaccctgaatggcgaatggaaattgtaaagcgttaatatttttgtaaaaattcggcgttaaattttttgttaaatccagctccatttttttttacccaatagggcccgaaattccggccaaaaatcccctttattaaatccaaaaaaaattaaaccccgaatataaggggtttgaaggtgttgttttcccagtttttggga

SEQ ID NO: 67793 - DNA, 793 bp, Zea mays
  misc_feature: Ceres CLONE 1542777
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
gaaaggtgtggttttttttttttcctacaaggtcnnnnnnncncnncnnccncaaaaccggaactccccgcggaggcggccgctctatactagtggatcccccgggctgcaggatttcgtctcacccctagaaaaacatatgaagatctctaggtccagcggacgcaagaacttatgtctgtgtcagtgtgcgttgattatttacgtgcggtttgttgggcatacgggcatgggttggtgctgcaattgcaactctattatggcttgtgagagcaaacaaacgtctgtattcattttcagatgcctgaacccaggcttgtattataccgcttgactccataaaattattcttgagtatctatgcttgaaaattttgccgacaattaccttgaacgccccttggtaaaaaaaaaataataattaacgaagaaggctccgaagtaccccatttccccccctttagtgaagttcgttttttttcccccccccccttggggccggccactttttaaaaacgctccgtgacactggggaaaaacacccgtggcgtttttccccaacctttaaatttcccttttgtaagtaaaattccccccactttttcaccacacttggggcgttaatttgcgcaataaagagccccccaccggtattgccccttttcccaaaaaattttgcggaacccctatagagggacatatagagaaattttgtgaaaaccccctactttttttgtgcatatataccgcgggcgtaatttttttatagtaaatagacctctattttttttttt

SEQ ID NO: 67794 - DNA, 700 bp, Zea mays
  misc_feature: Ceres CLONE 1542781
ccccgcggtggcggccgctctagaactagtggatcccccgggctgcaggaattcgtctcacccctagaaaattgcttttgggagacgcctatatattgcgcctgatctgctgaattacctagcagttgctattaatctatccagaagacttggattgagtttgattgctatgtaaccacgcggttggttctgtacttgtacgcaactgtgcgacattggcaaatggtggtgccgttgacctttatggattattgtgcccccatcaacatgttattactagcccccttcggcatttccaaaaaaaaaaaaaaaaaacgagacgctccaggtaccccaatttcgccctatagtgggtcttattacgcgccgctccctggccggtcgtttttcaacgtcgtgactgggaaaaaccctggcgttaccccaactttaaatcccctttgaacaccatccccccctttccgccagttgggctaaaaaccaaaaaagcccccccccgattccgcccctccccaacaattttgcccaccctggattggcaaaagggaaatttttaaccccttaaaattttttgttaaaaatccccggttaaaatttttttgtaaacacccccttccttttttttttaccccaatagggcccgaaaactggggggaaaaatccccctttaaaaaccacaaaaagaaataaaaccccgggg

SEQ ID NO: 67795 - DNA, 653 bp, Zea mays
  misc_feature: Ceres CLONE 1542786
  misc_feature: Encodes the peptide sequence at SEQ ID NO. 67796
aaaactggagctccccgcggtggcggccgctctagaactagtggatcccccgggctgcaggaattcgtctcacccctagaaaaaattacgcccttggctcgtacgtacttactcactctccccccacccgcgccaggccagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtcttagaggtgaaatgagtggggccggccggctcaagggctccgcgctagctaccgtgtgattgatttgtagtagttgt

SEQ ID NO: 67796 - protein, 136 aa, Zea mays
  misc_feature: Ceres CLONE 1542786
  misc_feature (75)..(136): Pfam Name: PSI_PsaE Pfam Description: Photosystem I reaction centre subunit IV / PsaE
MASTNMASATSRFMLAAGVPTGSSGGRVNFASAPNRLGRRLVARADNEAAAAEAAEGEGAVATKPKAEKPPPIGPKRGAKVKILRRESYWYNGIGNVVTVDQDPNTRYPVVVRFNKVNYAGVSTNNYALDEVLEVK

SEQ ID NO: 67797 - DNA, 670 bp, Zea mays
  misc_feature: Ceres CLONE 1542796
  misc_feature: Encodes the peptide sequence at SEQ ID NO. 67798
ggagctccccgcggtggcggccgctctagaactagtggatcccccgggctgcaggaattcgtctcacccctagaaaaacctagaaaaacctagaaaaaattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataaaataaaaaaaaaaaaaaaaacgagacgctcgaagtacccaattcgccctataatgagtcgtattaccccgcgctccctggccggtcctttttacacgccgtgactgggaaaaaccctgggcgttacccaatttaattccccttggaagaaattcccccttttcccccggtggggttataaaccaaaaaaagcccccccccaattcgccctttcccacaaaatttcccccccccccgatgggcaaaagggaaatttttaaacccgtaaaatttttttgttaaaaa

SEQ ID NO: 67798 - protein, 90 aa, Zea mays
  misc_feature: Ceres CLONE 1542796
  misc_feature: SWISSPROT Homolog: EC 4.1.1.39 Ribulose-bisphosphate carboxylase
MPALTEIFGDDSVLQFGGGTLGHPWGNAPGAAANRVALEACVQARNEGRDLAREGNEIIKAACKWSAELAAACEIWKEIKFDGFKAMDTI

SEQ ID NO: 67799 - DNA, 656 bp, Zea mays
  misc_feature: Ceres CLONE 1542798
  misc_feature: Encodes the peptide sequence at SEQ ID NO. 67800
  misc_feature (656)..(656): n is a, c, t, g, unknown, or other
aaagctggagctccccgcggtggcggccgctctagaactagtggatcccccgggctgcaggaattcgtctcacccctagaaaaaagcaagctcatcagcattcgaccgctccagctagctgcagtgtgtagagccataccaaagcctgcttgtgttgtgttgtttctcttctgctcctcgctcgcacgaataatcagttcaaaccaatggacgggaagaaggtgcaggagagggcggcatggggagccagcgacggcggcggcaacctggtgcaggacgccgtcgactacaggggctgccgggcggacaagtccaccacgggcgtgggtttttttccgcgctccccttaaccgttggcgcacaggcaaatgacggcggcggcctcatgccggagctcccgcccagcggcctcatgcccatgccggagctctcacccagcggctctcccacgccatttgtccccttcctggcgcctgctccgctcgcgccattctttaacaacagcacgccaaagctctcaggaaaatgcacgctgaactttaccgctgtcgacaaactcatgaccaccacggctgtcgactgcttcacctcgtttgctcctttcctggccaatgtcatctgctgccctcagcttcaggcaacactgaccatcctcn

SEQ ID NO: 67800 - protein, 139 aa, Zea mays
  misc_feature: Ceres CLONE 1542798
MGSQRRRRQPGAGRRRLQGLPGGQVHHGRGFFSALPLTVGAQANDGGGLMPELPPSGLMPMPELSPSGSPTPFVPFLAPAPLAPFFNNSTPKLSGKCTLNFTAVDKLMTTTAVDCFTSFAPFLANVICCPQLQATLTIL

SEQ ID NO: 67801 - DNA, 650 bp, Zea mays
  misc_feature: Ceres CLONE 1542802
  misc_feature: Encodes the peptide sequence at SEQ ID NO. 67802
aaagctggagctccccgcggtggcggccgctctagaactagtggatcccccgggctgcaggaattcgtctcacccctagaaaaagagtctttgtcccatccaacatctcgatccatcccagcatcatccccacaattgaggcgattgaagcagaaaaaatcagtcgccgtagcagcgccgcctccgccgccgtggggaggtagcatctaggcccattccgccgcctccatctccggccagcaatggcttcggcggtggagcggcggagggaggagcacgcgcggagatcgcgttccccagcacggggcagggagcggaggggaacgccgccacgcaggcggagttccccagagcggaggaagggttcgcctgctagggcacggtctcctgctgcgaagtcaagtgcgtcgcatagggacagggagaggtcgcctccgagggagaaggtgaaggagcgtgtcaggtcgccagagtctcctgctaaggtcagcctgttgcacaaggggagagagaggtcgtctcccagggagaaggcgaaggaccagcgggtcaggtcgccgaaacgtaagcaggagcagtcacgatcaccctcacctgctaggcgacacttctctaggtcgccctcgccgcgctccaagaggacgagggga

SEQ ID NO: 67802 - protein, 136 aa, Zea mays
  misc_feature: Ceres CLONE 1542802
MASAVERRREEHARRSRSPARGRERRGTPPRRRSSPERRKGSPARARSPAAKSSASHRDRERSPPREKVKERVRSPESPAKVSLLHKGRERSSPREKAKDQRVRSPKRKQEQSRSPSPARRHFSRSPSPRSKRTRG

SEQ ID NO: 67803 - DNA, 542 bp, Zea mays
  misc_feature: Ceres CLONE 1542805
  misc_feature (175)..(175): n is a, c, t, g, unknown, or other
  misc_feature (186)..(186): n is a, c, t, g, unknown, or other
  misc_feature (187)..(187): n is a, c, t, g, unknown, or other
  misc_feature (264)..(264): n is a, c, t, g, unknown, or other
aagctggagctccccgcggtggcggccgctctagaactagtggatcccccgggctgcaggaattcgtctcacccctagaaaataagagcgtgcagagcgagacgcgtcgcctcctcccttcccccaccccgccgccgccctcgcgtccgtccgtccgttattagggttcggtcgnccgccatgggnncgatccctctcggcgctcgccacgaagtgctcatccccgtcgcccgcgtcatcggcatcgcctttcgcgtcgtgcantgggtggtcgtgtcgcgcgtgaagctctccccgggccgcgttcgggcgggcaccgggcgggaaaaggccgggttaaccccgaactcccctcattccaagagagaaagaaaggggtttcaaggaaccaaaaaagttcttcgttaaatgtggccccaaaattcccaaaaacccctttttccccaaaagggagaaaacattgcttttttcttttttcccccgaaataaacaaaaatttggggggggaatttctccaggggggtatattctctcccgggtga

SEQ ID NO: 67804 - DNA, 593 bp, Zea mays
  misc_feature: Ceres CLONE 1542806
  misc_feature (145)..(145): n is a, c, t, g, unknown, or other
  misc_feature (177)..(177): n is a, c, t, g, unknown, or other
  misc_feature (178)..(178): n is a, c, t, g, unknown, or other
  misc_feature (223)..(223): n is a, c, t, g, unknown, or other
  misc_feature (228)..(228): n is a, c, t, g, unknown, or other
  misc_feature (236)..(236): n is a, c, t, g, unknown, or other
  misc_feature (237)..(237): n is a, c, t, g, unknown, or other
  misc_feature (247)..(247): n is a, c, t, g, unknown, or other
  misc_feature (258)..(258): n is a, c, t, g, unknown, or other
  misc_feature (282)..(282): n is a, c, t, g, unknown, or other
  misc_feature (315)..(315): n is a, c, t, g, unknown, or other
atagctggagctccccgcggtggcggccgctctagaactagtggatcccccgggctgcaggaattcgtctcacccctagaaaaatccggatccgtccgctctgatcgagaagtgagttgatctggactctgtgcctgcctgtganggcgaagagggcatggacgagttcgagctggnnagacacctcgagttcatcctccagagcatccagaagctgatggangaccnggggggannacacgccttncggagacgccnacccgaacgagctctttcgcagcnttcgtttactacgaccaggagaacatgcctgcnaaacttgtctgccccggaacttggctgccggggaaaacattttcagggaatcccctggggaaaaaattgcccttcgggagggataattaccggggatagaaaaataaaaaaatccccagattttcccaattttttttttccccccgggggatcctttttgggggtggcaaaaaatgggaaaaaggggggccctcttttttatttttccccccaacacaagggggggggccgccccctcttttttatatttttttccccaggaaacctatgtggggggc

SEQ ID NO: 67805 - DNA, 653 bp, Zea mays
  misc_feature: Ceres CLONE 1542808
  misc_feature: Encodes the peptide sequence at SEQ ID NO. 67806
atagctggagctccccgcggtggcggccgctctagaactagtggatcccccgggctgcaggaattcgtctcacccctagaaaaaatcaattagatattattacataaaaacacctctcggccacctccaccgcaccccgccccgactcctacccagatgccggccacggccagcggcggcgcgcggccggaggaggtgtcgcccgcaccatcggcgtcggcgtctgcgtcgagctgcatggggacgagggcggaggagctgacggcgaggctggcggccgcggggccctccccgggcgccggtgccggcggagaggaggtggagcacgagcgcgtccgcgcgctgcgcgagatcaagaaccagatcatcggaaaccggaccaagaagctgctctacctccgcctgggcgccgtgcccgcaatcgtggcggcgttggcggatcccggagcctcgccggcggcgctcgtgcaggcggcggccgcggcagggagcttcacgtgcggcgtctaagactgcgcgcgcgccgtgctggccgccggcgctgtggggtacctcactcggctcctcgctcaccccgacgagaaggttgtggatgcaagtgcacgtgctcttagaatgatatatcaatcaagattagctccaaagtttgatgt

SEQ ID NO: 67806 - protein, 117 aa, Zea mays
  misc_feature: Ceres CLONE 1542808
MPATASGGARPEEVSPAPSASASASSCMGTRAEELTARLAAAGPSPGAGAGGEEVEHERVRALREIKNQIIGNRTKKLLYLRLGAVPAIVAALADPGASPAALVQAAAAAGSFTCGV

SEQ ID NO: 67807 - DNA, 653 bp, Zea mays
  misc_feature: Ceres CLONE 1542810
  misc_feature: Encodes the peptide sequence at SEQ ID NO. 67808
caagctggagctccccgcggtggcggccgctctagaactagtggatcccccgggctgcaggaattcgtctcacccctagaaaaaatcaaactcttgtcctcaccccggaaccacgctagctctattgagaagtgcagcagcatgaccagcgggagaagtgttacttagttgctcctcctacctgtgctgctgcgcaggaactcagcctgaaaggacgactgccgtcggcgtaaggggagcgagcgagcgaacggccatgaagtacgtgctggtgaccggacgggtggtgagcggtgtcggcaagggagtgactgccagcagcatccgcgtcatgctcaaagcctgcggcctcctcgtcaccaccatcaagatcgatccatacctcaacaccgatgctggaaccatgtcgccgttcgagcacggtgaggttttcgttttggacgatggcggagaggtggacttggaccttggagactacgaacgttttctggacatcaaattgacccgctacaacattataaccaccgtaaagatcttccaggctgtcattaacaaggagaggagaggcgactacctaggaaataccgtccaggtagtgccacacatcacggatgagatacaggactggatccaacgcgtcgcggtggtcccag

SEQ ID NO: 67808 - protein, 132 aa, Zea mays
  misc_feature: Ceres CLONE 1542810
  misc_feature (1)..(132): Pfam Name: CTP_synth_N Pfam Description: CTP synthase N-terminus
  misc_feature: SWISSPROT Homolog: EC 6.3.4.2 CTP synthase
MKYVLVTGRVVSGVGKGVTASSIRVMLKACGLLVTTIKIDPYLNTDAGTMSPFEHGEVFVLDDGGEVDLDLGDYERFLDIKLTRYNIITTVKIFQAVINKERRGDYLGNTVQVVPHITDEIQDWIQRVAVVP

SEQ ID NO: 67809 - DNA, 615 bp, Zea mays
  misc_feature: Ceres CLONE 1542816
  misc_feature: Encodes the peptide sequence at SEQ ID NO. 67810
ggatcccccgggctgcaggaattcgtctcacccctagaaaaagattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaaggtagcaccttgcttggattcaagggaggccctgctgggatcatgaagtgcaaatatgtggaactcacttcagactttgtgtatccctacagaaaccagggcggattcaatatgatctgccgtggaag

SEQ ID NO: 67810 - protein, 165 aa, Zea mays
  misc_feature: Ceres CLONE 1542816
  misc_feature: SWISSPROT Homolog: EC 2.7.1.90 Diphosphate--fructose-6-phosphate 1-phosphotransferase
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPYRNQGGFNMICRG

SEQ ID NO: 67811 - DNA, 616 bp, Zea mays
  misc_feature: Ceres CLONE 1542817
  misc_feature: Encodes the peptide sequence at SEQ ID NO. 67812
  misc_feature (197)..(197): n is a, c, t, g, unknown, or other
  misc_feature (218)..(218): n is a, c, t, g, unknown, or other
tggagctcaccgcggtggcggccgctctagaactagtggatcccccgggctgcaggaattcgtctcacccctagaaaaagagtcgtcgtcttgtcgggtcttcaagccacaccaaaccacactgcgacacacagtaggcgaggcgaaggagaggcaaggcggcgcggcgggcaagatgtttgacgatcaagacctgngcttctttgccaatttcctgngcatcttcatctttgtcttggttattgcgtaccacttcgtgatgggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaagcgttttccagtactgcagttggtggttgtttctggtcctagtgtatgcatgccagaatcttatgataataatctttgtttttgtgccgaaaaaaaaaaaaaaaaccagacgctcgagggacccattcgccctatagggagccgt

SEQ ID NO: 67812 - protein, 64 aa, Zea mays
  misc_feature: Ceres CLONE 1542817
  misc_feature (8)..(8): Xaa is any aa, unknown, or other
  misc_feature (15)..(15): Xaa is any aa, unknown, or other
MFDDQDLXFFANFLXIFIFVLVIAYHFVMGRPEVRRKLMSSSAKILLSAGRNRAILLANASEIA

SEQ ID NO: 67813 - DNA, 673 bp, Zea mays
  misc_feature: Ceres CLONE 1542826
  misc_feature: SWISSPROT Homolog: EC 3.2.1.23 Beta-galactosidase
tggagctccccgcggtggcggccgctctagaactagtggatcccccgggctgcaggaattcgtctcacccctagaaaactagcttaagtgcattgtgttaaccttttcttttacttgctcgaattatacttttccgtgttgtagaatacctggaaatatccgtatgtgtggatacaccgggaaagaaattgggtgccgtttaattcatccaaaaaaaaaaaaaaaaacgagacgctcgaggtacccaattcgccctatagtgagtcgtattacgcgcgctcactgggcgtcgtttttacacgtcgtgactggggaaaacccctggcgttacccaacttaatcgccttgcagcacatccccctttcgcccagctggcgtaatagcgaagaagcccgcaccgatcgcccttccccacagttgcgcagcctgaatgggcgatggaaattgtaggcgttaatattttgttaaaattccgcgttaattttttgtaaaatcagctcatttttttaaaccaatagggcggaaatcggcaaaatccccttataaatcaaaaagaatagaccgaaaatagggtttgagtgtttgttcccagttttgaaacccgaattccccctttttaaaagaacgtggaactcccaccgtccaaaagggccaaaaaaccgttctattcggg

SEQ ID NO: 67814 - DNA, 641 bp, Zea mays
  misc_feature: Ceres CLONE 1542827
  misc_feature (184)..(184): n is a, c, t, g, unknown, or other
ggagctccccgcggtggcggccgctctagactagtggatcccccgggctgcaggaattcgtctcacccctagaaaatggcgggctggacgtgtggctgagccgcggggcgatgctgggcttcgtcggagcggtggccgtggagctgaccaccgggaaggcgtgcttcagaatgtgggattgacngcgccggtgccgacgctggcgctggcgctcaccggcgtggtcggcgtcctcacggccttcctcatcttccagtccgggacgcgggactgatgggtaatttgtcaaagctcccaaaaagacatgcataagtctgtcagagtcttgtgctgtgtatgtctatgctgttgtagttgcctttcccttccaggaagctgaggagtacccagtgcgaaaaagataattattattattatttaccaattgttgtttcagtaaaaaaaaaaaaaaaaacgaaacgctcgagggacccatttcgcccctatgggagtcgtataacccgccgctccctgggccgccgtttttacaaccgtccggaccggggaaaaccctgggcgttccccaactttattccgccttgaagcacatcccccctttttcccccggttgggggaaataaccaaaaaaagccccccccccg

SEQ ID NO: 67815 - DNA, 884 bp, Zea mays
  misc_feature: Ceres CLONE 1542828
  misc_feature (1)..(1): n is a, c, t, g, unknown, or other
  misc_feature (828)..(828): n is a, c, t, g, unknown, or other
nattaataaaatatatataaaaatcatcaattaaaattgggtgttttctccccactaaaaagctggaactccccgcggtggcggccgctctagaactagtggatcccccgggctgcaggaattcgtctcacccctagaaaaaaaatacattggctgcctcactcctgcttgctcctgcaactatagtgatcgtctatgctacatcatatttactcctgttgcttgaggccattccgcgaagccccaactcttacatgcatgcgcccggccgacaacgacgctgcctctcgtgagcttctgttcaagtgatgcatggtttcaggcatccatggatgctttatgtttatgaaatgcgtattaattaaattaaccgtgttaggggaaacgggcaaaaagggggtgtttgtttttatttacctttcttccgggggaccaaaaaaaagggggaaaaataatttttggaaaggttgcccacaaacaaaaaaaaaaaaaaaacgggggacccctttcgggggggcccccaaatttcccccctctttaagggggaagtccaaattaaccccccgcccttccccaggggcctgctctcttttttatacaccccctccttgaaactcgcgggaaaaaaaaccctcttggggatttatacaacccacaatattaacatacaccacctgtggaaaaaaacaacaccccccccttttttctcccagagatgtgtgcgggataaatataccacaaaaaaataggccctccccccccccacaatactgtcttctttcttccgccaaaaaattttgttctgcccccccctaaggtgatggcgtncccgagagcaaactctgtaatacgccgacttgaatattctctctcgtcaacaacac

SEQ ID NO: 67816 - DNA, 627 bp, Zea mays
  misc_feature: Ceres CLONE 1542840
aaagctggagctccccgcggtggcggccgctctagaactagtggatcccccgggctgcaggaattcgtctcacccctagaaaaaccttcatatatagagacaagagttctcgcttgtgagcataattgcatgatcgtgtggtgtatgtaacccgaaactgtttaccttttcgcaaaaacttcagtcttcaggcattgttccgattcagtgtcttcattcagtattccgattcagtgccctggtatcaatcttcagttatgagaaggtttattaaatctgcagttgttgttaacaaaaaaaaaaaaaacgagacgctcgaggtacccaaattccccctatagggagtcgaattaccgcgcgcttaattgcccccccctttacaacggggggggggggggaaacccctggcctttccccaactttaatccgctttggcacccaacccccccttttcgccagctggggggaaataacccaaaaaagcccccccccgaattccccctttccccaaaattttgcgccaaccccgaatatgggcaaaaggaaaaatttttaacccctttaaatatttttgttaaaaaaattccgccggtaaaaatttttgtggtaaaacccccccccattttg

SEQ ID NO: 67817 - DNA, 638 bp, Zea mays
  misc_feature: Ceres CLONE 1542857
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (296)..(296): n is a, c, t, g, unknown, or other
  misc_feature (327)..(327): n is a, c, t, g, unknown, or other
  misc_feature (335)..(335): n is a, c, t, g, unknown, or other
  misc_feature (398)..(398): n is a, c, t, g, unknown, or other
  misc_feature (400)..(400): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcaaaatggagctccccgcggtggcggccgctctataatagtggatcccccgggctgcaggaattcgtctcacccctagaaaaaaacaactcgcacgcagcagtacgacgtctctcctctgggtctggggccgagacaccgagcacgtactaccagcaagatggtggcgtctcccagattcagccccatcgagagtgctgnctcgaagggcggtcggagcaaaacgtggcgncgaactgnaacgcacgctgctcatctccaggagcgcggtccccctactaactcctccgtggctctcgaggncnggaagggtctccgggccccgctgctggttcctgttccgtggcgttgttttataataacctaacgcctcttttcccaaaaacccttggcctaaaaaaaccgggggggatcttccccggggggggggcccaggggggcccaaaacccaaaaagggtggccccccccctggtcccccacgtttttttcccgggggaaaatttcccccgcaaaaaagggggggggggtgccacccccccccc

SEQ ID NO: 67818 - DNA, 655 bp, Zea mays
  misc_feature: Ceres CLONE 1542863
  misc_feature: Encodes the peptide sequence at SEQ ID NO. 67819
  misc_feature (322)..(322): n is a, c, t, g, unknown, or other
  misc_feature (348)..(348): n is a, c, t, g, unknown, or other
  misc_feature (369)..(369): n is a, c, t, g, unknown, or other
  misc_feature (408)..(408): n is a, c, t, g, unknown, or other
aaagctggagctccccgcggtggcggccgctctagaactagtggatcccccgggctgcaggaattcgtctcacccctagaaaaaagccgagtggtcttccactcctcccagctgagctctccctctccacgcagctccctcgcggtgctccctccatagcgcctgagcgctctgtcctcggatcggagcttctctgcgtgtcgcagccaagcttccttccccatggcgcccggcgcccaagtccccagccgtgaccctgccgagctccgccccgactccacgtctcctggtcgggctctcgttctatgcctgatgccgctgntccctggtgctccctgctcggtcccntgccagcggctgactacagcntcagctcgcggcgtcccctctgcttagcaaggattgtcntgcctctgctccctggtttttccctacgcgcgactcgcttgtggtggccctggtcgcttggtccgggttccccttagttcacaattttgttctggcattggaagaaacccccgaaccctggttcccggttgcgatactcccctggcacgcgggagttgcccaagtcgggccacctacctcccatgggcggacctcctctaagtcccttgtttcccccgaaagggcttcccctgtttgttccgccggt

SEQ ID NO: 67819 - protein, 59 aa, Zea mays
  misc_feature: Ceres CLONE 1542863
  misc_feature (6)..(6): Xaa is any aa, unknown, or other
  misc_feature (15)..(15): Xaa is any aa, unknown, or other
  misc_feature (22)..(22): Xaa is any aa, unknown, or other
  misc_feature (35)..(35): Xaa is any aa, unknown, or other
MPDAAXPWCSLLGPXPAADYSXSSRRPLCLARIVXPLLPGFSLRATRLWWPWSLGPGSP

SEQ ID NO: 67820 - DNA, 645 bp, Zea mays
  misc_feature: Ceres CLONE 1542866
  misc_feature: Encodes the peptide sequence at SEQ ID NO. 67821
  misc_feature (570)..(570): n is a, c, t, g, unknown, or other
  misc_feature (572)..(572): n is a, c, t, g, unknown, or other
  misc_feature (601)..(601): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (645)..(645): n is a, c, t, g, unknown, or other
aaagctggagctccccgcggtggcggccgctctagaactagtggatcccccgggctgcaggaattcgtctcacccctagaaaaaccgccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggaacacgtgtcggcggcgcacgcggccggggcggggctcgtcgacggggccttcgtcggcgcccacgccggcgaagccaagaaagcacacgtcttcacttncngcacgctccaggactgcctggtcctgtgncctgtcnnngtcagctgtggtggatgacgcagccgaatggcgtn

SEQ ID NO: 67821 - protein, 78 aa, Zea mays
  misc_feature: Ceres CLONE 1542866
  misc_feature (60)..(60): Xaa is any aa, unknown, or other
  misc_feature (61)..(61): Xaa is any aa, unknown, or other
  misc_feature (70)..(70): Xaa is any aa, unknown, or other
  misc_feature (73)..(73): Xaa is any aa, unknown, or other
MTVTPRITVSDGRLTVRGRTVLTGVPEHVSAAHAAGAGLVDGAFVGAHAGEAKKAHVFTXXTLQDCLVLXPVXVSCGG

SEQ ID NO: 67822 - DNA, 718 bp, Zea mays
  misc_feature: Ceres CLONE 1542883
  misc_feature (1)..(1): n is a, c, t, g, unknown, or other
  misc_feature (14)..(14): n is a, c, t, g, unknown, or other
  misc_feature (17)..(17): n is a, c, t, g, unknown, or other
  misc_feature (21)..(21): n is a, c, t, g, unknown, or other
ncgccccccccccnctncttntatttattcccccacaccaccacacaaaaaaattaaaattggatctccccgcggtggcggccgctctatactagtggatcccccgggctgcaggaattcgtctcacccctagaaaaaaaagaatggcaccccttacaatctgaacaccatcacacctgttggtgtcaataagaactcaagaacagctgaagcagttgacagcagacatcttcataaagtgggttctggcaatctcaatgggcactcatttgatcgtgccggtgaaggagccatgggattttcaagaagtggaagcggtcataactgtggtcaccagttaatgtggaataattcaaataacttccacggtcatcccaattctcctgtgctgtggcaaaatcccggatcatttgtaaataatgtaccgtctcgccccccagcacaaatgcatggagttccaagagcaccatcacacatgattgagaatgttcttccaatgcatcatcatcatgtgggctctgcgccagcaatcaatccgtcactttgggacaggcggcatggctatgcaggggacttgacagaagcatcaaattttcatcctggcagtgttgggagcatgggattccctggtagccctccacttcttggtctgaagctaaataccatattttctcacactggtaggagccgcatggatccaactgtgatctcccctccc

SEQ ID NO: 67823 - DNA, 662 bp, Zea mays
  misc_feature: Ceres CLONE 1542886
  misc_feature: Encodes the peptide sequence at SEQ ID NO. 67824
aaagctggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcaatcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgccgccagcaggaggaccggcggcggcgtgtcctcccggtccggctcccggcggcccgtgcggctgccgaggatcagctgcagcgccaccgaggaggtcagcggcgccgtgtcgtccgtcaccgtggagaggatgctgacggtgacggcgtcggtggaggcgtcgccggccatcgggcagatgtacttccagcgcgccgtcgacgacgtcggcgacctattcggcaagacgctgctgctggagctcgtcagctccgagctcgacgcatagtcgggcgtgg

SEQ ID NO: 67824 - protein, 121 aa, Zea mays
  misc_feature: Ceres CLONE 1542886
  misc_feature: SWISSPROT Homolog: EC 1.13.11.12 Lipoxygenase
MMNLNLKQPLVLPAHHSNVVGSRLSSPSPSAAAASRRTGGGVSSRSGSRRPVRLPRISCSATEEVSGAVSSVTVERMLTVTASVEASPAIGQMYFQRAVDDVGDLFGKTLLLELVSSELDA

SEQ ID NO: 67825 - DNA, 567 bp, Zea mays
  misc_feature: Ceres CLONE 1542887
  misc_feature: Translation starting site: 435
  misc_feature (439)..(439): n is a, c, t, g, unknown, or other
  misc_feature (483)..(483): n is a, c, t, g, unknown, or other
  misc_feature (540)..(540): n is a, c, t, g, unknown, or other
  misc_feature (541)..(541): n is a, c, t, g, unknown, or other
aagctggagctccccgcggtggcggccgctctagaactagtggatcccccgggctgcaggaattcgtctcacccctagaaaaagcttaagggcgccgtcttcctctccctcgagctgcaggcacagctcggataccgctccgtcgacttcctgccctacggctcccacgtccgcaagacggcgggctacctcttcgccatccagcacggggccaaggtgatcttcgacgccgacgaccgcgccgaggtgcccgggaacgatctggggaagcatttcgacgtggatttgggatctggagtcaccaaccacccagtgctgctccagtacagccacgcggatcccaatcgcacagtggtgaacccctacgtgcacttcggccagcggtcggtctggccaagggggctgccgctcgataagggttggggaggtcgcccatgangtgttctacaccgagggtctcagtgggcggcattcattcagcangggctgtcggacgggttgcagatgtaaatgcggtgttctacttcactagaaaacacnnaactcggcgttcgatctgaagtttga

SEQ ID NO: 67826 - DNA, 558 bp, Zea mays
  misc_feature: Ceres CLONE 1542893
  misc_feature: Encodes the peptide sequence at SEQ ID NO. 67827
  misc_feature (25)..(25): n is a, c, t, g, unknown, or other
aaaactggagctctccgcgggtggngggggtctttcactcctgtatccccgggtgtggggttctcccctcccctcgaaaaatcggaatcaatcgtgtttctcgcctccacgccgagaccaatccagccaccgccaactctttgcctcgcctctccgattcgagggaacgatggagtgcgtcaccgatatgcccctcgcgacgctggacagccgaccgcgcaagcggcagcggctcgggtggggacgtcgttcccgccgagatgtatcagggtacgcggcccgcgcttggttgggacgtcggcccccccccgagaatgaatcagtttgcactttgtggacagaaattggtgatgccttccatgctccacggttgggccaaccttcaggtttgtgttcctccccaggccaaccaaaaaccaccccccggaggggttcccccccccctggaaaaaaaatgaaaaaaatggggccttttggttttttgccggggggggaaaaaaaatccccccccccccccccctcttaaaaaaaagagggggaaaaaaggggggggagggg

SEQ ID NO: 67827 - protein, 65 aa, Zea mays
  misc_feature: Ceres CLONE 1542893
MYQGTRPALGWDVGPPPRMNQFALCGQKLVMPSMLHGWANLQVCVPPQANQKPPPGGVPPPLEKK

SEQ ID NO: 67828 - DNA, 596 bp, Zea mays
  misc_feature: Ceres CLONE 1542937
  misc_feature: Encodes the peptide sequence at SEQ ID NO. 67829
aaagctggagctcaccgcggtggcggccgctctagaactagtggatcccccgggctgcaggaattcgtctcacccctagaaaaaccaatcgcatcgcagcagcacgagcagcacgccgtgccgctccaaccgtctcgcttccctgcttagcttcccgccgcgccatggcgtcgaccaaggcacccggccctggcgagaagcacactccatcgacgcgcagctccgtcagctggtccccagcaggtctccgaaagacgacagctcatcgagtacgatgcgctgctcgtcgaccgcttcctcaacatctcaggaacctcaccggcccagccttccgaatttggtccagaatgcttccagggttccgccgactttgagggcaaggaaaacccacaaaactgggcaagctccgggcaaaatccggggggtggcccccgcaaacccttcccctggggaagagtccttctggaaatggtcaacctcgccaacttgggcaggaagggggaaatcgcgcacccccccccacaaaagaaagctcaaaaaaagggggtctccccaaaaaaggctccccccccccccgaatcccaaattcagggaaa

SEQ ID NO: 67829 - protein, 42 aa, Zea mays
  misc_feature: Ceres CLONE 1542937
MVNLANLGRKGEIAHPPPQKKAQKKGVSPKKAPPPPESQIQG

SEQ ID NO: 67830 - DNA, 638 bp, Zea mays
  misc_feature: Ceres CLONE 1542938
  misc_feature: Encodes the peptide sequence at SEQ ID NO. 67831
  misc_feature (286)..(286): n is a, c, t, g, unknown, or other
  misc_feature (316)..(316): n is a, c, t, g, unknown, or other
  misc_feature (333)..(333): n is a, c, t, g, unknown, or other
  misc_feature (350)..(350): n is a, c, t, g, unknown, or other
  misc_feature (352)..(352): n is a, c, t, g, unknown, or other
  misc_feature (386)..(386): n is a, c, t, g, unknown, or other
  misc_feature (394)..(394): n is a, c, t, g, unknown, or other
  misc_feature (397)..(397): n is a, c, t, g, unknown, or other
  misc_feature (549)..(549): n is a, c, t, g, unknown, or other
  misc_feature (550)..(550): n is a, c, t, g, unknown, or other
aaagctggagctccccgcggtggcggccgctctagaactagtggatcccccgggctgcaggaattcgtctcacccctagaaaaaacagagccatcagagactgaccaaagccgagaccaaggatcctgtctcctgtgcactccggcggccggaccacggcgagtccgggacgtagaagtcgccccgcccctccggatcgtgttgctcgggaaattgcttccgagtagttcccgacgccgcgggcctctaagccgctgcctccgacagtctcgtgagtccttgactnctgagaatcgagggaacgcatttacggacngcagactggatctgaangagcgctgacgaattgnanggccgcgcaagcctggggatgggaaggctggtcntcccggcngcngtgggccttgtgggccttcccattgcggctttggtgaactccgtagtgccagagcctacatggatgaaaatctccataatttcacaagcaccagcatattgccctggaagattctggacatgggatcccatgatccccacccctccctgccnncaaaaatggcctctttctttccctgtgccccgaaatgtttcggtaaccaaaacatttgaaggtctttggcccaaaaaaactctcagaa

SEQ ID NO: 67831 - protein, 89 aa, Zea mays
  misc_feature: Ceres CLONE 1542938
  misc_feature (6)..(6): Xaa is any aa, unknown, or other
  misc_feature (60)..(60): Xaa is any aa, unknown, or other
MGRLVXPAAVGLVGLPIAALVNSVVPEPTWMKISIISQAPAYCPGRFWTWDPMIPTPPCXQKWPLSFPVPRNVSVTKTFEGLWPKKTLR

SEQ ID NO: 67832 - DNA, 608 bp, Zea mays
  misc_feature: Ceres CLONE 1542940
  misc_feature (11)..(11): n is a, c, t, g, unknown, or other
  misc_feature (24)..(24): n is a, c, t, g, unknown, or other
  misc_feature (28)..(28): n is a, c, t, g, unknown, or other
ctagaactaanggatcccccgggntggnggaattcgtctcacccctagaaaaaatcctcacactacaacgccgagcccacttgcgtctatctcgggctacagctacactcatcgccaccgaacatccggtggtgttcgcctcccgactctttttgtcctaaggcggtaaatatggaggcgtccaaggagtggccgtaaggccgatcgaactaggacaaagtgctggagaatgtggcgtcataccaccagcaacaacggaggcagaagctacgcaagagactcacctacacaggcgagatagctctcgttcactgtctggtcccgtggggatgaccccacctccgtgtccgtcgaggcacagaaggaggacttgcctcttgtgctccccttcacatatcatcagatctgaaggcaaaactgtgcgtttacggatactgactcaaatgatctttcttcagttctacatgtgacagacattggcatgaaaaataaaaacaagaatgcgatgtctgtcaaaggagctttcttcatatcaggcagctccatctcggtcgctgtgaccattcaaaggcataacccgccggaacttatgcacagaaataatcccg

SEQ ID NO: 67833 - DNA, 730 bp, Zea mays
  misc_feature: Ceres CLONE 1542947
  misc_feature: Encodes the peptide sequence at SEQ ID NO. 67834
  misc_feature (730)..(730): n is a, c, t, g, unknown, or other
tggagctccccgcggtggcggccgctctagaactagtggatcccccgggctgcaggaattcgtctcacccctagaaaaaatacctttctcggccttttggctaagatcaagtgtagtatctgttcttatcagtttaatatctgatatgtggaccatgtgttcacttcgatattaaatttattttttgtgggggagggctcactacagtagcttgctactggggtcctcacgtgtcgcttgggcgttgcactatagctcaagcctggcgcaccccaaagaaaataaaaaaaaaaaacgagacgctcgaggtacccaattcgccctatagtgagtcgtattacgcgcgctcactggccgtcgttttacaacgtcgtgactggggaaacccctggcgttacccaactttaatcgccttgcagcactatccccctttcccccgcttgtcttaataaccgaaaaagcccgcacccgattcccccttcccaacatttgccccaccctggaatgggaaattggaaatttgtaacccttaataattttggttaaattttccccgtaaatttttttggaaaaaccccctcctttttttaaaaccaaaaggcccaaaatccggcaaaaacccctttataaatcctaaaagaaaaaaaccccaaaaaaaggggtgagagtgtttttcccctttttggaaaaaaaaaaccccccctttttaaaaaaacggggaactcccccn

SEQ ID NO: 67834 - protein, 57 aa, Zea mays
  misc_feature: Ceres CLONE 1542947
GAPRGGGRSRTSGSPGLQEFVSPLEKIPFSAFWLRSSVVSVLISLISDMWTMCSLRY

SEQ ID NO: 67835 - DNA, 654 bp, Zea mays
  misc_feature: Ceres CLONE 1542950
  misc_feature: SWISSPROT Homolog: EC 3.2.1.23 Beta-galactosidase
ggagctccccgcggtggcggccgctctatgactagtggatcccccgggctgcaggaattcgtctcacccctagaaaaagcgaccccaggtcagtcgggactacccgctgagtttaagcatataaataagcggaggagaagaaacttacgagggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggaaggtgagagccccgtccgggccggaacctgtcgcaccacgaagcgccgtccacgagtcgggttggttgggaatgcagcccaaatcgggcgggtaaactccgtcccagggttaaaaaaaaaaaaaaaacgagacgctccgaggaccccattccccctatagtgagtcgtattacgcgcgctcactggccgtcgttttacaacgtcgtgactgggaaaaccctggcgttaccccactttatcgccctgcagcacatcccccttttcgcagctggggtaatagcgaaagaggccgcaccgatcgcccttccccacagttgcgcagcctgaatggcgaatggaaattgtaagcgtttatattttgtaaa

SEQ ID NO: 67836 - DNA, 908 bp, Zea mays
  misc_feature: Ceres CLONE 1542952
  misc_feature (1)..(1): n is a, c, t, g, unknown, or other
  misc_feature (20)..(20): n is a, c, t, g, unknown, or other
  misc_feature (22)..(22): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (45)..(45): n is a, c, t, g, unknown, or other
  misc_feature (46)..(46): n is a, c, t, g, unknown, or other
  misc_feature (908)..(908): n is a, c, t, g, unknown, or other
ntttttttttgggtggtggntncctcctctccnnnccctcccccnnctcactcccctccccgttgtggtcccccctctataactagtggatcccccgcgctgcaggaattcctctcacccctagaaaaaaccgtcattccactccatccgtgggcagcgctctgctctcctccactcacgaactcactcactcactccccttggccccatccatccgctagccactagctccagcagggtcgccgccgacactccacctaatgctctgctctcctccgctccacctcaaaaactcccctcgctcccccccaaaaaaaaaaaaaaaaacaagacccccgatgcaccccacttcccccctatcctgaaggcgtattccccgggtcctttgtggcccgcctgtgctacacgagttacatgatttttttatacccccccccccctttgtgggggggggggggcgcctttccccccccatattcccccctttctcccagacttagctttcacaaaccccacaaactcccccccccccgccttcccccccctcttttaccctctcccccactccccttgcacagcagtgcaattaagcccttacccccttccctttcccccccacctttcccttgaaacaacacaccctccagaaagtgactcccagaaatacaaccaaccctctccttctattttcttaatatcccccaccctccctctctcgttccattgggctgccacccacatttctcccgactaccgcctatccctctcaaccgtcttaaaagccaaatccaaagacgccacctgttgcccccaccacgacacaacgcacaagacctacactttgatataataacaattgatatatgcataatcaacctccttgcctgcgacccttccccagccaagcn

SEQ ID NO: 67837 - DNA, 640 bp, Zea mays
  misc_feature: Ceres CLONE 1542960
  misc_feature: Encodes the peptide sequence at SEQ ID NO. 67838
ttttaactagtggatcccccgggctgcatgtaattcgtctcacccctagaaaaaaaacatgttggaaagtactggaaagactgctacttgtctttatatttggtaattcagccgtagattgctatgctggttgggatttactcgtgaaccagagtttttctgtcttatatatcctgaattggttatcccaatggagatggattcttccttttttttgtccctggaatttatttctcgctcgcttcggtagaaaaagcaaataagcaagcaactatataaaggtattatattaattattaattaatttaaaattccggagaactgagaaagcccactcgttagtcgttactcccaacaccgggaatccatggagccggcctatgtcgtcaccctctccttcctcttcctcttcttgctccaccatctcctcggccgccaccgccgcatgaccaacggcaagaacaagagaacgcagctgccaccgagccctcccgccatcccggtcttgggtcacctccacctcttacggaagcctatccacgcggtgctcgcctcgcctcgcggagcgcttcggggcggtgttctttcttcgggctcggctcgcggcaagccgtggtggtggtgtcccgcggctttggcc

SEQ ID NO: 67838 - protein, 91 aa, Zea mays
  misc_feature: Ceres CLONE 1542960
  misc_feature: SWISSPROT Homolog: EC 1.14.13.89 Isoflavone 2'-hydroxylase
MEPAYVVTLSFLFLFLLHHLLGRHRRMTNGKNKRTQLPPSPPAIPVLGHLHLLRKPIHAVLASPRGALRGGVLSSGSARGKPWWWCPAALA

SEQ ID NO: 67839 - DNA, 672 bp, Zea mays
  misc_feature: Ceres CLONE 1542964
  misc_feature: Encodes the peptide sequence at SEQ ID NO. 67840
ggagctccccgcggtggcggccgctctatactagtggatcccccgggctgcaggaattcgtctcacccctagaaaaaatacctttctcggccttttggctaagatcaagtgtagtatctgttcttatcagtttaatatctgatatgtggaccatgtgttcactttgatattaaatttattttttgtgggggagggctcgctacagtggcttgctactggggccctcaagcgtcgctcggccgttgcactataggctgagcctggcgcgccccaaaaaaaagaggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagccccgcacgatcgcccttcccaacagttgcgcaacctgaatggcgaaatggaaattgtaagcgttaatatttttgttaaaattcgcgttaaaatttttgttaaatcagccccttttttttaaccaaaaggcccaaaccggcaaaatcccctataaatccaaagaaataaccgaaaaaagggttaaatgttgttccaatttggaaaaaaaa

SEQ ID NO: 67840 - protein, 54 aa, Zea mays
  misc_feature: Ceres CLONE 1542964
SSPRWRPLYTSGSPGLQEFVSPLEKIPFSAFWLRSSVVSVLISLISDMWTMCSL

SEQ ID NO: 67841 - DNA, 681 bp, Zea mays
  misc_feature: Ceres CLONE 1542965
  misc_feature: SWISSPROT Homolog: EC 1.4.1.2 Glutamate dehydrogenase
  misc_feature (681)..(681): n is a, c, t, g, unknown, or other
tcatcgcggtgggcggcgctctagaactagtggtccccccgggctgcgggaatttcgtttcacccttagaaaattctcgaaaccttagtccctggttcctttctcggccgccgccaatcctttcccgggctccgcacccgttaattgaaaaaaaaaaatgggccggcaagggcaatggcccggctatcggcttcaatctcggcccaacgtactcttgcgtcggcgtgtggcaccccaaccgcttcaagatctttgccaacaaccagggtaaccgcaccacgccctcgtacgtcgccttcaccgactccaagcgcctcatcgaagatgcggccaaaaaccaggtcgccatgaaccccatcaacaccgtctttgatgccaagcgtctcatcggcaggaggtccactgatgcgtctgtccaaagtgatatcaagttgtggcccttcaaggtcatttctgggcctggtgagaagccaatgattgttgtccagcacaagggtgaggagaagcagtttgcagctgaggagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggcccttatgtgctcn

SEQ ID NO: 67842 - DNA, 695 bp, Zea mays
  misc_feature: Ceres CLONE 1542967
  misc_feature: Encodes the peptide sequence at SEQ ID NO. 67843
  misc_feature (695)..(695): n is a, c, t, g, unknown, or other
tccccgcggtggcggccgctctagactagtggatcccccgggctgcaggaattcgtctcacccctagaaaaactgtacaaggaggagctggagaagatgaaggagatggcgccggacaacttccggctggacttcgcggtgagccgggagcagacgaacgcggccggggagaagatgtacatccagacgcgcatggcggagtacaaggaggagctgtgggagctgctcaagaaggacaacacctacgtctacatgtgcgggctcaagggcatggagaagggcatcgacgacatcatgctcgacctcgcagccaaggacgggatcaactggttggactacaagaagcagctcatgaagagcgagcaatggagcggcgaagtctactgatgatgatccttccttgcattgttcagctcaagccatctggtggtgatgagtttgccttgcattggacctagtattggcgagaatcatccaatcgtttggcccgtcgtctttctatcgatggacctaccttattattggatgaaagacctttttaaccctttcctttccaaaaaaaaaaaaaaaaacaaaaccccccgagggaccccaatttcccccccaagggggagcccaatttaccccccggccccccgggcccgccctttttaacaaccccctggctcggggaaaaaccccgtgcgctatccccn

SEQ ID NO: 67843 - protein, 96 aa, Zea mays
  misc_feature: Ceres CLONE 1542967
  misc_feature: SWISSPROT Homolog: EC 1.18.1.2 Ferredoxin--NADP(+) reductase
MKEMAPDNFRLDFAVSREQTNAAGEKMYIQTRMAEYKEELWELLKKDNTYVYMCGLKGMEKGIDDIMLDLAAKDGINWLDYKKQLMKSEQWSGEVY

SEQ ID NO: 67844 - DNA, 652 bp, Zea mays
  misc_feature: Ceres CLONE 1542972
  misc_feature: Encodes the peptide sequence at SEQ ID NO. 67845
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (509)..(509): n is a, c, t, g, unknown, or other
  misc_feature (571)..(571): n is a, c, t, g, unknown, or other
ccccgcggtggcggccgctctataactagtggatcccccgggctgcaggaattcgtctcacccctagaaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcatacctttttttaaaannnnnccatncactaaaaaaattaataaatatataataatacctgcccctccaattttcccagttagggaanatatttttataacccgacaggctcggaggaaccccatctctccccaatagggaattcaaataccccccgcgcgccctgggg

SEQ ID NO: 67845 - protein, 65 aa, Zea mays; identical to SEQ ID NO: 66489
  misc_feature: Ceres CLONE 1542972

SEQ ID NO: 67846 - DNA, 775 bp, Zea mays
  misc_feature: Ceres CLONE 1542973
  misc_feature: Encodes the peptide sequence at SEQ ID NO. 67847
  misc_feature (38)..(38): n is a, c, t, g, unknown, or other
atacgcgtggttcccctacacgggctcccccccgcccnccgctccccaaccctaaaactagactccccgcggtggcggccgctctatactagtggatcccccgggctgcaggagttcgtctcacccctagaaaaagtcatcgtcagaatttcctcttttttttccttccccaacttctccctgcatcggccgatgctgcggcgactgaccacagctttcgaccctctccagtggagggaacggggttagcgagcggcctccgctgccactgcaacggcgtgggagggccatggcggcccccgcgctcgccttccccatgttgctggctgcctcactgatctccgtcgccgctcctgcgctggctcgaagcccatcttgccctgatggtctggcaagccggccctgttcagaacagatgcttcatgtacatatccgcctccctttcttgggatagacccaacacccctctggcatacctacagcgggcatcctcgctgcaatatcatcaattccacgagctaaacttcccagaagtctctcgtgtggatcttcacccccagggatgcattggtttggagcggccttactcgatggcattggccacagataaccgggttgggaaaacggtatttaccccttcccccctgttttgcgcaatgaggacccgtcctttcctttgggtggggtcttttgcccttgccccaccgggccgttggaatcccgcccttgttaaaacaaacgcccttctcatccacccacgttatttgttgttctc

SEQ ID NO: 67847 - protein, 54 aa, Zea mays
  misc_feature: Ceres CLONE 1542973
MAAPALAFPMLLAASLISVAAPALARSPSCPDGLASRPCSEQMLHVHIRLPFLG

SEQ ID NO: 67848 - DNA, 698 bp, Zea mays
  misc_feature: Ceres CLONE 1542985
ccgctctataactagtggatcccccgggctgcaggaattcgtctcacccctagaaaaaaggatcagccgagccgagttccatttccgccaccgtcccttccccctctgcccctcgttcctcgtcttctctatttgcttggctttgcttgcttttggttcaacttccacaccattcattcatttcttggatttctttggtggcgtccgcaagtcaagtcccttcccccttccgcccctcgtcaaagcaagcaagcaaaagtggtgcggtgccatcagagtaagcaagctccccattttccctattcctatactactactagtagctgcagcagcatccaccggatggccatgtccagcgacaccgccgccacgacggggacatgcaccaagcccaaccccaaccaccgccttcccactctcaatagccctgattgaatcatgggcttccgcccccaacaaccgcctcttcttccgctaccgggcgtcctcgcggcccaattgccaaaccggcccgaaaaccgctgccaaggccccccggccctcacctttttccgggacccgtgcggttcctccaaccttacttccaaattcgcaattcccaattccaaagctcgttggcttggggccttccttcaaaaacaaaaatcccttgccgccccaaccgagggggtggggttgcttactctccccccaaaggc

SEQ ID NO: 67849 - DNA, 659 bp, Zea mays
  misc_feature: Ceres CLONE 1542986
  misc_feature: Translation starting site: 99
  misc_feature: SWISSPROT Homolog: EC 3.2.1.23 Beta-galactosidase
  misc_feature: SWISSPROT Homolog: EC 2.7.7.9 UTP--glucose-1-phosphate uridylyltransferase
ggagctccccgcggtggcggccgctctataactagtggatcccccgggctgcaggaattcgtctcacccctagaaaaatccgaaagcatttgccaaggatgttttcattaatcaagaacatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgaagagcacgtatggtgtctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgg

SEQ ID NO: 67850 - DNA, 829 bp, Zea mays
  misc_feature: Ceres CLONE 1542987
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ccccccccggnnttntgtactccaataagagagggnnnnnnttttttnnnaaaaaataaaactcaacgcggtggcggccgctctatactagtggatcccccgggctgcaggaattcgtctcacccctagaaaaatacgaaagcatttgccaaggatggtttcattgatcatgaacatcgccaagcctggagtgaagttggagattccagatggacacggacttgagaagaaggatgtcaatggccctgaggatctttaaggaagggttggaatcaccattatttcccaaggacatgtcacgggaactgccaagcctagacactcctactgagctctatatgttgaaagtttagtgtgcattgcgattccgctgtgtttgttcacggaagaccagttagagaaaaatgtgtaatctttttttgtctggcttttgtgcgggggagggggggcgcgccttggacgtattattggtgactgcaaccgacatctccgtaaagagtcccgccctcggggcccagtaatgggaagaaagtaagaagaagaacgctacgtaggggatccccaagttggggcattaatggggagggtccgtgattaattgggggcggtttcacgtgggcaacttaaactttagccacccgaacgaggactggggtaatatcccataattcgcattgcgccaacggcaaaacgaattaccttgcagattctatgaggcccgtcctcggaaagtgcgggacgagaggttctggagagaaaacgccacctttgagtttgagccgcccgctggtactgatgtgttttatggggagtcaccgtgaaaggcgta

SEQ ID NO: 67851 - DNA, 686 bp, Zea mays
  misc_feature: Ceres CLONE 1542989
  misc_feature: Encodes the peptide sequence at SEQ ID NO. 67852
agtggatcccccgggctgcaggaattcgtctcacccctagaaaaaccgccgtcaccgccggcgtgtactgcgccggccggtacgtcaccgacatcggggtgcgcaaggacgtggtgaaggtggaggcggaggacctcgcggcgcacctcggctgctgccgccgccgtgccgaggagcaggaggaggcagcggcgctcaacaacaagaaggagcagccggccaaggccaagcagagcttgcttccgctgaagcggacacgggaggtttgcgtctgatttttggtgtgcacacatgcgatgcgaataggtttcgttactagtcactggctggctgcctagaatttaataaggcgacgtatagatagacattggacgcgtctccccctcggtacaagtaagtggggtgcttttggcctaaaagaagcccaagggtaaattggttcacttccgatcctttggttttttccttttccccacggagaaatccgaggttggtgggttggttccttggaactcccttccctctggaaaaactaacctcccagagttccagtaaaaaaaaaataaaaaaccgcaaccgcctccggggtccccaatttcgccctatagggggggcggtattgccccccgccccccggccgcccctttacaacccggccgcgactggggaaaaccccggcccttacc

SEQ ID NO: 67852 - protein, 90 aa, Zea mays
  misc_feature: Ceres CLONE 1542989
WIPRAAGIRLTPRKTAVTAGVYCAGRYVTDIGVRKDVVKVEAEDLAAHLGCCRRRAEEQEEAAALNNKKEQPAKAKQSLLPLKRTREVCV

SEQ ID NO: 67853 - DNA, 829 bp, Zea mays
  misc_feature: Ceres CLONE 1542990
  misc_feature: Encodes the peptide sequence at SEQ ID NO. 67854
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (829)..(829): n is a, c, t, g, unknown, or other
tttttttttttnnnccntnntnaaatctnccnnnnnnnnaccttnnnnnnnnaccgctggagctccaccccggtggcggccgctctagactagtggatcccccgggctgcaggaattcgtctcacccctagaaaaacgagggcgatgccgaccttccacttcgtcaagaacggcaagacggtcgcgaccatcgtgggtgccaggaaggacgagctcctggccctgatcgagaagcatgccgcgcctgcgcctgcgactgcgtctgcctaaatgagatcagatcagtcgtcgccgtcaataagggccagcacgtatggctgtaaatgttgccgttatcagttccgcctttgccgtttgtgggcgatttgggaacctaataatatggtttgtttcaatccgagcccggaggccattcctttacccttggcaccccggggggggggggggtccggttccccgggttgacttctgaaccccccccccacccagcctcccccccgggcaccagggcccgtgtgtgcatgggcggcccagtagatttccccggcttcccaaaccctctcccccgtcggccccttgattcccgagtagtccccgcacccgcctgctccacttcttcccgcgtccccctcccagtgtgtctcacatccttcccccccaaaagggggaggccccaaattaccgcccgccctccactgggccctgccctttttttccaccctcccccggtctccggcaataaccccctgggcctccgccccccccccctattcttcccccgttttcgtccattaaccgccctttttttgccccgccgcgccccttgatn

SEQ ID NO: 67854 - protein, 41 aa, Zea mays
  misc_feature: Ceres CLONE 1542990
MPTFHFVKNGKTVATIVGARKDELLALIEKHAAPAPATASA

SEQ ID NO: 67855 - DNA, 722 bp, Zea mays
  misc_feature: Ceres CLONE 1543001
  misc_feature: Encodes the peptide sequence at SEQ ID NO. 67856
  misc_feature (722)..(722): n is a, c, t, g, unknown, or other
tccccgcggtggcggccgctctagaactagtggatcccccgggctgcaggaattcgtctcacccctagaaaaactcgccaatcggcacgaccatggctgccatccacctgcgcccgctccgctccgtcgccgtctcctccgcgaggtaccgctcgcttctcgcaccttctcgcccgccccctctcctcttcccaatcgtcccacgcctaccaccctttccccaccccggccgccgccgcccccaaccatgttcaccaccaccaccctacccaccacagccagcagcagtcggcgccgccgaggaacccgcctccccttggcccctctccgcagtggtccccgcagcctccgccgccccgcggctatgggcctccaccgccgcagcacccgcatgtgccgccgccgcgccccgcgggtacggacctctatcaccgggacagcactttgccgccttccccacaagggaagggcccttcaatgcgggcggcgcaaaaaaaaaagggaccgggacctccccccccaaaaaaaaaattttggggccccccgtgcgtcctattaaagggacaaaaaccccacacctttaggccacctttggcccaccgcgcccccccacttgggggtgcacggaaaaccccccccctggggccaaaaagggtgtatatgtgtggggcacccacaaaaaaggaggtcctcctccccgcacaagagaagaacaccccccn

SEQ ID NO: 67856 - protein, 103 aa, Zea mays
  misc_feature: Ceres CLONE 1543001
MFTTTTLPTTASSSRRRRGTRLPLAPLRSGPRSLRRPAAMGLHRRSTRMCRRRAPRVRTSITGTALCRLPHKGRALQCGRRKKKRDRDLPPQKKNFGAPRASY

SEQ ID NO: 67857 - DNA, 630 bp, Zea mays
  misc_feature: Ceres CLONE 1543004
  misc_feature: Encodes the peptide sequence at SEQ ID NO. 67858
tcccccgggctgcaggaattcgtctcacccctagaaaaaattcttcgtggcggcttaattactgcgtaggaggagaggttacaaccttatttcacttggatcggccaatgtatttactaggatatcttgcaaaccaaagccgtgtctatcttattgataagcaatttaatgttgtggggtatactttactccttagtttgatcgagtataaaacacttgtaatgcgtggggattttgatcgtgcaaatgatgttttatcatctataccaaaggaacaatatgacagtgtggcacgtttcttggaatcacgtggaatgttggaggaagccctcgagatagcaactgacactaattacagatttgacccccccctgtgcagcttggtcgacttgaaatagcgaaggtgattgctattgaggtgcaaagtgaatccaagtggaagcaattaggggagttagctatgtcaaatggaaagcttgaaatggcagaggagtgtcttctacatgcaatggacctcagtgggtttgttgcttttggcattcttcccttggggatgccgaagggattaacaaaattggcatctggaagcccaaagaacagggaaaagaaccatgtttccttttccgttgg

SEQ ID NO: 67858 - protein, 131 aa, Zea mays
  misc_feature: Ceres CLONE 1543004
PRAAGIRLTPRKNSSWRLNYCVGGEVTTLFHLDRPMYLLGYLANQSRVYLIDKQFNVVGYTLLLSLIEYKTLVMRGDFDRANDVLSSIPKEQYDSVARFLESRGMLEEALEIATDTNYRFDPPLCSLVDLK

SEQ ID NO: 67859 - DNA, 647 bp, Zea mays
  misc_feature: Ceres CLONE 1543019
  misc_feature: Encodes the peptide sequence at SEQ ID NO. 67860
  misc_feature (647)..(647): n is a, c, t, g, unknown, or other
ggcggccgctctagaatagtggatcccccgggctgcaggaattcgtctcacccctagaaaaaatcttattccgcatcgcggatcgcatctactgtcgagctttctttctgtcgttgtttcgtttttctgggagaagatgaagaagaggggaggcgcgacaaaaagggcgctgcgccactagtcgcctccgacgccggagtctctacctcgttctccttctctcgatatgattcgaaaggcggcgtcaacgaggacaacgtacgggcacgatgcattggagctacctgatgctggaggagctcatcgggatggcctcgatgatggagtcgtctaagaccatgttcttcctggcgatgaccaagatcgtcgggacgctcgggcccaaacccccctccgtcgaggctatctcctcctgtctcaaggccggcatgtctgtcgcgcagttcgatttctattggggagacaccgtgtacctccagtagacgctcgaggacctgggggtcaccatcaatgctcctagaagctgtgcgctgttatggttgatactgatgaatcggagctgaaggtggtcaaccagagtgaaacccccatctccctcgaggaaaacgggactgttgtgctcaccctgtattatggcccagaaagcn

SEQ ID NO: 67860 - protein, 70 aa, Zea mays
  misc_feature: Ceres CLONE 1543019
  misc_feature: SWISSPROT Homolog: EC 2.7.1.40 Pyruvate kinase
MHWSYLMLEELIGMASMMESSKTMFFLAMTKIVGTLGPKPPSVEAISSCLKAGMSVAQFDFYWGDTVYLQ

SEQ ID NO: 67861 - DNA, 648 bp, Zea mays
  misc_feature: Ceres CLONE 1543023
  misc_feature: Encodes the peptide sequence at SEQ ID NO. 67862
ggagctccccgcggtggcggccgctctagaactagtggatcccccgggctgcaggaattcgtctcacccctagaaaaatcacacagagaggctccataattaattattgccctttcagttcggcatcggcagccgagcaccatgagctccacaggcggcgacgatggcgccaagaagtcttggccggaagtggtcgggctcagcctgaaagaagccaagatggtgatcctgtgcgacaagcccgactccgacatcgtcgtgctgcccgtcggcacgccggtgaccatggatttccgccccaaccgcgttcgcatcttcgtcgacaccgtcgcggatgcaccccacatcggctgacaatcaaatctataaaatgaataactcggacatgtcatgcgtgcatgtccgtcgccgaataatggatgtgtgtgcttcgttccaataaattgctagtacaaataatgtcatcgtcggtatgcatgaataaaatgtatcacaatgttcatcctttcacgattgtatatatgataatgtgctcaggtgtttggtttacgaaaatataatgataacgagacgctcgaggtacccaattcgccctatagtgagtcgtattacgcgcgctcactggccgtcgtcttacaacgtcgtgaa

SEQ ID NO: 67862 - protein, 70 aa, Zea mays
  misc_feature: Ceres CLONE 1543023
  misc_feature (11)..(70): Pfam Name: potato_inhibit Pfam Description: Potato inhibitor I family
MSSTGGDDGAKKSWPEVVGLSLKEAKMVILCDKPDSDIVVLPVGTPVTMDFRPNRVRIFVDTVADAPHIG

SEQ ID NO: 67863 - DNA, 662 bp, Zea mays
  misc_feature: Ceres CLONE 1543024
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaactagaaaaaaccgcgtcccccacctctctcactgcacatcgcagagaccttagtgctctttaatctactattaccaggcatggtggttgtaataataaagtagcgctgtgctactcgtaggacatgaagaactatttgttattcaacccttcatatgtacttaatatcttgtctatttcagttcagtagtcggtacttatttccatccattgtaatgcaccatataatgttgtgtaatatatgtccactgtgctgcaaaaaaaaaaaaaaaaacgagacgctcgaggtacccaattcgccgtatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccataggccgaaatcggcaaaatcccttata

SEQ ID NO: 67864 - DNA, 610 bp, Zea mays
  misc_feature: Ceres CLONE 1543026
  misc_feature: Encodes the peptide sequence at SEQ ID NO. 67865
  misc_feature (610)..(610): n is a, c, t, g, unknown, or other
tgtggatcccccgggctgcaggaattcgtctcacccctagaaaaagtaggacctgtgcttgttggtttgttgctggcaatgtaaatataagtgttaggtaatgcaaatattagcatgacagtgcatattcttgtaaatgggaatttaccatgttattggaaatccaaagttcaaactatctcaagcttgttggttgctgtgctgaaataaaaagatgttccttttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccccctcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagn

SEQ ID NO: 67865 - protein, 82 aa, Zea mays
  misc_feature: Ceres CLONE 1543026
  misc_feature: SWISSPROT Homolog: EC 3.2.1.23 Beta-galactosidase
MFLFKKKKKNETLEVPNSPYSESYYARSLAVVLQRRDWENPGVTQLNRLAAHPPLASWRNSEEARTDRPSQQLRSLNGEWKL

SEQ ID NO: 67866 - DNA, 667 bp, Zea mays
  misc_feature: Ceres CLONE 1543027
ggagctccccgcggtggcggccgctctagaactagtggatcccccgggctgcaggaattcgtctcacccctaggatttattccagacctatcttaacaagttttgatataaatatatttcttcgcccgattctctgttatgacaggattctgacgaactcctcttcgactggcttttctaggagggacgcattgttttcttcagatggagcaccttgtgatgccttggctctgccatgctactggggaggatctgctatcagtgctagctgtatggatatgtgagtgcagcatctccgatactgatcagcacattcctttagactatcctgttgcaccgcgtcatatagccccgacaagaactagagctgcatcgcttcgctgccaggtgggtgggtcagcagagacgggggcactgtctgcgggatccccgtgctggacaacgcatactatccgctcgcatctcaattcgttcaaatcatcactagagcgcacgatgccaggcgctcctaatagactgcccatcgatgtctccagagactacttcgttccttacacatctgggttgcgctcgtgccgccacttgagatcttgtcgcacaacctcttgcctacaactgtgtataccgtggcgcctggggaactgcttaggctcctgccaatccgact

SEQ ID NO: 67867 - DNA, 858 bp, Zea mays
  misc_feature: Ceres CLONE 1543028-R2
cgaattgggtacctcgagcgtctcgtttttttttttttttttgaaaagctgagcgtttggcggtccccagcaccttttgatggccaaaaggcgaaacaaagagacacatatgtacaccgacagttatttgatacatctgtcagccgtcgtgcaactcccaggctgccagcatgatggatcgtcgtcgtgcgccatgcactctcgatcactatacttccagttgcagcctaccagtacttggtgcgtagcgccgtagcatcgtcaatcaaagcccatacccagtgctaaagtagctccgggtgacgttccggctcattatctgcagcaccttgctgttggactggctcacaaaccgcggcgtcttgaactggctgacggcgcccccaaggctcaggtagtggttcatgacctgcgcaaaggctcccttccggaggacccggagctcgagggccccaatggtctgggtcttcctcgacccgacttaccccgcgtccgcaaaggccaggtccatgcagctcgcgcagccgctcaggacgtcttcgctggcgccgtcttcggagctcagctcccagaagacgacgtagtgccctggctcgctcgacctgtccacgaggctcgtgaagtccaccacctccagcttctccgcggcaaaaagcttctccgcggctttcaacggccagctgaagatctttccctgtgtccttgccaatgttgaccctaaggactaggcctctccgggaaatgaacgggacctcctgtggttgctttgtgaaaacctgctttcttcaaaatatctcccattctgtatcggtataaaccgtgcaaaatttgttattacaactttcgtaagattttgcc

SEQ ID NO: 67868 - DNA, 1034 bp, Zea mays
  misc_feature: Ceres CLONE 1543028-R
aagtttggcggtccgagcagcttttgatggcagaaggcgaaaaaagagacacatatgtacaccgacagttatatgatacatctgtcagccgtcgtgcaactcccaggctgccagcatgatggatcgtcgtcgtgcgccatgcactctcgatcactatacttccagttgcagcctaccagtacttggtgcgtagcgccgtagcatcgtcgatcagagcccatacgcagtgctgaagtagctccgggtgacgttccggctcagtatctgcagcaccttgctgttggactggctcacgaaccgcggcgtcttgaactggctgacggcgtcgccgaagctcatgttatgggttttgacctgctcaaaaggctcccctcttgaggaaccggagctccgagggctcccatggaccgggggtcttccctcgaccccgaactatcccatgggacctgcgaagggccaattttcctttcaaaactatgcgacaaaccgctacagggacggtttttcactggggattccgatctttggcaaacataaacctccccccgaaaaaaccgcaacgaggggtgtcccttggggaattcgacaattaacgccgggtgcccacccaaaggtccctccttgtaaagattcccactcaacgcctcgccaaggttgtctcttccaccgtacagagaccaaaagaaatacttttcctcccgagtgggggcacattcctaaagtggggcaccatcccgaaccgagatactatgcctgtctaatgggaaaccgcccccgcgcgcgaagtttcttaaacaccttaacatgaaataaatgcaccttttcactccccgccgcgagaatacatatacgcgagaccattcgggggtgttacagacgtggtacgcggcaaaaaacccacggataattaccatcccagataatattttccaccgatttataattctacaccgtactaggagcccctattggcaaacatttgagagtatgcccgccacatctcgtttatgctatatcctacctagctctttttc

SEQ ID NO: 67869 - DNA, 653 bp, Zea mays
  misc_feature: Ceres CLONE 1543030
  misc_feature: Encodes the peptide sequence at SEQ ID NO. 67870
tgtggatcccccgggctgcaggaattcgtctcaccccagaaaaattacacctgtgaagaaggagatgtcggatggtcagccatggcttgggctgggacctcagatcgccaatcctgatctgagcttgtccaaggaggcgagccagtgatcgatgatccagcatcaccatcttcaaaactgcgatactcaacagccatgtgtggaagtgttctgttttgggcccctatcattccgggttttttttcgcatggataaataggttgtacgaaagtaaagaacacagctaatgacggacttcagtaaggattaccggcgctggggcaggtttggctgatcagcctttgctggcctgaccccagtggcctttttaaaaccacgaaaatgtaatgtaataattgctaaaacaagttggcatcttgggatggtcctgtgttgtttgggtttggaactgggtgcgtggcagtgtcccaaagctttttattttccacaaaacccggcaaaagaattggtttttttttaaaaaaaaaaaaaaaaacggagcccctcaaggacccccatttccccccatatggaacccgaaattccccccctttcactggccctccgttttaaccaacctcctgaacgggggaaaaccccggggcgtttcccca

SEQ ID NO: 67870 - protein, 48 aa, Zea mays
  misc_feature: Ceres CLONE 1543030
VDPPGCRNSSHPRKITPVKKEMSDGQPWLGLGPQIANPDLSLSKEASQ

SEQ ID NO: 67871 - DNA, 649 bp, Zea mays
  misc_feature: Ceres CLONE 1543032
gctcttaactagtggatcccccgggctgcaggtatttcgtctcacccctagaaaaaaagtttgccaaaccatttgttcattggaaccgcctgcattgcatacaagctgccttccttgtctaaccagctcttagacaacaagattctgcttccagaccaggatactacgcccgtttctgtctgtgtgcctccgttcaatgcacacgcttcatttggtttctgtcacttgttcatcacgctctaccgtctctagcgccatctccgtactagttttgatgactggacttatttgatgctcttgccgttctcgacttggggcgcgagccgatggatctcctccggatgaaacttctcctgccctccttcatcagttgccttccccccatgcaagcagcactatgtgatggcgccgccgccaccaccaccaccaccggcgaaaacggaacggcaaactggacatgtgtgtgcgcagttcatcctctcggtgaaccagactccaacagcagcttggtgtccaattgctccttcttcctgccattggcaaccgagatgagaacggctgcgtgctgcggccggcggctacaggctcgtggaactgcacgtggtgcctctggttgatgaggggccttccgaaaggaatatcctgcctg

SEQ ID NO: 67872 - DNA, 661 bp, Zea mays
  misc_feature: Ceres CLONE 1543036
  misc_feature: Encodes the peptide sequence at SEQ ID NO. 67873
tgtggatcccccgggctgcaggaattcgtctcacccctagaaaaacgggcccgcagttgaaaccgccagccgttccttcccacgctcctccccgcccccggtccgccccccacctcaattccacaccccgcggcgaggccgcggggcgcccgcgcccaaacgccaaaaccctagctccccacccacccaccccaagcaccgcggggccgccgcgcgctcgcccacggtcgacacggatgcgcgcggcccgctcgcggacctcgacgacaccccgatcgctagccgcggctgttccgccatggacgagcccgagaaagtgagggggcagggaggatgcggcgtctggccgcgaggctggcggcgccgaccaccccccgggatgggttccagctcgggatccatggtcagaaaaagaacagggcggccagcggccagaactgcggggactgctggctctggctcttggcgctggcgccgggccagtgccggcgttgaccaacgagaaggagccgcgccggctccgggggccaaggggaaggggctttccacgatcccagcattccccggcccccggagtttaccaaaatcagaggggataactacaagccattcgagccatgtctggctggagcgcacccaaaacggtacccgaacgtgttcc

SEQ ID NO: 67873 - protein, 121 aa, Zea mays
  misc_feature: Ceres CLONE 1543036
MDEPEKVRGQGGCGVWPRGWRRRPPPGMGSSSGSMVRKRTGRPAARTAGTAGSGSWRWRRASAGVDQREGAAPAPGAKGKGLSTIPAFPGPRSLPKSEGITTSHSSHVWLERTQNGTRTCS

SEQ ID NO: 67874 - DNA, 673 bp, Zea mays
  misc_feature: Ceres CLONE 1543037
  misc_feature: Encodes the peptide sequence at SEQ ID NO. 67875
tccccgcggtggcggccgctctataatagtggatcccccgggctgcaggtaattcgtctcaccctagaaaaaaaccggcaacaccgtcctcccctccccctcctcctcccgcgtgctctcctctcctatcctctctgcccccggtaactacaactgttggagtaggcccgggttggccacggccgccacactgctccgctctgctctctgaaggcattgcctgcgcggcttcttcctccgccggcgtcggtccgcgagttgttggcatggccgccgcagggacgcagctaggccggcttctgggcggcctatggttcctggccgcgttgctaggacgaccggggaggacttcgtgtgcgcgacgttggactggtggccgccggacaagtgcgactaccgcacctgcgcctggggccgcgccggcctgctcaacctggatctcttcaacaaggtcctgctcaatgccgtcagagccttctcgccgccgctgctgctccgcttggaagggccgctgcaggacaaggtgatgtaccggtaccgggcccgggcggccgttgcgccccctttcttcaggaacgccgttcggaaaatccacgggtttctcccagggttgccctgcccccttgccacgggggaaagaacccttaagcccttttttccggaaaaacccggg

SEQ ID NO: 67875 - protein, 121 aa, Zea mays
  misc_feature: Ceres CLONE 1543037
MVPGRVARTTGEDFVCATLDWWPPDKCDYRTCAWGRAGLLNLDLFNKVLLNAVRAFSPPLLLRLEGPLQDKVMYRYRARAAVAPPFFRNAVRKIHGFLPGLPCPLATGERTLKPFFPEKPG

SEQ ID NO: 67876 - DNA, 646 bp, Zea mays
  misc_feature: Ceres CLONE 1543041
  misc_feature: Encodes the peptide sequence at SEQ ID NO. 67877
ccgcggtggcggccgctctttactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcccgcgcggcgcgatccggtgtccaccgctgccccgccggaggaggaggaggaaggggggcggggggtggagcacagggggatgctagaggcgaagccgccgtcgccgggctcctccggcgcggccggggcggcggcacacatccacgctcacagggggtgggcggtgccgctgctggactcagtccacccctcgcttatcctcatctcctcgtaactcttcttcttttcctcccgcacgctggtcttgtacatctcgtcgcagacctccgcagcctccgccgagtccctctttgcccaggccaagctccggagaagcatgcatgccaaggagatatcgcttgttctctctgtggaacttatgaatttatacaacaacagtttgcctacgagattgatcagctaatgacaggaacaattgggcgaactactaccaa

SEQ ID NO: 67877 - protein, 44 aa, Zea mays
  misc_feature: Ceres CLONE 1543041
MLEAKPPSPGSSGAAGAAAHIHAHRGWAVPLLDSVHPSLILISS

SEQ ID NO: 67878 - DNA, 587 bp, Zea mays
  misc_feature: Ceres CLONE 1543045
  misc_feature: Pfam Name: Ribosomal_L28e Pfam Description: Ribosomal L28e protein family
  misc_feature (92)..(92): n is a, c, t, g, unknown, or other
  misc_feature (102)..(102): n is a, c, t, g, unknown, or other
  misc_feature (113)..(113): n is a, c, t, g, unknown, or other
  misc_feature (114)..(114): n is a, c, t, g, unknown, or other
  misc_feature (152)..(152): n is a, c, t, g, unknown, or other
  misc_feature (275)..(275): n is a, c, t, g, unknown, or other
  misc_feature (278)..(278): n is a, c, t, g, unknown, or other
  misc_feature (279)..(279): n is a, c, t, g, unknown, or other
  misc_feature (304)..(304): n is a, c, t, g, unknown, or other
  misc_feature (332)..(332): n is a, c, t, g, unknown, or other
  misc_feature (339)..(339): n is a, c, t, g, unknown, or other
ctccccgcggtggcggccgctctagaactagtggatcccccgggctgcaggaattcgtctcacccctagaaaaaaaccccgtgaacagagcngaggcgacgnccgaggcaccnntcatctccggcgaaggggaaatgggcgtaccgttccanggggaatctcgatctggcagattgtgaggaagaacaactccttcctggtgaagcagtttggcaacggcaatgccaaggtgcagttcaccaaggagccccacaacctctacaatttacactccntanncaagtactctggctttaggcaaacnaggaaaaaactggttaacgatttcaaancccaagncttgcttgggaaaaagggaaacccccggggggtgggggggcccctttttttctccccgggcccgaaaagcaaaaacaccccccaaaaattccccccccatttttttgtttccccagaggttttccccccaaaggccccaggggtgttaaaaaaacccggtgggggggaaaaaaattttttaggggcctttttttttaaaaaaaaaaccccccctttggggggggaaaactccttttttttttccccca

SEQ ID NO: 67879 - DNA, 655 bp, Zea mays
  misc_feature: Ceres CLONE 1543046
  misc_feature: Encodes the peptide sequence at SEQ ID NO. 67880
  misc_feature (597)..(597): n is a, c, t, g, unknown, or other
tggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctgggctgctgcttccctgatatcgaccatttccccagtcttggctctttggagntcctcccttcctcatctccaggcatggggttctgatcccccggccccaatggcggttc

SEQ ID NO: 67880 - protein, 50 aa, Zea mays; identical to SEQ ID NO: 64299
  misc_feature: Ceres CLONE 1543046
  misc_feature (1)..(50): Pfam Name: AdoMetDC_leader Pfam Description: S-adenosyl-l-methionine decarboxylase leader peptide

SEQ ID NO: 67881 - DNA, 646 bp, Zea mays
  misc_feature: Ceres CLONE 1543047
  misc_feature: Encodes the peptide sequence at SEQ ID NO. 67882
  misc_feature (544)..(544): n is a, c, t, g, unknown, or other
  misc_feature (551)..(551): n is a, c, t, g, unknown, or other
gcggtggcggccgctctagaactagtggatcccccgggctgcaggaattcgtctcacccctagaaaaagtctcatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctcccccacaacttccgcaagcagctcactgtgcagctgaagaagctcgctgcccgccggcagctgacgagggtgaagaactcccttcagctgccggccaccgacgccnagcccanggccgcaagccccaagcacccaaggccgcgccatagcccagccctccgcgaaagcgaaggccagaccgctgcgaagcccaaggcgcgtcgcccaa

SEQ ID NO: 67882 - protein, 161 aa, Zea mays
  misc_feature: Ceres CLONE 1543047
  misc_feature (54)..(124): Pfam Name: Linker_histone Pfam Description: linker histone H1 and H5 family
  misc_feature (128)..(128): Xaa is any aa, unknown, or other
  misc_feature (130)..(130): Xaa is any aa, unknown, or other
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPHNFRKQLTVQLKKLAARRQLTRVKNSLQLPATDAXPXAASPKHPRPRHSPALRESEGQTAAKPKARRP

SEQ ID NO: 67883 - DNA, 864 bp, Zea mays
  misc_feature: Ceres CLONE 1543048
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (665)..(665): n is a, c, t, g, unknown, or other
  misc_feature (692)..(692): n is a, c, t, g, unknown, or other
  misc_feature (756)..(756): n is a, c, t, g, unknown, or other
  misc_feature (772)..(772): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
nnnnnnnnnnnnnnnnnnnnggggttttnnnccccgacttttncnnccaaaactaaactcccctcaatgttcaccactctataactaatggatccccccaactgcaagaattcatctcacccctacaaaaaacctcccacacatctcctccacctcccaatccccacttgttctcctccccccttcctcccgtatccgtgccaccctcccccaccccatcaaccataatcacgaccacttctcagtactaaaatgccaagtcctcttgctgcgccgcggtcagctattcattgctggtgataacgcgccccaggcaccccccatgaactgcttcccgttcttctgttcctctttatattattagctcaaatgactacaaatccaaaggcccctctcttattccgattccagtcggctcccccacccaaccaacttacctacatacctgaatactcctacatctttaataaaatataagatcccacccgcttcacaaataatacccattatttaaatacccccccaaacaaaccactcactactaaagtcccccgtcaatatgacccctctctacactttttccaaacccttatataacacccaattgcattcttttctcccccataaataataccgcttttccatcttacttatataatatattnccccattaaacaaaataaattcatttntccttccattaatccaccctacacccatcttataaccaaacccctcaaaccccaaacaaaaaantttttcttctaaatantttgtaatctataaattattacattttcacaccttaaagtagtaagtccaaccaaaccaaaagcacccacnnnatatacttctcaaacaacg

SEQ ID NO: 67884 - DNA, 2431 bp, Zea mays
  misc_feature: Ceres CLONE 1543050
  misc_feature: Encodes the peptide sequence at SEQ ID NO. 67885
agagaatccgattgcttctagtttgtctccccaactcctcgcctcgcctctcctcctggttatgggcgccggcgagttggatggacgcgccttgtcggacgcggagcagcagtagcggcgggcaaccaggcgggggatctggatccgaggcaccaccaccgggctcctcacggcggcgacgcaggcggcggcggagaaggaggaggaggcggaggagcgcagcaagaagcagatgagcagcagcggcaccacaacaaccggctgctgcagttccaccagcaagtgcagcagaaccaagacccgccgccggtccccctctttcagctccagcacctgcaggccgcggcggccgtgaggcagcggggcggcttgtcggccgagtatgcccttctcgaccccatgggcgacgccggccagtcccactcccaccgccaccaccacggcttccagccgcagctcctgtccttcggaggagtcggccagcaccacatgcaccagttcacggcgcaggcgcccgcggcgtctcactcctcgcggccgcggataggaggggtgggcgcgggcggcgaggccgcggccgccacgtccgcgtcgcactcgcgcgcgaggggcggcgccggggagatcgtggccgtgcagggagggcacattgtgcgctccacggggcgcaaggaccgccacagcaaggtgtgcacggcgcgcgggccgcgggaccggcgcgtgcgcctctctgcgcacaccgccatccagttctacgacgtgcaggaccggctgggctacgaccgccccagcaaggccgtcgactggctcatcaagaacgccaaggacgccatcgacaagctcgagacgctgcccgcgtggcagcccacggccaatgccgccgcgccgccgtcctcctcgacgcaccccgactccgccgagaactccgacgaccaggcgcaggccatcaccgtcgccgcgcacgctccgttcgacttctccggcgccggtggagcaagcggcggcgccgcgggcttcctcccggcgtcgctcgactcggactccatcgcggacacgatcaagtcgttctttcccatggctggcacgggtggcggcggcgaggcgtcgtcgtccacggcggcggcgcagtcgtcggccatgggcttccaaagctacacgcccgacctcctgtcgcgcaccggcagccacagccaggagctccggctgtcgctgcagtctctcccagaccccatgttccaccagcagcaggaccggtcggaagcccacggcggcaatggctcggcgcagcaggcgctcttctccggcgccgccagctactcgtttggcggcggcgccatgtggggcgagcaggcgcagagccagcgcatggtgccgtggaccgtgcccgacccaggcggcgggagcgctggcggctacctgttcaacgtgtcgcagcaggcggcgcacatgcaggcggcgtttggcggccagagccagttcttcttccagaggggaccccttcagtccagtaaccagccctccgagcgaggatggccggagagcgtcgaagccgacaacccgatgcagcacggcgggctcagccccgctgtgtcggccatcgggttctcgcccggcgtcggcttctccgggatccgcatccccaccaggatgcagggcgacgaggagcacaacggcggcggcaatggcgacaagccgccgccgccgtccgtgtcctcggcttctcaccactgacgacggcagagcagtggagcgcagattactccgcgcgcccaccatgccaccaaccaccatcacgagcatttcagcagcataccatgcatgaattcagcaaacacatatcaccgtcagctagctcctcaacatgcaccgcccaggtagttactttgctgctgcttcctacgacaacggatggctgcagcaaaatggaggagcaaggttgggagcgaagcactctttttgactggctggttggttggccggtcggtcggtcggtcggtttctctaccatctctcgctgctttgtgtacgtcactggtttttgctccaagaactcactcactcactcggagcttctcttgttagaaattaggcctgtgagaacgcagcacattggctagccagcaggttctttcttcactagatctcttgctgcttgtccgtttgctgcgttgttacagtaggtttagttgatgttctagttgctgtagtagttctcaagcttttgcatcttaattttgctgttgttctcgctggcgctctgcacggatcgatgggggttaagctagtgtgcttcctcctggggttcagggagcagctataagcggcagcgcagcgccagccagcggatgatgttgttgttgttgttagcctgatgattaagcggatagggacaggagtctttggttctttttaagaaaaaaaaaaaaaaaaa

SEQ ID NO: 67885 - protein, 443 aa, Zea mays
  misc_feature: Ceres CLONE 1543050
  misc_feature (74)..(309): Pfam Name: TCP Pfam Description: TCP family transcription factor
MGDAGQSHSHRHHHGFQPQLLSFGGVGQHHMHQFTAQAPAASHSSRPRIGGVGAGGEAAAATSASHSRARGGAGEIVAVQGGHIVRSTGRKDRHSKVCTARGPRDRRVRLSAHTAIQFYDVQDRLGYDRPSKAVDWLIKNAKDAIDKLETLPAWQPTANAAAPPSSSTHPDSAENSDDQAQAITVAAHAPFDFSGAGGASGGAAGFLPASLDSDSIADTIKSFFPMAGTGGGGEASSSTAAAQSSAMGFQSYTPDLLSRTGSHSQELRLSLQSLPDPMFHQQQDRSEAHGGNGSAQQALFSGAASYSFGGGAMWGEQAQSQRMVPWTVPDPGGGSAGGYLFNVSQQAAHMQAAFGGQSQFFFQRGPLQSSNQPSERGWPESVEADNPMQHGGLSPAVSAIGFSPGVGFSGIRIPTRMQGDEEHNGGGNGDKPPPPSVSSASHH

SEQ ID NO: 67886 - DNA, 654 bp, Zea mays
  misc_feature: Ceres CLONE 1543055
ctccccgcggtggcggccgctctagaactagtggatcccccgggctgcaggaattcgtctcacccctagaaaaaatcacacagcgccaccgcgtggttcgttaggaaaggagatcgattcccccgcatccgatctcttcggtgctagagaaatataagccggcgcctcctcctcattcggtgaaaggtgggcggttagggttgggagatctcttgactcacgacactagcagcagaattcgtctagggccgctggttgctgctagaggtccgggccttcatgggatctgtaagaatctcttgctctccatacatgttcttgatgcgccatctgatccagtttgatgttcgttttttgtctggcattctattatgctgggatttctaagataccctaactcccagtttgatggtatagggaagtaataattacttgatttgtgaaaggggattaatttgtgaaggagaatggggtgcctatattccttcactaagactcgatttttcgtttcgttgagaatcttggatagccctctggcgtctgggtttctagtttcttcagttgcgtatcgaattctttgtccagcccataactttgatatgggttgtctgcgtagtatggattattgatttctcaattatgcctactattagt

SEQ ID NO: 67887 - DNA, 650 bp, Zea mays
  misc_feature: Ceres CLONE 1543056
  misc_feature: Encodes the peptide sequence at SEQ ID NO. 67888
  misc_feature (452)..(452): n is a, c, t, g, unknown, or other
tggcggccgctctagaactagtggatcccccgggctgcaggaattcgtctcacccctagaaaaatcctcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaaacagaagccctcttcagttgaattgggaccntggaatcttggaaacatttttgacggtatccagcgacctctaaaaacatcggctataagtcagggagatgggtaatccctcctggtggttcagttctgcctttgacaagattgattgtgggaattcagccacgaaactagggttggaaatgtcatccagggtggaatcttaccgctctgtttttgaaaaccctggaga

SEQ ID NO: 67888 - protein, 106 aa, Zea mays
  misc_feature: Ceres CLONE 1543056
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (93)..(93): Xaa is any aa, unknown, or other
MAYGDRVTTFEDSEKESEYGYVRKVSGPVVVADGMGGAAMYELVRVGHDNLIGEIIRLEGDSATIQVYEETAGLMVNDPVLRNRSPLQLNWDXGILETFLTVSSDL

SEQ ID NO: 67889 - DNA, 635 bp, Zea mays
  misc_feature: Ceres CLONE 1543058
  misc_feature: Encodes the peptide sequence at SEQ ID NO. 67890
acccgcggtggcggccgctctagaactagtggatcccccgggctgcaggaattcgtctcacccctagaaaaacccccgcctcgccctccgtcgtctcagcgtatgttgtgcatgtgaagagagagaggaagagggtgacgagcgagaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaggcggcggccaagtgcgagtacagaaagcactccggccaccggtacaggcacccggtgggcgtgcggaagatcgtggtggacgcgggcggcgccggcgatttcgtctccatccagcgcgccgtcgactccgtgccggagggcaacaccgtgcgcgtcgtcgtgcagatcaacgccggcacgtacatagagaaggtggtagtgccggcgtcgaagccgtacgtcacgttccagggcgccgggcgcgacgtgacgg

SEQ ID NO: 67890 - protein, 109 aa, Zea mays
  misc_feature: Ceres CLONE 1543058
  misc_feature: SWISSPROT Homolog: EC 3.1.1.11 Pectinesterase
MARILVLALVTIASLLLPPVVASQQAAAKCEYRKHSGHRYRHPVGVRKIVVDAGGAGDFVSIQRAVDSVPEGNTVRVVVQINAGTYIEKVVVPASKPYVTFQGAGRDVT

SEQ ID NO: 67891 - DNA, 598 bp, Zea mays
  misc_feature: Ceres CLONE 1543059
  misc_feature: Encodes the peptide sequence at SEQ ID NO. 67892
  misc_feature (24)..(24): n is a, c, t, g, unknown, or other
  misc_feature (378)..(378): n is a, c, t, g, unknown, or other
tccccgcggtggcggccgctctantgaactagtgggatcccccgggctgcaggaattcgtctcacccctagaaaaatccccggtgcagaacgctcaacggctgtgctgccaaaagtccggaccacagctcgcgccgcccgccgcgccttgcccagacgtgcgctcccttctcccgcgccgtcgcctctgccctggccgacccgctgggcccagtgtgcgcagccctcccgggttaaggcggaggtgcttggggacccgctcccatggcgagcgccggcatcagcggcagcggggacgacgatgcaggagggaagctcttggcggatcgctaccagaagggcgaggtcctcggcgagggcacgtacggagtcgtcttcnagggcatcgacacccagactggaaatacagtcgcggtaaagaggatctgggtagggaaagaacaaaaaggaaggtggttactttccccgcctttgagggaaattaaactaccttagggggcctgaaaggcgcctatatttttaaaagccgaatggattgggttccccttaaaaggaaaaatttcccccctgggtttttggattttttgggaaacctgttc

SEQ ID NO: 67892 - protein, 76 aa, Zea mays
  misc_feature: Ceres CLONE 1543059
  misc_feature: SWISSPROT Homolog: EC 2.7.11.23 [RNA-polymerase]-subunit kinase
  misc_feature (39)..(39): Xaa is any aa, unknown, or other
MASAGISGSGDDDAGGKLLADRYQKGEVLGEGTYGVVFXGIDTQTGNTVAVKRIWVGKEQKGRWLLSPPLREIKLP

SEQ ID NO: 67893 - DNA, 2853 bp, Zea mays
  misc_feature: Ceres CLONE 1543065
  misc_feature: Encodes the peptide sequence at SEQ ID NO. 67894
actcagtgcggggccttcctccactcccccactcgtctcgcacccgcgttccccgtggtcaactcgctgcctccagcgacgaccgcgaggggggggccgaaataggcaggcaggcagcggcaggccacccaaaaagcgaccaccctgcgcgcaccacctcggctgccattgccatggccacgccatgacgccccgcccagctgcacgcgctcacacccccaccgctccactccgctccgcctaaccctcaccctcacccgccaccgctcgcctccccatgcttccgcgctgccgccgccgccgctcgggtgcctcctgcctcgccgtgctcctcctcctgctgctgctgcacgcgggcgcggggtccgcgcagggcgcgcttgcgcggcaggacgtcgcggcgctccacggcctgcgcgcgtcgcttggcgtgcgcgccagcgactggcccgacagggccgacccctgcaccttctggtcgggcgtcgtctgccgcgccggccgcgtcgcggagctccgcctctccggactccgccgcacccgcgcgggcgcccggagcgcggccttcgccgtcgaccaactcccgcggctcgcagcgctccaggcgttcaacgcctccgggttcccgctccccggccggatcccgtcctggttcggccgcggcctgccgccgtcgctcgccgtcgttgacctccgctccgcacgcgtcaatggcgagctcccggtcgatctcggcatgtccgggaacctcaccacccttgttctctccggtaacaacctgtccggccctatcccgctgtcgctcctctcaatcgctggtctccgcgttctcgacctctccgccaacaatctcaccggcccgctgccgaacgtgtcgttctctggcagtggtggagctggagtcttgttcaacgcctctggtaatgccttgtacggcgccgtcggcgatgccactggctccctcaggaagaggttctgggttgttgatgtctctgacaattacttcgatcaggtgcttggaactgggtttcagaatggaaccgatggtgtggtggatctcaggatgaactgtttgtctggtgcagcaagccagcgtacccgcggggattgtgaggctttctacacgaggaacggggtgaggcttgcgttggaccccaagccaccatcgccattgccagagccacagccaccacaggtgctgatgccgtcaacgaaaaagagagggggcaaatggaagtttgtattgaccggggtccttggtggtgctgcaattctggtaacacttggccttagcgttctggtattttgcttgttgagaagaaaaggaaggaaaccgagagggagaggagtggagcagactgaagagggcattcggtctgggcggagaagtagtagtgtgaatcccgtcacaatgtcacccatggcatcccccagagccagtggttcaccaaagggcgttcctattatcacagatgaattcacctatgagcagttgcaccatgctgcagggggctttggggatgataacctcgtcaagcatgggcactccggtgacatgtactatggtgtcctggagagtggctttcaagttgtcataaaaaagattgatctgaagaccaggaagaagtgccagggcgaattgagcttccttacaaagcatacccatgggaggatcgttccattgctgggccatttggctaaggatgaagaggaattgcttgtctataagtacatggcaaaaggtgacctcacaaccgcactgcacaagaagtcagtggaagttgaacaggggttgcgctcattggattggataacgaggctcaagattgcaataggtgtggctgaggccttgtgcttccttcatgacgaatgcaatcctccgttggtccacagagatatccaagccagcagtgtgcttcttgaggacaaatttgaagtgtgccttgggagtctgagtgaaatatgcactcaacaaagtgcaggaagccaaagtttcttctctcggattctaagatcatcgaagtcccttgacaagaacataccaggtccaccagctagctgctcatacgacatttactgtttcgggaaggttctactagagctaatcactggaaacttcggtgcgagtggctcaaccaacgcagattcagaagagtggttagcaagaacattagattacatcaacgcaaatgacaaggagggtgtctcaggtattgtggatcccacccttgttgtggatgatgaccatctagaggaagtgtgggcagtgtccatcgtcgcgaagacatgcctgaatccaaagccctctaggcgtccactcgctcgatacatcctgaaagcactggagaacccactaagggtggtgcgggagcaggaagagttccaatccagtccatctcacctcagaagtaccccatcccagggctcttggcgtttcgctttccatggaaacaagtaccacagctgggaggccatgccaacgtcggggcaagcacttgctcggaaaaatacagcgaagtctcaggggaccgaggggagtgacgaggacgaagagaactcgttctcgttcaagagggcttctcgggacgattttccggatcccatagagtttgaaggaggtgttgttgtgaaggagtacccgcagactagctagcgatacttgatgtgcatctctttgatgtctctaggtgaaaagctgtgtatacagaatagataattttttcccctcttttctctttacttgtttatctcagtcgattgaaatggaataaatggcgcactgggtgtgccatccttgaaatgcaagccagtaaagttctcagatagagccatttgcaaaaaaaaaaaaaaaaa

SEQ ID NO: 67894 - protein, 791 aa, Zea mays
  misc_feature: Ceres CLONE 1543065
  misc_feature (418)..(689): Pfam Name: Pkinase_Tyr Pfam Description: Protein tyrosine kinase
  misc_feature: SWISSPROT Homolog: EC 2.7.11.1 Non-specific serine/threonine protein kinase
MLPRCRRRRSGASCLAVLLLLLLLHAGAGSAQGALARQDVAALHGLRASLGVRASDWPDRADPCTFWSGVVCRAGRVAELRLSGLRRTRAGARSAAFAVDQLPRLAALQAFNASGFPLPGRIPSWFGRGLPPSLAVVDLRSARVNGELPVDLGMSGNLTTLVLSGNNLSGPIPLSLLSIAGLRVLDLSANNLTGPLPNVSFSGSGGAGVLFNASGNALYGAVGDATGSLRKRFWVVDVSDNYFDQVLGTGFQNGTDGVVDLRMNCLSGAASQRTRGDCEAFYTRNGVRLALDPKPPSPLPEPQPPQVLMPSTKKRGGKWKFVLTGVLGGAAILVTLGLSVLVFCLLRRKGRKPRGRGVEQTEEGIRSGRRSSSVNPVTMSPMASPRASGSPKGVPIITDEFTYEQLHHAAGGFGDDNLVKHGHSGDMYYGVLESGFQVVIKKIDLKTRKKCQGELSFLTKHTHGRIVPLLGHLAKDEEELLVYKYMAKGDLTTALHKKSVEVEQGLRSLDWITRLKIAIGVAEALCFLHDECNPPLVHRDIQASSVLLEDKFEVCLGSLSEICTQQSAGSQSFFSRILRSSKSLDKNIPGPPASCSYDIYCFGKVLLELITGNFGASGSTNADSEEWLARTLDYINANDKEGVSGIVDPTLVVDDDHLEEVWAVSIVAKTCLNPKPSRRPLARYILKALENPLRVVREQEEFQSSPSHLRSTPSQGSWRFAFHGNKYHSWEAMPTSGQALARKNTAKSQGTEGSDEDEENSFSFKRASRDDFPDPIEFEGGVVVKEYPQTS

SEQ ID NO: 67895 - DNA, 651 bp, Zea mays
  misc_feature: Ceres CLONE 1543069
  misc_feature (651)..(651): n is a, c, t, g, unknown, or other
gcggtggcggccgctctataactagtggatcccccgggctgcaggaattcgtctcacccctagaaaaaactccactgccagtgccatcccattcccatccgaggtaaacgcgtcaacgcgaccagctcacctcgtcatctcccattctctttcatatttgcatgcatctcggttctcggatctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgtttcccgaggtgccccgccgactaccaggactacaccccttgcacggaccccaagcgctgggcggagtacgggcactaccgcctcagcttcatggagcggcactgccccgccgcgcccgaacggaaacagtggcttgtggcgccgcccaaggggtacacn

SEQ ID NO: 67896 - DNA, 670 bp, Zea mays
  misc_feature: Ceres CLONE 1543071
  misc_feature: Encodes the peptide sequence at SEQ ID NO. 67897
  misc_feature (462)..(462): n is a, c, t, g, unknown, or other
tccccgcggtggcggccgctctagaactagtggatcccccgggctgcaggaattcgtctcacccctagaaaaagtacatggtcgcactcgcacaattcgcacgtcagaaagcgagagaagtccgtctgctggtcgcaaccgagcaggatgctgtcattgcccagaacggcggcggcggtgactgtgtatgcgctggtcgctcttatcgccggcgccgccgcggcgggaggtggcgagcagccgctgtcgaggatcgccatccaccgcgccaccgttgcgccccagccgggtgccttcgtcgacgcttcgccggcccttctcggccgggagggggaggacagagaatgggtgaccgtcacatatagtaaccccaggccctcgaaggatgactggattggactcccctcccctgctaatttcaatgattccatttgtccaccagagaatgaatgggtggagccncctcttttatgcacagctcctatcaagttccaattcgcaaactacacgaatcgtgattatggaaacactggaaagggatcgttgaggcttcagctgataaatcagagagagggtttcctcttttgccattgtttctcctggagggctggtccaaatccgaaactcactcccccactccaaaaaagggtcacttttcgccaaccccaaa

SEQ ID NO: 67897 - protein, 174 aa, Zea mays
  misc_feature: Ceres CLONE 1543071
MLSLPRTAAAVTVYALVALIAGAAAAGGGEQPLSRIAIHRATVAPQPGAFVDASPALLGREGEDREWVTVTYSNPRPSKDDWIGLPSPANFNDSICPPENEWVEPPLLCTAPIKFQFANYTNRDYGNTGKGSLRLQLINQREGFLFCHCFSWRAGPNPKLTPPLQKRVTFRQPQ

SEQ ID NO: 67898 - DNA, 889 bp, Zea mays
  misc_feature: Ceres CLONE 1543071-R2
  misc_feature (538)..(538): n is a, c, t, g, unknown, or other
acgattgggtacctcgagcgtctcgtgagacgatttcttgcagccagaagggatccactagttctagagcggccgccaccgcggtggatctcctccttttgtccccttgggcgccccccaattaagcaaaaaatccgggggggggatcatttttggccggggggacaccccaaagcaccatggggacctgctgcaccagaagcggcttccccactcaggtatttcatcccccccacaacagtacagcaaagggcaccgatcttgaaatcaaaacccaacagcgacccaaaccgaatataatcgacaccaccgctcgttcacaaccccagggtggtgctgggggatttttcaacacccccaggccaaaacttcccgttatccccgggaaaatgggaaaagggtgctttgcacccttgccttcccgggctctttctttgttccccaaaaagcacccctcgggggggttaaaacccccgccaggttccaaaaaaccaaaaatgcggggccccccaaaagggtttccctttggccccccccnggggcctttttaatccgggaaaaggtttgggcccccccccccccccccccccaaaaaatggggggtttgtccccccctaaaaaaaccccccccccaaaaaaatggagaacccccccttgggcccccacacccggtttctctataataatggggggaggggcccccctctcaaaaccccgggaaaaagggccccccaaaaaaagcgaggtgccccaccctgtgattctttccccaccaaaaagggggataagaggcccccccacgccccccaggggggccccccccggcggggtgcccctctcttccgcggcgggtggaaaaaagaggggccgcccaaaaaaaaacaccccc

SEQ ID NO: 67899 - DNA, 864 bp, Zea mays
  misc_feature: Ceres CLONE 1543071-R
gattgggtacctcgagcgtctcgtttttttttttttttttcttaaaatataacacatgtttatatataagttattatagtattatatatttccgttgcaacgcacgggcactcacctagtaagcaaagaattcaggggtgtgatcatttttggccgtggggacactccgaagcagcatgtggacctgctgcaccagcagctgcttcctcactcaggtatttcattccgtccacaacagtacagcacagtgcatcgatcttgaaatcaaaatccaacagcgacacaaaccgaatataatcgacaccaccgctcgctcactacgccagggtggtgctggggcagttgtcgaccccgcaggccagaacgtcgcggtagtcccgggagatggtgaagtggtcgtgcacactgccatcccggctcttcttgtactccaacagcagcctcgtgtggttgaacgccgtcagcttcacgaacccaaagtcgcggtcccgcacacggctccatcacgcccgcgcggccgtgtagtcggcgaggctgaggccgccgccgcccaccacgacgtgcgtcgtcaccgttagagcggcggcgtaaaggtccgacccctttgccccgacacacgttttcattactggggaagggcccgttcgtaaccccgggacgttgccctacataagcgagttcaacccttgaacctttagcccaaaatgggttaaaagactttcaggggtccctatgggcgccccccggggggtccctttcctcaggccgtaaaaagagtggcccgacatagttaaaccccaggaaacacagtttggccgcctgagaaaattgtaaccacctgggcttggttttctggcaaaaaaa

SEQ ID NO: 67900 - DNA, 671 bp, Zea mays
  misc_feature: Ceres CLONE 1543072
  misc_feature: Encodes the peptide sequence at SEQ ID NO. 67901
  misc_feature (453)..(453): n is a, c, t, g, unknown, or other
gcggtggcggccgctctagaactagtggatcccccgggctgcaggaattcgtctcacccctagaaaaagccatacaattctcacacgcgcgcgcccaacacactagcctgcaggatcgtcgagcgcgaggcggctgccccgccggccggttcgttcgctctatagcttgagaccgatcctagggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagatttacctgcttgtacgcgcggtcgacgagccatcagcgaagcagcgcgtccaacaagaggtgatacacacggagctgttcggcctgctgagagagaacacgggcaggggcttccgcagntcgtagaggccaagtcgtcgcttttggccgaagacatcgtatccaccggccctggggctggaggcaaccgtgcttgaccgccctggccaggacgtcaacgttcttcttcaaaatcgcggcaaccccccaaattttttatcgaaaaaataccaatggtttccccccgcgaccttaaaccttgcctgggaaaggaaaaaccccctgttgatttgttctcc

SEQ ID NO: 67901 - protein, 84 aa, Zea mays
  misc_feature: Ceres CLONE 1543072
  misc_feature (83)..(83): Xaa is any aa, unknown, or other
MMMDAARIVEYFKGKCILVTGSTGFLGKILVEKILRVQPDVRKIYLLVRAVDEPSAKQRVQQEVIHTELFGLLRENTGRGFRXS

SEQ ID NO: 67902 - DNA, 731 bp, Zea mays
  misc_feature: Ceres CLONE 1543074
  misc_feature: SWISSPROT Homolog: EC 2.4.2.14 Amidophosphoribosyltransferase
  misc_feature (13)..(13): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (42)..(42): n is a, c, t, g, unknown, or other
gggggggtgtgtntnttntnnnntnnaatgacgtataatcgngtggtgtttttcaatcaaccttaggactcaccgtcggtggcggccgctctatactagtggatcccccgggctgcaggaattcgtctcacccctagaaaaaagggcatccttggaagttggaagcaggcctcacctgcccccaaaggcccaaactcccgaaccgccccgcaccacgcatggccgccacagccgccgccgccgcgacggcctccacgccttcctctcccctccgccgccgagcctctgcggcgtctaccacaagacacaactcccagctcaaatgctccatcaagccctcgcagttcgagctgcggcaccgcgccgcgggtctcgctccggcgcgagctctgctccctgaccgcgtcacgccgttttccttcgacgcggacagcgacgaccatccccgagaggagtgcggcgtgttccgaatcattggcgaaccagacgcgtcgtcgctctgctacctcggcctgcagaaactgcagcccccccggggagaaggccccgggcatccttgcgtcggacgccgaacggcaacctcaatgcattgaccgaactgggaactttgtccgggaaagtttttccccgaattccggggcccccctcgccaaagtttcccccgggaaaacgcccgcccatcggggccaacgggggcccttaatccaaccccccccgggggggcccccttt

SEQ ID NO: 67903 - DNA, 669 bp, Zea mays
  misc_feature: Ceres CLONE 1543075
  misc_feature: Translation starting site: 94
  misc_feature: SWISSPROT Homolog: EC 1.14.13.68 4-hydroxyphenylacetaldehyde oxime monooxygenase
gcggtggcggccgctctataactagtggatcccccgggctgcaggaattcgtctcacccctagaaaaatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacggggtccctgtttcttccgcgccggcgccgtgcccaccctgatcgtgtcgtcgcccagcgccgcgaaggccgtgatgcgcaactacgaccacatcttcgcggtcccggccgttgggtcatgggctcccaaatccttcggttacaacacctgggacgtgggctttctccccttcggggaaattttgggcgcgaaaccgggaagctgatgaacccccccctggtcaaaaaaaaaaaaaggggtttttcctttcccccctgggcccaaaaaaaaaagggggccccccccttggaaaaaatctcccg

SEQ ID NO: 67904 - DNA, 759 bp, Zea mays
  misc_feature: Ceres CLONE 1543078
  misc_feature: Encodes the peptide sequence at SEQ ID NO. 67905
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
taatatttattctttcttttttatatatgtttcttcccccccttnnntggcaaaaatggagctccccgcggtggcggccgctctataatagtggatcccccgggctgcaggaattcgtctcacccctagaaaaaagaagccgcagccacgccccacgcccccacaccaagccgtatcgtcttctccctcttgtccggttcgggtggtccgcggtcggggtgagtgagtgagcagctttgcttctccatctccccattcccgtccctccccagcccccccggcccggcggcggtacgtgaccctgacgccgcagcgctagctagctcgccggaacgggaggtggcggcgcgcgacctgagagcacagcagcagcggaccggctcaggcaggcgaccggcaagaaagatggcgggagcagcagctgtggagactgcggcggcggctgcggcggcggcggcaggagccaacggaaaagcgtgctgccacgccgccaaggggcccgggtacgcctcgccgctggaggccatggagaacggccccagggagaagctcgtctacgtcacctgcgtctacaacggcaattggaatttaacaagccggattacccttgcgacggggggattttggattcccaggctctccctacatactcccaaggtggatccaaaagggcttccccgggtacaacccaacattggggcgaaaaaagcttgtcattccctctttgggggggggaaaatctcctgggagactccctcg

SEQ ID NO: 67905 - protein, 118 aa, Zea mays
  misc_feature: Ceres CLONE 1543078
MAGAAAVETAAAAAAAAAGANGKACCHAAKGPGYASPLEAMENGPREKLVYVTCVYNGNWNLTSRITLATGGFWIPRLSLHTPKVDPKGLPRVQPNIGAKKACHSLFGGGKISWETPS

SEQ ID NO: 67906 - DNA, 2047 bp, Zea mays
  misc_feature: Ceres CLONE 1543090
  misc_feature: Encodes the peptide sequence at SEQ ID NO. 67907
gttcccttcgcctccccattccgtaccgcgtcagatcgcacccctcctccatggcggcgctcagcctccgccagaggcagcttgatctgattgtgcggatgctgcacctcaacaagccaccgccgccgcccggcacggctgcggagcaagaagaggaggtgtacaagatcctggtactggacagcttctgcctctcgctgctctcgccgctgctccgcgtcgccgacctccgcaagcacggggtcaccctctactttcccatcgacaagccccgccagcaggtcgccgacgcccccgccgtgtacttcctccgccccacgcaagccaatgccgaccgcgtcgctgcagatgccgccgcctcgctctacgcatccttccacctcaacttctcctccgccctcccgcgcccgctcctcgaccgcctggccgccgccaccgcagcctccggctctgcccaccgcgtcgcccgcctcgccgaccagtacctcgacttcgtctctctcgaggacaacctcttctccctcgcccacccgcgctcctacgtcgcgctcaacgaccccaaagcggccgacgccgacattgaggccctcgtcgacgcgatcgcgctcggcctcttctgcgcggcggccacgctcggcaccgtgcccgtcatcaggtgcccccgcggtggccccgccgagatggtcgccgccgcccttgacgcccgcctccggcatcacctcctcgccaagcctaacctcttcaccgaggcctcagcctcagcctccgttgcctccttccagcgccccgtgctctgcctcttcgacaggaatttggacctctctgtgggaatacagcacgattggagctaccgccccttggtccatgacgtcctcggcctcaagctcaacaagctcaagatgcccgcggacaagtctggcccggccaaggcctacgatctcgatgattccgatgccttctgggtagcaaacagctggtcgccgttccccagggtggctgaggagatcgagtcgcagctcgccaagtacaagcaggatgtggacgaggtgaaccagcgcaccggtggcaacaaggatggcatcgagttcgatggcacagacctcattggcaacacccagcacctgatgaatgccgttaactcgctcccggagctcacagaacgcaagaagatgatcgacaagcacacgaatatcgcgacagcgttgcttgggcacatcaaggagagatcgctggatggatactgtgactgcgggaacgacatgctcacgaagggcaccgtggacaggagcacgctactgggccttctccgagggaagggcaccaaggcggacaagcttcgtctggctgtgacctacctcctctgtttcgagacgccagagctagagcaggtcgaggcggcgctgcgtgagtcagaagtggacatgtcagcgtttcagtatgtgaagaggatcaaatcgctgaacacgcagtttagtgcctcgtcgtcaagcagtgcaacgaggagcaacattgttgattgggcagagaagctgtatgggcagtccattagcgcagtgacagcaggggtgaagaatctcttgtccagtgggaggcagcttgcattgacgaggacggtcgaagctctcatggaagggaagccgaatccggaggtggacaactatctgctgtttgacccacgtgcccctagatcaggaagcggtgggcagttcaaagggccattcagagaagcaattgtgttcatgattggtggtgggaattacattgagtacaggagcttgatggagctggcagaatgctcgcagccgccttcttccaagcatgtcatatacggagcaactgagattgtcaacggggtggagttcatcgagcaacttgcagaactggggcagaaagcggggctgggtctgggtggtggaaacaaccctccactacagtaattactaataaataagggggggttctttcacatcgtttgaacattgtcagatatgatatgatcatttgcttccttttgtatggtttatattcagaaaaaaaaaaaaaaaaa

SEQ ID NO: 67907 - protein, 628 aa, Zea mays
  misc_feature: Ceres CLONE 1543090
  misc_feature (38)..(608): Pfam Name: Sec1 Pfam Description: Sec1 family
MAALSLRQRQLDLIVRMLHLNKPPPPPGTAAEQEEEVYKILVLDSFCLSLLSPLLRVADLRKHGVTLYFPIDKPRQQVADAPAVYFLRPTQANADRVAADAAASLYASFHLNFSSALPRPLLDRLAAATAASGSAHRVARLADQYLDFVSLEDNLFSLAHPRSYVALNDPKAADADIEALVDAIALGLFCAAATLGTVPVIRCPRGGPAEMVAAALDARLRHHLLAKPNLFTEASASASVASFQRPVLCLFDRNLDLSVGIQHDWSYRPLVHDVLGLKLNKLKMPADKSGPAKAYDLDDSDAFWVANSWSPFPRVAEEIESQLAKYKQDVDEVNQRTGGNKDGIEFDGTDLIGNTQHLMNAVNSLPELTERKKMIDKHTNIATALLGHIKERSLDGYCDCGNDMLTKGTVDRSTLLGLLRGKGTKADKLRLAVTYLLCFETPELEQVEAALRESEVDMSAFQYVKRIKSLNTQFSASSSSSATRSNIVDWAEKLYGQSISAVTAGVKNLLSSGRQLALTRTVEALMEGKPNPEVDNYLLFDPRAPRSGSGGQFKGPFREAIVFMIGGGNYIEYRSLMELAECSQPPSSKHVIYGATEIVNGVEFIEQLAELGQKAGLGLGGGNNPPLQ

SEQ ID NO: 67908 - DNA, 659 bp, Zea mays
  misc_feature: Ceres CLONE 1543091
  misc_feature: Encodes the peptide sequence at SEQ ID NO. 67909
  misc_feature (636)..(636): n is a, c, t, g, unknown, or other
ctccccgcggtggcggccgctctagaactagtggatcccccgggctgcaggaattcgtctcacccctagaaaaaggtaccggcaggccattggccacagcccgctttactcacgacgcgacgaaccgcgcactccctttaaagctccacgttgcggtgtcctcacgggtcacggcgaccgatgccgctgctgctgcgcggcgcctccctcctccgcctctgccagtgtaccagtgggctctcaagtgtgaaatttagttcaagagtaacggtactagtgaatctcaacgccatgagggacggaatgcgggccacatattcacgtagagctgcctctaagaacagtgaggtcaagaaagatgagcagccactcacagagaaggaagatgctgctgaaagtgatttggagatggagcgagggaggagcagcagccctagccagctccaatcaatgactgtcaaggagctcagggagctcacgaggaggaggggtatttctgtgaaaggtaccaagaaagatttagtatcagcactgatgaattctatggccgtggaagcaaatggtgaagagggaaagtcatccgttgagctggttagcccccttggaagtacctttgaaaagaaaaggtggtgcttnctgttgtggttgaacaaaactag

SEQ ID NO: 67909 - protein, 159 aa, Zea mays
  misc_feature: Ceres CLONE 1543091
  misc_feature (88)..(122): Pfam Name: SAP Pfam Description: SAP domain
  misc_feature: SWISSPROT Homolog: EC 2.4.2.30 NAD(+) ADP-ribosyltransferase
  misc_feature (152)..(152): Xaa is any aa, unknown, or other
MPLLLRGASLLRLCQCTSGLSSVKFSSRVTVLVNLNAMRDGMRATYSRRAASKNSEVKKDEQPLTEKEDAAESDLEMERGRSSSPSQLQSMTVKELRELTRRRGISVKGTKKDLVSALMNSMAVEANGEEGKSSVELVSPLGSTFEKKRWCXLLWLNKT

SEQ ID NO: 67910 - DNA, 626 bp, Zea mays
  misc_feature: Ceres CLONE 1543092
  misc_feature (626)..(626): n is a, c, t, g, unknown, or other
ccgctctagactagtggatcccccgggctgcaggaattcgtctcacccctagaaaaatgtgtgactttcggaatgggcggagatgggaaccgaggctgttctgctgaaaagcgtggatgcgaccttgcaacatggcctgtgagcttgtaccctcttggaacgcgggtatgatggaggtctaacgatctgatggatgccatctgagccttcctggacaagcggatgcctgtgttctccaagctgtaatgatcagatgccttcatgccctaccttctgccgttacttcactcgtggtgctacgctctctggaaatcgcacaggaatcaagtgtgctactagtagaccacagtgccgtctgcggtatcatttgtcgaaacatccattcttgtcagcggaaagaaataaaaaaaaacgagacgctcaaggatcccacttccccctatagtgactcgcattacgcgcactgactgtccgacgcgttactacgtcgtgactggcaaaaccctgtctgtgccaatcttaatcatctttgtaacacatcacgccttatctcagctaggcctcttagtcgatgagaccagttacccctcgcccgtgcctaactgttgcttccaccttgaatagcn

SEQ ID NO: 67911 - DNA, 637 bp, Zea mays
  misc_feature: Ceres CLONE 1543103
  misc_feature: SWISSPROT Homolog: EC 3.2.1.23 Beta-galactosidase
ccccgcggtggcggccgctctagaactagtggatcccccgggctgcaggaattcgtctcacccctagaaaaaaacgaaaaagaaacaaaaaagaagaagagacagaatcacctcgtcatatcgcttgtgaccagttctctgatactagtttgcaagtctgggcttcggtccacagtatatatgtgggatatatatctgtaaacaaaaaaaaaacaagaaggcagggcatgttgggatatatatctgtaaacaaaaaaacaagtttgggcttcggtccacagtatataagctgttttcacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttttaccaataggccgaaatcggcaaaatcccttttaaatcaaaaga

SEQ ID NO: 67912 - DNA, 721 bp, Zea mays
  misc_feature: Ceres CLONE 1543118
  misc_feature: Encodes the peptide sequence at SEQ ID NO. 67913
  misc_feature (293)..(293): n is a, c, t, g, unknown, or other
  misc_feature (395)..(395): n is a, c, t, g, unknown, or other
ggcggccgctctagaactagtggatcccccgggctgcaggaattcgtctcacccctagaaaaagagtttcgatctctcccatccgagtgtctcctcctccgccgccgccgccgccgcttccgtcgtctccgcccgccgaggccatgccgggcggcaagaccttccggatcaagaagaagctggccaagaagatgcgccagaaccgccccatcccctactggatccgcatgcgcaccgacaacaccctcaggtacaacgccaatcttctgcactggagtcggcaacaaactccnattccttatctggtggaagaattgcttggctaatgacgcttgggggggtttttttccccccccccctggggaaaagaaaaggggggtctttttttttccttnttttaactcccccccccttaacaccatgtttttgtccaggaggggaaaaagaacccggccttatttgcccctgggggaatctcacttcaaaagaaaaaggaacacgtaggggagccgcactcggggcttcccccagtgtggtccctatttgttggaggcggtttttacgggccgcttctctcgtgttcttccctctctgtccaacgccccacggcccggggaaccaccccccccgtcgcgcgcctcagccccctgttcgtgcccttcggatccgggtgcgcgcgccccttccgggcggacgctaggggttgactagtgccccccgc

SEQ ID NO: 67913 - protein, 60 aa, Zea mays
  misc_feature: Ceres CLONE 1543118
  misc_feature (9)..(51): Pfam Name: Ribosomal_L39 Pfam Description: Ribosomal L39 protein
MPGGKTFRIKKKLAKKMRQNRPIPYWIRMRTDNTLRYNANLLHWSRQQTPIPYLVEELLG

SEQ ID NO: 67914 - DNA, 779 bp, Zea mays
  misc_feature: Ceres CLONE 1543119
  misc_feature: Encodes the peptide sequence at SEQ ID NO. 67915
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gatcccgcctcttcgccgcctcccgtctaccaaatanaaaanntnnttnnnccaaaactggagctcaccgcggtggcggccgctctagaactagtggatcccccgggctgcaggaattcgtctcacccctagaaaaaaccatcgacgacagcacagctaacccaatcccaaatcaatcttccatggcgccggcgaccttgctactggcgagactggccgtggcgtgcgcgctggcgctcggcgccatggcgcagctgtcgccgacgttctacgacgcgagctgccccagcctgcaggccatcgtgcgggccgggatggccgccgccgtgcagcaggagccgcggatgggggcctccatcctccgcctcttcttccacgactgcttcgtccaggggtgcgacgcgtccgtgctcctcgacgactccccgacgctgacgggggagaagacagtggggcccaacccccaactccctgcgcggcttcgaggtcatcgactccatcaagtcccagggggaggccgcctgcccccgggaaacgtctcccgcgccgacatcctctccctcgccgcccgcaaacggaatcaacctgcctgagcggtcccaactagggccgggggcaacttggggtcccccggagacaccccccacggagcagccaattccggagggcgaaaaaagaaaaccttgtccgccgccctttccaacagagcggcgggcgggccactttgagtagaccgggcctttccatgataacgaaggggggctatcggaatttccgcg

SEQ ID NO: 67915 - protein, 136 aa, Zea mays
  misc_feature: Ceres CLONE 1543119
  misc_feature: SWISSPROT Homolog: EC 1.11.1.7 Peroxidase
MAPATLLLARLAVACALALGAMAQLSPTFYDASCPSLQAIVRAGMAAAVQQEPRMGASILRLFFHDCFVQGCDASVLLDDSPTLTGEKTVGPNPQLPARLRGHRLHQVPGGGRLPPGNVSRADILSLAARKRNQPA

SEQ ID NO: 67916 - DNA, 642 bp, Zea mays
  misc_feature: Ceres CLONE 1543120
  misc_feature: SWISSPROT Homolog: EC 3.2.1.23 Beta-galactosidase
ggcggccgctctattctagtggatcccccgggctgcaggaattcgtctcacccctagaaaaatcctcctcatccagcgcggctccactcaaagcttgagccttccttttcttttcttgtttttgttttattttcttggtaggggggagtcgtcttctccatctctccttagcctaggagaaggagagatccagaggcaaaagcttcagggtttgtacaaattctagatctaaccggactaaccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaac

SEQ ID NO: 67917 - DNA, 787 bp, Zea mays
  misc_feature: Ceres CLONE 1543121
  misc_feature (11)..(11): n is a, c, t, g, unknown, or other
  misc_feature (12)..(12): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (38)..(38): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (82)..(82): n is a, c, t, g, unknown, or other
  misc_feature (108)..(108): n is a, c, t, g, unknown, or other
  misc_feature (120)..(120): n is a, c, t, g, unknown, or other
  misc_feature (146)..(146): n is a, c, t, g, unknown, or other
  misc_feature (152)..(152): n is a, c, t, g, unknown, or other
  misc_feature (157)..(157): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (787)..(787): n is a, c, t, g, unknown, or other
gggcagggcgnngggggacaaacaannngnttgggggnttttgggnttnnnacaaactggagctccccgcgggggcggccgnctatttcgagccagatttcccgggcngcaggatctcanaacaccccttgaaaaagacaccggcnaacccnagcgncggnnnggctgttgccccccgggaggcggctgctttggtgcgctgcgcagtgcgctccggggggggggcgaccggaaggccgtcccctggcccctgctcgacgacaacctcgggggctcgacttcctccgaacgcgcgcgggccgccgaccagctcgaactcctgcaggagcgcgcccggcgggcaggcgacgcagaccaacggccggtttttttataaagcgagcggaggggggagccccgaccacttttttttttttgaccccccgcgcgggggggggccatctaacgggcgaacgaaaaccccccggggggaagggaggaagaaacggccgtgggggggcgaggctgaccgctagaccggccccgcgggaggggtagaaagcctcgaatgggggggtcggccccgccgcgatccccatcccgccccagaggagcgcgaaccggaaaggaaatgcgcggaacgggcgagcccggcgacgaacgcggaggacgggaaaagacctaaagggctgccgcggggcccgggcgcaaaaagaaacggcgcccgcgcgacaagtactcgccgagggcccgcgcggtgatgaacccagcccggacgggacagacgcggagcgcccgaccccccccn

SEQ ID NO: 67918 - DNA, 700 bp, Zea mays
  misc_feature: Ceres CLONE 1543123
  misc_feature: Encodes the peptide sequence at SEQ ID NO. 67919
  misc_feature (535)..(535): n is a, c, t, g, unknown, or other
ggagctccccgcggtggcggccgctctagaactagtggatcccccgggctgcaggaattcgtctcacccctagaaaaaatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacggggtaatcatgctaacgagaggacaggtgggcttcgcagcagcggtggttatgggtggtgncggctatgtgggtggttgtggtggctaaggggtggcggggggcaatggggggggcttatgggggtgggaaacggggggcaaatggcgggcggcggccatggttaactttgggtggcccgcaccggggggaataggtgggacaaatcccggggaaaaggggtgggg

SEQ ID NO: 67919 - protein, 157 aa, Zea mays
  misc_feature: Ceres CLONE 1543123
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (123)..(123): Xaa is any aa, unknown, or other
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRGNHANERTGGLRSSGGYGWXRLCGWLWWLRGGGGQWGGLMGVGNGGQMAGGGHG

SEQ ID NO: 67920 - DNA, 805 bp, Zea mays
  misc_feature: Ceres CLONE 1543126
  misc_feature: Encodes the peptide sequence at SEQ ID NO. 67921
cagcgatcgtcgccgctcatcgccgaacccgttgcacctcacctatgtgttcataaaaactggactccaccgcggtggcggccgctcttaactagtggatcccccgggctgcaggaattcgtctcacccctagaaaaaaagcctgtgtttcagagacaactcaggcgacgcgatggcgatggcggcgctgcgacgcgaggggaggcgcctcctcctcgcccccaccgtccccaacccgtcttcggcggccgcttccgctgcggtgacgccatcctccgccatgtctcaaccggagatggctccacttggtgcacgttctatttcacccccagttgtgaggaaccggatgaagagtatccaaaacatcccgcaccatcacaaatgctatcacgatggttgcagcatcaaagcttcgggctgtttaaacaaggactgaaaattcaacaccggcttgttggcagcctacccaccccccccttccttgggtgacacctcctatcggttgaccccccaacaaaaaatgatgatttgtcgccccgctatccctctgtataaagggaactctgtcgggggggcttccactttcctttctccggctcgacaccgttctaatgggcccctttcattaaaattgaaccccctgggccccccacacaatatatccccacgtactgcttaatttatcatgagacaaaattgccaaattcctcagcctttttccgctctgcaccctaaagaatacagtcccttcaccaccgccctgtccagcgaaccctccacttatatcccccttatcttacccctc

SEQ ID NO: 67921 - protein, 87 aa, Zea mays
  misc_feature: Ceres CLONE 1543126
MAMAALRREGRRLLLAPTVPNPSSAAASAAVTPSSAMSQPEMAPLGARSISPPVVRNRMKSIQNIPHHHKCYHDGCSIKASGCLNKD

SEQ ID NO: 67922 - DNA, 666 bp, Zea mays
  misc_feature: Ceres CLONE 1543135
  misc_feature: Encodes the peptide sequence at SEQ ID NO. 67923
  misc_feature (416)..(416): n is a, c, t, g, unknown, or other
  misc_feature (491)..(491): n is a, c, t, g, unknown, or other
  misc_feature (666)..(666): n is a, c, t, g, unknown, or other
ctccccgcggtggcggccgctctagaactagtggatcccccgggctgcaggaattcgtctcacccctagaaaaaaagccgaagacgcgaccgacccaggcaggcaccactccgctcaacgcaccgggcggcacccaaatcccaaaccctagcacacgcaccatggcggcgcagcagaagatccggtggggggagctggaggaggacgatggcggggacctcgatttcctcctcccgccccgcgtcgtggtcggacccgacgagaacggcctcaagaaggtcatcgagtaccgcttcgacgacgacggcaacaaggtccgggtcacgaccaccacccgcgtccgcaaactcgctcgggcgcgcctctcccgcagcgccatcgagcgccgccagtggcctaagtttggggacgccctncaggaggacgcgggctccaggctcaccatggtctccacccgagagatccctctcgagcgcccccgcgccccaggnagctaagctgaggagtcagctgcatctggtgatccgctggctatgacgagcaagggaggtgctgttctcatgatttgcaaaactgttggaaggaagggcaatcactgaccttcaaatgtcgttcaaagacctggcaccacgactgaaacttcccggacgggctccacgtccaagn

SEQ ID NO: 67923 - protein, 111 aa, Zea mays
  misc_feature: Ceres CLONE 1543135
MAAQQKIRWGELEEDDGGDLDFLLPPRVVVGPDENGLKKVIEYRFDDDGNKVRVTTTTRVRKLARARLSRSAIERRQWPKFGDALQEDAGSRLTMVSTREIPLERPRAPGS

SEQ ID NO: 67924 - DNA, 466 bp, Zea mays
  misc_feature: Ceres CLONE 1543138
  misc_feature (115)..(115): n is a, c, t, g, unknown, or other
  misc_feature (217)..(217): n is a, c, t, g, unknown, or other
tctgaatagtggtcccccgggctgaggaattcgtctcacccctagaaaaactcctgtcgctcgctctccctgtctcccgcacgccgacccgcagccgccgccgttcgccatgggnttttcctcgacgcgctctacgtgtgtgatgcgcgcacgcgtctacgtacctcgtctcgcggcgcttcgcggcgagcgggcgtgactacgcgtcacagatctngagatgaacacctcggaaaagtcgagactatccgttttgggccaggcacctgaagatgatattttggcccccttttgcttcgtttaacgtttcttttgccccgtattaacgatgttaactttccggccccatgaaccccttttcttttaagaaaaaaaaaaaaaaaaacggaacccccgggggcccccattcccccccttagggggcgtttttccccccccctccttgcgggggctttttttttaaaac

SEQ ID NO: 67925 - DNA, 764 bp, Zea mays
  misc_feature: Ceres CLONE 1543140
  misc_feature: Encodes the peptide sequence at SEQ ID NO. 67926
aacaacttcccacacatacaaaaaaacacacatatacccctcaccacacaccaaaaaaactggaactccccgcggtggcggccgctctacactagtggatcccccgggctgcaggaattcgtctcacccctagaaaaagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcaagagccgggacacagcggccgcctacctgttcagcgccgcgctcccgccggggcgtcaatcaaccaccacgtgacggtgggagctggaagagggcaacgtgcttggtcatccccggccaacagcagcgtgttgcccgccagaagcgccaacgaccggtgccacccacttcgaggcgcaagccccgccaacctttccctctccagggtcccccctgccccgaagaacccccgccccctcaacagaagtcaggggccccccctgggaacccccgccaaggacccccccctcccccatgtccccaaggttcgtggggcccgctttcctcccccccctatgttgtacccacaaaaaacccccccccc

SEQ ID NO: 67926 - protein, 69 aa, Zea mays
  misc_feature: Ceres CLONE 1543140
MSLVRLLDTLALDSWVRNPFTIFGTAVAADAWLASDTSAFANTHIKSRDTAAAYLFSAALPPGRQSTTT

SEQ ID NO: 67927 - DNA, 717 bp, Zea mays
  misc_feature: Ceres CLONE 1543145
  misc_feature (9)..(9): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ctttttttnccacccccaaaaggagagccgcctgnnnnnnnnataannnnnnnnttttggagttcccgcggtggcggccgctcttttactagtggatcccccgggctgcaggattcgtctcacccctagaaaaatcatcgtcctcaccagggtaagacgtgcccctcctccctccccttgtcacagcccccgtagaccatggaagatgcatggcttgagcatctgcatgggttcttgagagtaaagctgcacgacgatggatagtggaacagagcttctcaagaggcttcgttttccggggtgcctttcctgacctccttggggggccagctgagggggccccaaaacgggcaaattccaaatacggggaattgggcggattttcccctttggggggtcccccccctttttaatttttttttacccccctttttttaacatttaaaaaaggtggggggggttttttcgccccccgggggggaaaatctctttaaaaaaaaaaaccccccccccccccaaagaattttctcggtggggggagcgagagaaaattataacccccccccacctttggggggagagaaacaaagtgttttgtgttcccccggggggggggccccccccagactcccccaaaagaaaaacaaagcgcggtcgtaaaaaataaaaaatattggttggtgttttttccccccaaaaaaaaaaaaaaaaaaaaaa

SEQ ID NO: 67928 - DNA, 498 bp, Zea mays
  misc_feature: Ceres CLONE 1543146
ccgcggtggcggccgctctttactagtggatcccccgggctgcaggaattcgtctcacccctagaaaaattatagcatgatgatttgggagcatgttctggtcttctatggattgttctacgcttcagaactgcatcgactatgttttttggtgctattttcgttcgtttatgccctatcatcgcaaatcaaacaaataactataccctcaactccccattcgcccttacggagtcgttttaccccccccctggacctcttttaccactcctgacgggaaaaacccggctttacccattttttgcctggggaaatcccccttttttaaatggggtaaaccgaaaagccccccctttcccccttttcccctttgccccccccccctgggaaggaaattttaaacctaaaatttttgtaaaattccccttttttttttttttacccccccttttttttttccaaagggcggaaaaccgaaaattccccttttaaaaaaaa

SEQ ID NO: 67929 - DNA, 840 bp, Zea mays
  misc_feature: Ceres CLONE 1543150
  misc_feature: Encodes the peptide sequence at SEQ ID NO. 67930
actagaccccaccctcccaccccctaccccattcacccccccccaaatccaaaaacccaaacccaccaccgtggcggccgctctatatcagtggatcccccgggctgcaggaattcttctcacccctagaaaagtgtctacattgaagattatgcatcagcgacaagtaacgaccgcccggaaagagagccagaaaaaagggcaggaaatcgccaccgcccgcccctatttgagcagccgcttgttccttccgcgtcctcgctgctcctcaattcgattggctccgtgccgacctccaggttgagaaggaaagcatcccgagttcgccatacggatgggttccaaagcgcctttctgtctcacgctcctcttgctgctcactgcggcctgtggacctgcagcacatgcccacgatggtggtgtaaggtcccgcatcatggctttcgcccttgatagaaataaaagttggggcccccccaattacttgatccgtcctcaagaagtggtagccggacctattgctccggcctgtcgaaaaacctttcccccaaccgtaaaaaaccgcccactttattctccgcgccttggggcacctgccataccccggaaccgggcggccatgggaagtatccctttccttgaatgcttttgcctccccaaatccaatccccctccttttaaaacaacaaaatgtccctccaagaccctaattgcgcccctctcgctgaaccacccctcccctgttttcgccccgcacacccacgcgtagtctctccacccccccacccgcgtttcttcccaacccgcgtctttgttcctccttgactagcgtccccgccg

SEQ ID NO: 67930 - protein, 144 aa, Zea mays
  misc_feature: Ceres CLONE 1543150
MGSKAPFCLTLLLLLTAACGPAAHAHDGGVRSRIMAFALDRNKSWGPPNYLIRPQEVVAGPIAPACRKTFPPTVKNRPLYSPRLGAPAIPRNRAAMGSIPFLECFCLPKSNPPPFKTTKCPSKTLIAPLSLNHPSPVFAPHTHA

SEQ ID NO: 67931 - DNA, 834 bp, Zea mays
  misc_feature: Ceres CLONE 1543153
aacgaatccattctctacttcctaccacagtcagccttaccacatttatattaccgcggtccaccgggcggcggccgctctttactagtggatcccccgggctgcatgaattcgtctcacccctagaaaatgacggatcgcacggccttcgtgccggcgacgcatcattcaaatttctgccctatcaactttccatggtaggataggggcctaccacggtggtgacgggtgacggagaattatggttcgattcccgagagggagcctgagaaacggctaccacatccaaggaaggcagccggcgcacaaattatccaatcctgacacggggaggtagtgacaatcaataacattaccggggcgcgctcttgtctggtaatcggaatgaccacactctcaattcccttgaggaggattcccttgcagggccagactcggatgccagtcattccccttgataaccccccccccccccccaatccttttgtcctaaccttgttcgtacctcaacaacccaccctattttagcccctctggggcacgggactagagaagggtacggccaccaccggtggagacaccctactattcttttcgaccccactcttgctgtggctgaaatccgttcccctaggtcccacgccacttgggccctgggctcgtttgtccttcccgtcgtcaccagtgttatacggctacacaacactttccccggttctcctcgccgcaaataacctccctccgccctcccgggaatatttatttccgacacgcggccgccgtaatctctgccctaacgccctatcttgtgtccgcttttcgcctaccgccccc

SEQ ID NO: 67932 - DNA, 806 bp, Zea mays
  misc_feature: Ceres CLONE 1543154
  misc_feature: Encodes the peptide sequence at SEQ ID NO. 67933
  misc_feature (37)..(37): n is a, c, t, g, unknown, or other
  misc_feature (38)..(38): n is a, c, t, g, unknown, or other
ccacggtctcccaccccccccccccccctcctaccgnnccccactctcccccaaaaactggagctccccgcggtggcggccgctcttcactagtggatcccccgggctgcaggaattcgtctcacccctagaaaaactgaacaggttaagagcatgtacgcgatgggcaaggtgcggatgacggccgcggagctcaacagcagcgacgccgacggccacggcggaagcaccggatacgggcaccaccgcggcgggaagaaaggcagcaagggagggggcggcggcggcgagatcggcgggttcgtgctgtggcagaagaagccggagctgtggtgcctggagctcgtcgtgtccggctgcaagatcagcgccggcagcgacggcaaagtggcgttggcgccagacgccgttggcaccagtcgcacgcatcccgcgggtcccccgcgcccgcttcggccgttcccctccccggtgcggaagctgaacgcccccggccttccgcgggcggcgccggttttcgtgtaccttttctccaaccttggggccttcgaacccccaacctgacccccaaagccttgtttcgcggaaactccggtgtggataccggccaagaccgaaacacatccaccggccaaaggaactggtttttccgtgcctccagggtgggaaggggggaaaggctttcccaatcctgccgcggcggtgggcaacaaattagcaagggtgtccagaaaatcattcccgggcccacacgggtgggtgggggagtttatttttataaaccacacccggctaggtgggccctg

SEQ ID NO: 67933 - protein, 136 aa, Zea mays
  misc_feature: Ceres CLONE 1543154
  misc_feature (1)..(137): Pfam Name: DUF620 Pfam Description: Protein of unknown function (DUF620)
MYAMGKVRMTAAELNSSDADGHGGSTGYGHHRGGKKGSKGGGGGGEIGGFVLWQKKPELWCLELVVSGCKISAGSDGKVALAPDAVGTSRTHPAGPPRPLRPFPSPVRKLNAPGLPRAAPVFVYLFSNLGAFEPPT

SEQ ID NO: 67934 - DNA, 873 bp, Zea mays
  misc_feature: Ceres CLONE 1543155
  misc_feature (12)..(12): n is a, c, t, g, unknown, or other
gactcggcccanacccatatccattcacaataagtaattcgagatcttttgctaatagcttggactccccgcggcggcggccgctcttacctagtggatcccccgggctgcaggatttcgtctcacccctagaaaaagcatcatattctcacctcgcgaacgaggacgaactgctacccccctcgcctcgccctcgccgcctcctctcccgttcccccaccaaccgcagcagcgagagcgagactgagaatggccgcggcaccgtcgtccctcgtgtcctcccatctctctcgactcgccgatctccaccacgcggcggcgcctgccattctccccgtttctccgccgcattctcatcggctgatcagccctaacgcacccaaacgccgtagttggacaggacaggaatacagaacagttcaaccttcaattgacaaacgcccacacgcgtccccaaaattaaagaaactcctagcctgccaacccccaacccccctgaacctgcacagcggtgcctcccaactaaagagccctgtgtggtcccaaaagcccggcatatatataccccccccttaatttaccccccccccctccatatgattaaccgcgctatataaacacccccccgcacacgccgactcgaaaataaaaacgggtacccctggtccaaaaacacccctacggataattttgtaaaaagagaccgcggagccaaaatacaccaggaagcggcacgccctggaataaaaccatcagttgggatgcgccccacttctctagaccgcacacagagaaacggaaacattgacatcgcccccagaattgaaatagcaccccctccggagggtaccagtgatacgagcctatttaccc

SEQ ID NO: 67935 - DNA, 654 bp, Zea mays
  misc_feature: Ceres CLONE 1543158
  misc_feature: Encodes the peptide sequence at SEQ ID NO. 67936
  misc_feature (634)..(634): n is a, c, t, g, unknown, or other
ctccccgcggtggcggccgctctagaactagtggatcccccgggctgcaggaattcgtctcacccctagaaaaaatcccttcaccgctgcctcgactcgtgccgaaagatacctttcccccccttcctctcgcgccgccgttttggtgcgaccatggcggcggagggggaggccaacaacccgtccggcggtggctaagggggtaacccccaccaccagcaggcagtgcaggctgcgccggccgagccgccaacggcacagggggaagcggtgcatgaggctggagcgcaagcgacaggacaacagccggatggggataaggctaatcgagatggggagggaagcgcgggggagaaggaccaccgcgcgtgcacagatctggttctggttgaggatccggaggtgctcgccgtcgaggacccggaggaagctgcagcaaccgcagcactccaggaagaaatgaaagcgctcgtggcatccgtccctgacggtgctggggcagcattcacagccatgcaggttcaggagctagagcatcagtcccgggtttatcactacatggctgcccgagtacctgtgcctactcagctcgtcttccacgtatggcagagtgtaacctgtgcatcctctgaangtgcccagaagtactctact

SEQ ID NO: 67936 - protein, 65 aa, Zea mays
  misc_feature: Ceres CLONE 1543158
  misc_feature (14)..(50): Pfam Name: QLQ Pfam Description: QLQ
  misc_feature (59)..(59): Xaa is any aa, unknown, or other
MKALVASVPDGAGAAFTAMQVQELEHQSRVYHYMAARVPVPTQLVFHVWQSVTCASSEXAQKYST

SEQ ID NO: 67937 - DNA, 847 bp, Zea mays
  misc_feature: Ceres CLONE 1543159
  misc_feature: SWISSPROT Homolog: EC 2.1.1.68 Caffeate O-methyltransferase
  misc_feature (36)..(36): n is a, c, t, g, unknown, or other
  misc_feature (481)..(481): n is a, c, t, g, unknown, or other
  misc_feature (482)..(482): n is a, c, t, g, unknown, or other
  misc_feature (487)..(487): n is a, c, t, g, unknown, or other
  misc_feature (490)..(490): n is a, c, t, g, unknown, or other
aatgcttcacccaacaaaaaccacaaaacccaaaanaaaaacaaaaacaaaaaaatcaaaatacaacaaagaggcggccgctctattctaatggatcccccgggctgaaagaattcgtctcacccctaaaaaaaaaaaaaaagtcgcatcgcacgccatcaccaactagtgcgctcctcgagcccaccacacaaaggccggcagcgctaatcgtaatagccatgggctccaccgccggcaacgtgcccacagtggtggactaggaggcgtgcatgtacgtaatgccattggcatcgtcctcatcctgcccgtgacctgaaaaccccatctagctgggcctgctccaagtgctgcaaaacgaagcccgggcaccacaacgacggcgttagaatctcaacaaagttgtggcaggggatggtgtgggtgaaacaaaagaacccagcacggtggtcttgtgtttttggtacccccccccctcccnnaaaanaanaataggatttgttataaaattaaataatttattcctcctataagaccgaactcggggaacaaaccttgtgtccgaaacttatcctccctaaccccagtttaattgaccaggttttgaacaacgggcggcacccccccactaattaaagtacggaatcccgttgtctgtggctctgtctccttcgctctttctttgataaactatgtatcaatagggaaattatctgacgaacacgcgggtactaattcctaataaagaatacgatattctagaacgggggcgctattttcggttaaaatgaggccctatattatattatgggttctacgagtttccacgcgtgacgtccccatagcg

SEQ ID NO: 67938 - DNA, 690 bp, Zea mays
  misc_feature: Ceres CLONE 1543167
  misc_feature (275)..(275): n is a, c, t, g, unknown, or other
ggcggcgctctgaatagtgatccccgggctgaggaatcgtctcaccctagaaaagtcgcttgtcgccgatctttttccgagactagctcgcccgctcgactccgaccttctagaacttgccctcgaggtgccgtccatcaccgcccgcctgcgccgcttgctcatcgcttctctccccccggcgggcctcccagatcccggttgggatcgagggggcaaggtcaacgagatgggggcaggccctttcccgaaagctcgtttgatgcctttcttcngcaaacaaagagatgccgggtggtgatgctttgcgttcggatgcagcttgggaaaaacatccatactgctataagctttcacatttggtagaagttcttctcccactgtcccctaaccatacccccccacatgttgaagacaggttccattacaaggaatgtagttgttcaaccgtgtgggcatggttggtggcccagtaaaaacctcatgccccttggtggaggcactaccttcaacacccctgatgcctttgatttacatggttgattcccctgaaaaaaagaagaattctggaaaacccaggcgggagtttcagggcaatatcaatgccccttttaagccttacagtgtggtatttggggtttcctaacaagcaaaacttgaggggaggcattgccctccatgaaagtgttg

SEQ ID NO: 67939 - DNA, 716 bp, Zea mays
  misc_feature: Ceres CLONE 1543170
  misc_feature: Encodes the peptide sequence at SEQ ID NO. 67940
  misc_feature (716)..(716): n is a, c, t, g, unknown, or other
gcggtggcggccgctctattacagtggatcccccgggctgcaggaattcgtctcacccctagaaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccgggatgggctctttggacggctcggaggtacccgaatacctcaccgggagagggtcccccccccccaatggctaccaacctttttgggccggggcaaaaagcccaaaaggaattccccaaagaaccagggtaaaaaaaacttaatctattccccaataggggcctagctccggggccccctgggctctttccattcccaaaaggtttgaaaaaaggtttgggggccaaactgggggccccccagaggccctttgggttaaaaaaaaggggcccccttttctctgggaagggaacacccccccccctattttttgagaaaaaagactcccccataaaaaccgggtggggccccatgacaaccgagggacggcccn

SEQ ID NO: 67940 - protein, 118 aa, Zea mays
  misc_feature: Ceres CLONE 1543170
MAALAPSKILGTKLNFAGSSRYATAAPTAGAQKIVSLFSKKPAQKPKPSAVSSSSPDISDELAKWYGPDRRIYLPGWALWTARRYPNTSPGEGPPPPMATNLFGPGQKAQKEFPKEPG

SEQ ID NO: 67941 - DNA, 794 bp, Zea mays
  misc_feature: Ceres CLONE 1543172
  misc_feature: SWISSPROT Homolog: EC 1.1.1.195 Cinnamyl-alcohol dehydrogenase
  misc_feature (464)..(464): n is a, c, t, g, unknown, or other
aaatgtcgacccaacacaacacaataacccccccaccaccccaaacaaaaaaaacaaccattcaacgcggtggcggccgctctatactagtggatcccccgggctgcaggaattcgtctcacccctagaaaagtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctcccctacagcttctccagaagggttcctaaagacgacgatgtcacgatcaaggtgctctactgcgggatctgccacaccgacctgcacgtcatcaagaacgactggcggaaacgccatgtacccagtcgtcccggggcacaagattctgcgcgtggtgacccggagttaaggggcgggncctgcccccttcaaggaccggcaacacggtcaggcgtgggctacttcctgggggtcctggccgatccttgcgaaaatttgccgccccgggggaacaaaaaattactggccccggggaacctgatttaacttccaaccgcctttcaacacccccacccggggggccccccccacccccgggggggggatttttcccaaagacccctgttatcacaggccaaaaccctccccttggcccccccgtccccccaaaaggccatgtgctcgtgggaccccaaatcgtgacacgtcagtctcttccgatgggggggtaaaccgtgagacagacccc

SEQ ID NO: 67942 - DNA, 679 bp, Zea mays
  misc_feature: Ceres CLONE 1543176
  misc_feature: Encodes the peptide sequence at SEQ ID NO. 67943
  misc_feature (393)..(393): n is a, c, t, g, unknown, or other
  misc_feature (483)..(483): n is a, c, t, g, unknown, or other
ctccccgcggtggcggccgctctagactagtggatcccccgggctgcaggaattcgtctcacccctagaaaaactcagcggtccgtgttcttgatcgattaagctgtcctcaaccatcatggctgccattatggcggcaggtctggtagtactggcactcctcgctgccgtcgccgctccggcgcacgccacggactacgtggtgggcgactcggccgggtgggccagcggcgtggactacgccacctgggcgagcggcaaaaccttcgctgctggggacaacctagtgttccagtacagcgcgatgcacacggtggcggaggtgagctccgcggactacagcgcctgctcggccagcaactccatccagtcctacagcgaccagaacaccanggtcgcgcttacggcgcccggcacgcgctacttcatctgcgggcgccccgggtcactgcggcaacggcatgaagctcaccgtaccgttgncgcccgcggccgccaccacaccccggaaaagttcaattttacccccgccgaaacaacaaaccccaccaggaacaaagttaacccgcccaaaggttaaacgccttccggaaaagtccacttttacccccggccgaaaaaaacccccccccccaaaacaaatccacgttccctctgaaacaatagaaaaatgggggtg

SEQ ID NO: 67943 - protein, 153 aa, Zea mays
  misc_feature: Ceres CLONE 1543176
  misc_feature (35)..(110): Pfam Name: Cu_bind_like Pfam Description: Plastocyanin-like domain
  misc_feature (92)..(92): Xaa is any aa, unknown, or other
  misc_feature (122)..(122): Xaa is any aa, unknown, or other
MAAIMAAGLVVLALLAAVAAPAHATDYVVGDSAGWASGVDYATWASGKTFAAGDNLVFQYSAMHTVAEVSSADYSACSASNSIQSYSDQNTXVALTAPGTRYFICGRPGSLRQRHEAHRTVXARGRHHTPEKFNFTPAETTNPTRNKVNPPKG

SEQ ID NO: 67944 - DNA, 767 bp, Zea mays
  misc_feature: Ceres CLONE 1543177
gaagctgccacacccctcccctcgaaccctacacccaacccccccccccaaaaaaactacactccacccggtggcggccgctctatactagtggatcccccgggctgcaggaattcgtctcacccctagaaaaagtagcaggcgcctggtttccggtttccctgcagtgaaggaagaggaagcccaaccccaaggacagcagcgtacaatcaggctgatgcttgttggaactcagctgttgatgcttgtaagcctcgctgcctggctgcgtcctgtgctgtagatacgagatcccgcagcgttcgtttgttgcacttgcaccggcttgctgctagcttgcgacaggactaggaggagctagccgaggaggaggtgtgtgactccatggacgcgggcccgcaggatgcgtgggactggtattgggaggtcctgcttttagaccacatgagttcatcttttgtccccccttgtgccagcaacaacataattccccttgacgatccacaagaagccgaggatctccaccctgctgcatgccttcccccggaaggggacgaacttcttttgactccctaccaattaccagtgccaaggacattcggagttctttgctctgacaaactaagccccaagaagatcccttcctcccgttcccgcccttagcgacttccccccccgggcgatctcgaccaaatggacccctcctccccaaaaggcgccccccccgtcaagcccaaagggagccccgtttccccgcaaaccccctg

SEQ ID NO: 67945 - DNA, 664 bp, Zea mays
  misc_feature: Ceres CLONE 1543178
  misc_feature: Translation starting site: 127
  misc_feature: SWISSPROT Homolog: EC 1.15.1.1 Superoxide dismutase
ggcggccgatctagaactagtggatcccccgggctgcaggaattcgtctcacccctagaaaaaaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtcaccccggccttcgtgggccagttccccgggcgtcaacgggcttggcatcacccccgccaggctcgacatcgaagtgggcggcgttcctgccgctgcacacccaccccgcgggctccgagctccctcttctgaaccagggcaaccgtcgccggcggctttcttcagctccggcttcaaaaccgtccacacccaagaaccctgtaccccccgcgaaaatcatggggtttcccgcaagggcccggttccacttaccagtacaaacaccgggcacccgggacttcccctgggggccttcttcgcccttcaaaaaaccctataaccccgg

SEQ ID NO: 67946 - DNA, 671 bp, Zea mays
  misc_feature: Ceres CLONE 1543184
  misc_feature: Translation starting site: 285
  misc_feature: SWISSPROT Homolog: EC 2.3.1.51 1-acylglycerol-3-phosphate O-acyltransferase
tcttacctagtggatccccgggctgcaggaattcgtctcacccctagaaaaatccgctacactccacctcctccctctcgtcccagtcccagcggccagcgctcatccatccacccccatcctataataaaacctccgaatgcgcctcgcgtgccccgtcctcctcgtcgccggcggagccgcctactatcgcctggagaaggagcgccgcggggagcttttcccactgccgactgccgtctgaccctccgagatcgggaagcggcgccggcgcccggccggcgatggcgatcccgctcgtgctcgtcgtgctcccgctcggcctgctcttcctcctgtccggcctcatcgtcaacgccatccaggccgtccctattccccaccataagggcctttttcgaagagcttctaccgtcggatcaacagattcttggcccgagctgctgtggcttcagcttgtctgggtggtggactggtggggcaggtgttaaagtacaactgcatgccgatgaggaaacttacagatcaatggggtaagagcatgcactcatcatatcaaatcatcggagtgatattgattggctctttggatgggatatggggcccagcgttcagggtgcccttggaagtacacttgttgtcatgaagaaatcatcccaagtccctccccg

SEQ ID NO: 67947 - DNA, 659 bp, Zea mays
  misc_feature: Ceres CLONE 1543187
  misc_feature: Encodes the peptide sequence at SEQ ID NO. 67948
ctcaccgcggtggcggccgctctagaactagtggatcccccgggctgcaggaattcgtctcacccctagaaaaaatttccaagctttctcgagatcaaatcagaaaggggaagggaagaacggcccagcaatgcggctctgcagcttctacgcctccagctccgttcccgtcgtcaagccccagcagtccgtcgcctcgtccaagccccccaccacggtggtggcctccgtggcgacaactgtgccgatgcgcagagcagcgacggtgacaccagccgtggccacaaaaacgagactagcgatgtctctgcacctgccggagctgccgtctcaggtgaaggacaagatcctgagcctggagctgatgggcgtggactatgggagcgcgctggagcagaacccggcgctccgcaacacgacgccggagtccatccacgcggtggtgtcgttcctccagtcccgcgggcatccagttcaaggacctgggccgcgtcttcggcatgtgccagtcagtgctgaccgtcagcgtccgcgccgacctccgccccgtgatcgacttcctctacgcggacctgggcgtgccggagtccgcgcaccagctcgaggtgatcaagtgcccgcgcgtgcaggacagcagcgtccgcaaccagctccgcctc

SEQ ID NO: 67948 - protein, 53 aa, Zea mays
  misc_feature: Ceres CLONE 1543187
MCQSVLTVSVRADLRPVIDFLYADLGVPESAHQLEVIKCPRVQDSSVRNQLRL

SEQ ID NO: 67949 - DNA, 665 bp, Zea mays
  misc_feature: Ceres CLONE 1543191
  misc_feature: Encodes the peptide sequence at SEQ ID NO. 67950
  misc_feature (263)..(263): n is a, c, t, g, unknown, or other
  misc_feature (264)..(264): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (635)..(635): n is a, c, t, g, unknown, or other
ctccccgcggtggcggccgctctagaactagtggatcccccgggctgcaggaattcgtctcacccctagaaaaaactaccttccccatccctacccatcatcaccctcaccagtcaccactcgccaccctcgcccgcccccatggtctcgctcgctggctcccagatcccctcgccttcgccggggggcagaaagccccctggccgccggggccggcgccgccccgcagcgccgccatgggaaaacttccaatgcagcacatnncgctcggcttctgctgcagccgggactccctcccccgggggtccccccgtccccccccccccaaattgggcgggcccccccaaaaccccgggggcggaaactccgggaaaaaaattttgggaaaaaaaccctccccaccccgggaaaatccccccgggttttattattcggaaaaatttttttccccccccccctcccccccgaagagttttgggcggggggccaaaaggggggggggggggggccccccccggggaaaaaaaccccccccgggggggggggggcccccccctcccccccccccaaaaagaaccccccccttctttttctcgcccgcccaaaaatattaaannnnnnaaannnnnnncccnccaggcccagcctgcacccagggaaaattt

SEQ ID NO: 67950 - protein, 174 aa, Zea mays
  misc_feature: Ceres CLONE 1543191
  misc_feature (41)..(41): Xaa is any aa, unknown, or other
  misc_feature (159)..(159): Xaa is any aa, unknown, or other
  misc_feature (160)..(160): Xaa is any aa, unknown, or other
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
MVSLAGSQIPSPSPGGRKPPGRRGRRRPAAPPWENFQCSTXRSASAAAGTPSPGGPPVPPPPNWAGPPKTPGAETPGKKFWEKNPPHPGKIPPGFIIRKNFFPPPPPPRRVLGGGPKGGGGGAPPGEKNPPRGGGGPPLPPPQKEPPPSFSRPPKNIKXXKXXXXQAQPAPREN

SEQ ID NO: 67951 - DNA, 601 bp, Zea mays
  misc_feature: Ceres CLONE 1543204
  misc_feature: Translation starting site: 73
  misc_feature (407)..(407): n is a, c, t, g, unknown, or other
  misc_feature (577)..(577): n is a, c, t, g, unknown, or other
gcgctctagaactagtggatcccccgggctgcaggaattcgtctcacccctagaaaaagtctgtaaccttgcatgatgatggcaaagtcgagctatgggacttgtcaagcaatttcttcctctcagagaaggatattgggcaaaaccgtgctcaagcttgtgttccaaagctacaggagcttaacaatgctgtcatcatctctaccataactggtgatttaaccaaggagcagctttctaactttcaggctgtggtcttcactgatatcagcatagaaaaagcagttgagtttgatgattactgtcatagccaccagccaccaattgctttcattaagtcagaagtttgtggccttttttggcagtgttttctgtgaatttgggtcctgcgtttactgttttggatngttgatggggagggaccacatacagggattgtggcatcaatcagccatgaccatccagcacttattttcttgtggtgattgatgaccgtcctgagttccaaggatggggaacccaattggtttcccccgaaaggcttggaaaggccccaactttattgttggaaaaccangaaagatttagaaaggcagaaccc

SEQ ID NO: 67952 - DNA, 655 bp, Zea mays
  misc_feature: Ceres CLONE 1543208
  misc_feature: Encodes the peptide sequence at SEQ ID NO. 67953
  misc_feature (414)..(414): n is a, c, t, g, unknown, or other
gcggtggcggccgctctagaactagtggatcccccgggctgcaggaattcgtctcacccctagaaaaaattttttacggacaccagcaagccacgccacactcccaatcgccgccgcagctggtcccctgctcggctcgtctgatccagcggctgaatccgcaggccatggggttcgacaaggaggcgagctcctcctcctcgcggctcgacgcggcgccgctgctcccgcagcacggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctgnctcgtcgccgcgccgccgccggatcgcggacgcgcaccccaagatcgccctccttcggggacctgggccacgccatctacggcgcgcccggtcgccacgcggtcgacgccatgctcgtgctcaccaggccagcttctgcgtcggctacctgatcttcatctccaacaccatggcgcacctctaccccatcgccatcggggcccaattcccccggcgtcgccgctcctcacggccaaggcgc

SEQ ID NO: 67953 - protein, 132 aa, Zea mays
  misc_feature: Ceres CLONE 1543208
  misc_feature (83)..(83): Xaa is any aa, unknown, or other
MGFDKEASSSSSRLDAAPLLPQHGGGAGGHLSSQPKTFANVFIAVVGSGVLGLPYTFSRTGWAAGTLLLLAVAALTFHCMMLXRRRAAAGSRTRTPRSPSFGDLGHAIYGAPGRHAVDAMLVLTRPASASAT

SEQ ID NO: 67954 - DNA, 641 bp, Zea mays
  misc_feature: Ceres CLONE 1543209
  misc_feature: Encodes the peptide sequence at SEQ ID NO. 67955
  misc_feature (382)..(382): n is a, c, t, g, unknown, or other
  misc_feature (535)..(535): n is a, c, t, g, unknown, or other
ttccgcggtggggcgggctctctagatcgtgtgtacccccggctgcgcgagttcgtctcacccctagaaaactcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcggcccagcatacccctcatcgaggaaggaggagggactcacgacacnacgtcgtcgtcaagtgcggcgagatccagacccgcatctctgaaggactacatcttccctttcactgagtaacagtatggtgggattattcatgggcatctttgcaatccttaaatcctcttcccctgggggctgtccaagggattccccccnaaaaagtccacccttggcccctttttccagggaaccgacttgccaagccctgccctttggtaaaggcaaccttcagaacaaaaacccttttggggcttgggggcaa

SEQ ID NO: 67955 - protein, 81 aa, Zea mays
  misc_feature: Ceres CLONE 1543209
  misc_feature: SWISSPROT Homolog: EC 3.6.1.1 Inorganic diphosphatase
  misc_feature (68)..(68): Xaa is any aa, unknown, or other
MAAAAILPELATQVLIPVAAAVGIAFAVVQWVLVSKVRVTPERRADGGAVKSGPAYPSSRKEEGLTTXRRRQVRRDPDPHL

SEQ ID NO: 67956 - DNA, 664 bp, Zea mays
  misc_feature: Ceres CLONE 1543212
  misc_feature: Translation starting site: 396
  misc_feature: SWISSPROT Homolog: EC 3.2.1.23 Beta-galactosidase
tggagctccccgcggtggcggccgctctagaactagtggatcccccgggctgcaggaattcgtctcacccctagaaaattttattgggatttacgagtcttgggccatttacttctcttcttatgaaagtccactcataaatcacaaatccaattttatctgacgggaataagggcggaccgtattgagagccaacgagacgctcgaggtccccacttccccctatagtgagtcgtattacgcgcgctcactggccgtcgttttacagcgtcgtgactgggaaaaccctggcgttacccaacttaatcgccttgcagcacatccccctttcgccagctggcgtaataccgaataggcccgcaccgatcacccttcccaacatttgcgcaccctgaatggccaatggaaattggaagcgtgaatattttgttaaaattcgcgttaaatttttgttaaatcagctcatttttttaaccaataggccgaaatcggcaaagtcccttataaatcaaacgaatataccgagatagggttgagtgttgttccagttaggaacaagactccactattaaagaacgtggactccaacgtcaaagggtgaaaaaccgtctgtcaaggcgatggcccactaggtgaaccatcaccctaatcaagttttttgggg

SEQ ID NO: 67957 - DNA, 676 bp, Zea mays
  misc_feature: Ceres CLONE 1543230
  misc_feature: Encodes the peptide sequence at SEQ ID NO. 67958
ggagctccccgcggtggcggccgctctagaactagtggatcccccgggctgcaggaattcgtctcacccctagaaaaatgccagcaactttgtggtcggaaagtgagggggtggatgggctgtcgccctgcaggcctacggctgcggagatgctacgtgttgcggatgctcgtgagcacgcactggttccggtttgtatcgcatgatgtacaattacttcccgtagcatgattctggccggaaggaagaattgttgtgttctggccagtttctctcacgagacgctcgaggtccccacttccccctatcgtgagtcgtattacacgggctcactggacgccgtttcactgcgccgtgactgggaaaaccctgacgtgacccaccttaatggccttgaagtatatcgccctttcgccagttggcgtattagcgaataggcccgcaccgatcacgcttcccaacagttgcgcttgcctgcatggccgaatgcaaattgtgcgcagtgaatattgtgatcaaattcacgttagatttatgctacatcagttcattgttatttacccatcatgctgtaaaacggctaagtccgctttttggatcaaatcccattatacagtaaaatagggttgacctgttgttccccttgtgggaatcaagactcctctgataaaaagag

SEQ ID NO: 67958 - protein, 69 aa, Zea mays
  misc_feature: Ceres CLONE 1543230
  misc_feature: SWISSPROT Homolog: EC 3.2.1.23 Beta-galactosidase
MILAGRKNCCVLASFSHETLEVPTSPYRESYYTGSLDAVSLRRDWENPDVTHLNGLEVYRPFASWRISE

SEQ ID NO: 67959 - DNA, 587 bp, Zea mays
  misc_feature: Ceres CLONE 1543234
agtggatcccccgggctgcaggaattcgtctcacccctagaaaaaaagcccttgcctctccctactccaaaccctcgccgactcagatccagcttcctcgcaccgccgtcgccatgccgttcactccaggcccctactctggcgtcagcaccctcgcccttgtggcgagggcgtcggcctttggtgtcgggtgtcgtctacgggagcatcaagctctccatcctcaaaggcacaaaaaccttaaaagggaggaaagggcccttgaatccatttccccttttggggagaaagggggtggccaaattttatttccccatatgggagggggtttttaaaatggggggggccccccctatatcaagaggggaaatttttgtttaaaaaaattttggggaaacgtttcttagaaaaaccgcccggtggctttttttttgttggggtgaaacaaaatatctctttgtatagaacgttagtttttttactttttcaaaacattattgggggcggggggtcacactaccgcccgcttacaatctattcgttttgcctgggggccactcttatgtgtgctactgctatggtatatg

SEQ ID NO: 67960 - DNA, 656 bp, Zea mays
  misc_feature: Ceres CLONE 1543243
  misc_feature: Translation starting site: 187
  misc_feature: Pfam Name: UCR_hinge Pfam Description: Ubiquinol-cytochrome C reductase hinge protein
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (444)..(444): n is a, c, t, g, unknown, or other
gcggtggcggccgctctagaactagtggatcccccgggctgcaggaattcgtctcacccctagaaaaaaaccgcccacttccccaaaacctgccacgcttgaacggctctcaatcccaaccctaacagcaccgtctctcggatctgatctgatctgatcctccaattcgttcgtccacgtctcgccatggaggacgaggaacttgttgatcagaagaaatatcttgaggaacgatgcaagccgcaatgtgtaaaatcactttacgaatatnnnnaaaagaaaatggccgttcagagagttgagatgatgatactggtcacaaacactgcactgggcaatactttgattactggtcatgcatccacaaatgggtagcatccaagctctttaaaaagctcaaatgatttggccaatgtgatgccactttctgacaaaggggaaccncaaatttgcatcccttaccccttttgaaaagtgttgggaccccaaccttttggaaaaaaaaaatcattttttcttttcgccggcgaaaaaaaaaaaaataccccgacccccccggggtccccatttttcccccctaagggggggccctaatattcccgcgcccttccgggggcggtgttttttttcaaaccgcttgggcgggggggaaaaac

SEQ ID NO: 67961 - DNA, 645 bp, Zea mays
  misc_feature: Ceres CLONE 1543246
tcaccgcggtggcggccgctctagaactagtggatcccccgggctgcaggaattcgtctcacccctagaaaatctgccgtcaggcgcgcacctccgtcgccatcaccttcggcaccgtcctctgtttcatcctcctgtccctcatctcctcgtaccgccttttcagcgcctacgaggcgcccccgtcgtcggcgctcggcagcaagggcgtcgagatcgccgcctacccgcgctgaagccgctggagggaggcctcgttgcaaatctctgttatgcgtagtcgatcatgtaataatggcttatcgcatatatacttcgttgatagtttgctgtcacatatgattagtacagtgctgctgctgctgctgctaaattgtgcttgactgggtatttatatagtttgcatcgttcttgtgtgtcttggatggatgagcttaaaatcttataaaatttctactacagactaatttctgtgcgcgaaaaaaaaaaaaaaacgaaacggtccaaggacccaaatcgccccaaaggaggcccatttcccccgccccccctggccgccttttttaaaccctctgaatggggaaaacctgggcgttaccaaaatttattccgttgggaaaaaatccccctttttcccccaggggg

SEQ ID NO: 67962 - DNA, 611 bp, Zea mays
  misc_feature: Ceres CLONE 1543250
  misc_feature: Encodes the peptide sequence at SEQ ID NO. 67963
ggatcccccgggctgcaggaattcgtctcacccctagaaaaaatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgccttggaatttgtgctatgtttgaacttctgtgaccctgttttaagagtagtaagcctggttataagattgcagttttgtttatcttggttgaaagtgcaattggtgttgagaaatgggtatcccttgctatatttatctataaaaacggcgcatgctcttgaatacttaaaaaaaaaaaaaaaaaaaacgaagaccgctcgaaggttcccccaatttccccccctattagttgaggtc

SEQ ID NO: 67963 - protein, 65 aa, Zea mays; identical to SEQ ID NO: 5504
  misc_feature: Ceres CLONE 1543250
  misc_feature (1)..(65): Pfam Name: Ribosomal_S28e Pfam Description: Ribosomal protein S28e

SEQ ID NO: 67964 - DNA, 617 bp, Zea mays
  misc_feature: Ceres CLONE 1543256
  misc_feature: Encodes the peptide sequence at SEQ ID NO. 67965
tagaactagtggatcccccgggctgcaggaattcgtctcacccctagaaaaaatccacctgacttcgcgcggctcgcctagcctgtgtgccttcagcccatctgccgagcctacccctcggctcgcatatctagggagcttgccctcccaccgggcggtgattcttccgtcccatctcctatgcggacgccggcgatgctccggtgggccgcggcgctcgcggtcctgctcgacctcgccgcgcctgctggcgggttctacctccccggggttgcgccgagcgatttcacgtatggtgatccgcttccactgaaagtgaataagttgacatgtatcaagactctgctcccgcatacctactattctcttccgttctgcgacccagataccatactcgacagtgccgacaatcttggggaggttcttcgtggcggatcgcttgaggactcccccttatgtggttcagatggccagagacccagatgtggccaaaaagtgcgtcccgagccacccatccctgggaaagaaaccccacggagctcccggaagaaatgggagggcacgatttccccatttgaacattggtttcctttggcaacccctcccgcgttagttgt

SEQ ID NO: 67965 - protein, 145 aa, Zea mays
  misc_feature: Ceres CLONE 1543256
MRTPAMLRWAAALAVLLDLAAPAGGFYLPGVAPSDFTYGDPLPLKVNKLTCIKTLLPHTYYSLPFCDPDTILDSADNLGEVLRGGSLEDSPLCGSDGQRPRCGQKVRPEPPIPGKETPRSSRKKWEGTISPFEHWFPLATPPALV

SEQ ID NO: 67966 - DNA, 824 bp, Zea mays
  misc_feature: Ceres CLONE 1543257-R
  misc_feature (1)..(1): n is a, c, t, g, unknown, or other
ncgaattgggtacctcgagcgtctcgtttttttttttttttttagaggagcaacaggagctatatgtccattggaaccaagatggatgcaatgtacacgtacgcacgcacacacgttacaaagtcaccacctgcaggcacctgccggccggcggcgcgatcgaggctgagagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgcctccagcttcagccccgccgtcgccttgcggttcgccgacggcgccagcccgaaccgccccgcgaacagcatcagcgtcgtcgtcgtcaccatgatcaggttggtggcggagccgatgtagtcgcagcggatgccctgcgacgacgacctcttcctgcccaccctcacggacggcagcgctgccaccgcggacctgggcgcggcgtagccccggaggccgtggaaccggggcacggcggcggagagctgggatgccatgtgtggcgcctgcgtcgtcgtcgtcgtacgtcgcagctctgtgccgctgtaccgtcctcagctagcgcggagtggtgtggtactggtctcttttatgtactggtcaaggatgtcaaaagcactacggataagttgctgcgccccactcaggatcagtgcatcacccttccttagctgttttttgctttcccttttacccaaagttttccggggattta

SEQ ID NO: 67967 - DNA, 634 bp, Zea mays
  misc_feature: Ceres CLONE 1543257
  misc_feature: Encodes the peptide sequence at SEQ ID NO. 67968
agctccccgcggtggcggccgctctagaactagtggatcccccgggctgcaggaattcgtctcacccctagaaaaaattcccacactcctagtccttccccccatctccagtcgagtgctctctccagtccccacgcccgatctcgcccccatcccatggacgccgatgagatggacgtcgactccccatcctcggcctcccccgcgcccgcctccggctccctccccaccgtcctctctgagctcgccgccctccaccgccgcgcgtcttcctcctccgtcacctccccgcccttgtccctgccctccatcacattcctctcctccagccccgcagccgtcgcgtccatcttccctcgcctcgccgaggccggcgtccccgcatcctccttgctgcccccgctcgaggcctcgctctccgcgcacccgctccccgcagccgtcgcctacctccgcctcctcctcgccccggcctccccgcttctcaccctcttctccccgcttccattcctctccctcctcctcgtcatccgcaaggccgccaacccccgcaagcgcaagaaccagcgccagaagccagcagcggctccgcgggcggcgccgtcgctgctcccgaaggcgctctccctgctct

SEQ ID NO: 67968 - protein, 159 aa, Zea mays
  misc_feature: Ceres CLONE 1543257
MDADEMDVDSPSSASPAPASGSLPTVLSELAALHRRASSSSVTSPPLSLPSITFLSSSPAAVASIFPRLAEAGVPASSLLPPLEASLSAHPLPAAVAYLRLLLAPASPLLTLFSPLPFLSLLLVIRKAANPRKRKNQRQKPAAAPRAAPSLLPKALSLL

SEQ ID NO: 67969 - DNA, 651 bp, Zea mays
  misc_feature: Ceres CLONE 1543258
  misc_feature: Encodes the peptide sequence at SEQ ID NO. 67970
  misc_feature (434)..(434): n is a, c, t, g, unknown, or other
  misc_feature (475)..(475): n is a, c, t, g, unknown, or other
  misc_feature (490)..(490): n is a, c, t, g, unknown, or other
  misc_feature (498)..(498): n is a, c, t, g, unknown, or other
  misc_feature (514)..(514): n is a, c, t, g, unknown, or other
  misc_feature (615)..(615): n is a, c, t, g, unknown, or other
ggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggancccggaggcgttcgcgcggaacaggggcgctggaggtgatnccacgggcggtgggncgatgctngggtgcgctgggctgncatcaccccggaagtgctgggagaagtggggtggcgcgtggacttcaagggagccccgtgtgggttcaaggccgggcgcgcagatcttttctcggaagggncgggctggactaccctgggcaacccccaaccttggg

SEQ ID NO: 67970 - protein, 104 aa, Zea mays
  misc_feature: Ceres CLONE 1543258
  misc_feature (92)..(92): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWDTAGLSAXPGGVRAEQGRWR

SEQ ID NO: 67971 - DNA, 596 bp, Zea mays
  misc_feature: Ceres CLONE 1543268
  misc_feature: Encodes the peptide sequence at SEQ ID NO. 67972
  misc_feature (355)..(355): n is a, c, t, g, unknown, or other
  misc_feature (396)..(396): n is a, c, t, g, unknown, or other
ctccccgcggtggcggccgctctagaactagtggatcccccgggctgcaggaattcgtctcacccctagaaaaaaagaagagcctccgcctccgctggtactcgagctcttctacactccacgtctcctccagacgctcaccacacaagtccacaactaccaagtcccctaaacacagtcataacttcccagctcacccgcgctagttcgtcgcccgtctcgacatggagtgcgagaacggacacgtcgcccgcagcggcaatggtggcgtctgcctggccacgcccgcgccgcgggctgaccccctgaactgggcaaaggcgcccaaagactgccggggacccactggatgccntcagccgaaggtggaagattacagaagcccctgtgaaaaanaagggggccaacctgaaccttccccaatttccgggccctggccccggcccgggaagccccccggggaaaccaaaaaatccccggggggggcccctttaaggccaaaaacattgtgtgttgtggccccttgttaaaaaagcccccaaccctttggggggtcccacccggggtgtggggccccccccccccggagagaaaaa

SEQ ID NO: 67972 - protein, 101 aa, Zea mays
  misc_feature: Ceres CLONE 1543268
  misc_feature: SWISSPROT Homolog: EC 4.3.1.5 Phenylalanine ammonia-lyase
  misc_feature (44)..(44): Xaa is any aa, unknown, or other
  misc_feature (58)..(58): Xaa is any aa, unknown, or other
MECENGHVARSGNGGVCLATPAPRADPLNWAKAPKDCRGPTGCXQPKVEDYRSPCEKXGGQPEPSPISGPWPRPGKPPGETKKSPGGAPLRPKTLCVVAPC

SEQ ID NO: 67973 - DNA, 662 bp, Zea mays
  misc_feature: Ceres CLONE 1543276
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaaagaagcgaacccagccatcgtttccaagtacgcgcagagagagagagccacaagagttagagcgaaacatcagcgtatggatctaggggctcgagcaagcaagagaggagagatgcctgcgtcaatagatcatgtatgaggaagtgaggacacgagtcatctgaaaagcaagttggtacctagaatctcaagtcccaggtcaagaacaggtaccacaggacgaggcgcttgaaggatgctgtgcgagttcgtgagaggtctaggtcgtcgtctcccagtcaactttgggttgctggaccgttgtctccttataatgtaattacttaattattttgtatagaactcctgttataaagatgtgacattcgatccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgc

SEQ ID NO: 67974 - DNA, 549 bp, Zea mays
  misc_feature: Ceres CLONE 1543290
  misc_feature (276)..(276): n is a, c, t, g, unknown, or other
  misc_feature (277)..(277): n is a, c, t, g, unknown, or other
acccgcggtggcggccgctctagaactagtggatcccccgggctgcaggaattcgtctcacccctagaaaaaaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattctggcagccgtgcgcagaatggccccggtggggaaagggagggggaaaaaaaaggggaaggggcnnccaggcccccacccttaaacctgaaaccttaaaccccccaaggtcccggcctgggtgggggggaaaagttcccccagccgatgggcaagggggggccccccagaaaacctctaaaagagccccggggtgcccgcgcccctttggggggggggccatttttttcccccaaaaaaccggtaacccctgggcccccactgtgggggggggcgccctttcgggggtccccgggggcgcccccccccggtggcccggggagggagggggtctcccca

SEQ ID NO: 67975 - DNA, 545 bp, Zea mays
  misc_feature: Ceres CLONE 1543291
  misc_feature: Encodes the peptide sequence at SEQ ID NO. 67976
  misc_feature (251)..(251): n is a, c, t, g, unknown, or other
tggagctccccgcggtggcggccgctctagaactagtggatcccccgggctgcaggaattcgtctcacccctagaaaaaatgtaaccattcctattttccaacaaaaaaggccgtcatgtgatcagcccactatgaacggaattcatccttggcttccatgaccataggtctgctagaatcattcgtttatgttttctgtaatgtgttcaggccgcaaggattttctaacgcgctgggcagaattgccttngatttttgatctatgaattcgtgctaggtgctctgtggaatgtactggtctgcccttgcctttttttttaaaaaaaaaaaaaaaaaaaaccaaaacctctccaggaccccattcccccaaaggagcctattccgcgccctcacgggcccttgtttttaaaaaacccctggggttggggaaaaaaaacccctgggggggttttcccaccaaaatatatatatccccttttttaaaaaaaaacccccccttttttttcccccaagggggggggggttttttttccgaagaaaacgc

SEQ ID NO: 67976 - protein, 33 aa, Zea mays
  misc_feature: Ceres CLONE 1543291
  misc_feature (31)..(31): Xaa is any aa, unknown, or other
MTIGLLESFVYVFCNVFRPQGFSNALGRIAXDF

SEQ ID NO: 67977 - DNA, 476 bp, Zea mays
  misc_feature: Ceres CLONE 1543299
  misc_feature: Encodes the peptide sequence at SEQ ID NO. 67978
ctggagctcccgcggtggcggccgctctagaactagtggatcccccgggctgcaggaattcgtctcacccctagaaaaaatatccgttattttggaactttgaaatatggttttagattgctatgttttattcgaagatctatggcttctcgaatttagtagagtagatgatgtttgaacatgggagccgcaaactatcaatatctgtttgaatggtatttatataaataataaaactgggtaacggtgaaaacaaaaatttatatataaaaaaaaaaaaaaaaaacgagacgcctcgaggtacccaattccgcccttaaagtgaagtcggattaccccggcgctccctgggcccgcccttttttacaaactgccggggcctggggaaaaacccctgggggtttcccccaacttttatcccccctttggaggaaaaaaaacccccccttttttccccccgagggggggggaaaaaa

SEQ ID NO: 67978 - protein, 33 aa, Zea mays
  misc_feature: Ceres CLONE 1543299
WSSRGGGRSRTSGSPGLQEFVSPLEKISVILEL

SEQ ID NO: 67979 - DNA, 663 bp, Zea mays
  misc_feature: Ceres CLONE 1543307
  misc_feature: Encodes the peptide sequence at SEQ ID NO. 67980
tggagctccccgcggtggcggccgctctagaactagtggatcccccgggctgcaggaattcgtctcacccctagaaaaatacattttcaccgtggacaccttttcctaccaagaggttattaccaagaatcctcaatccaaatccaaggcgttcagcatcatagcaatatttcaatagttaataatttttataaaagaaatcaattgtgtttctacctttgaaggttcaaattttactgcaaaatcaacgagttcttggtggtgttggtatggcatccgatccaatggtggcacgtagaagtaaaatctgaaacatttgttttgatggttagcttgcattttatgctataattacctcaaatcacgtgttgcctttttcaccaatttatgacatctattgacatgttttactttaatttacgacatttattgatgtgttttgcgacaacctcatgtggggccacatttgccattatgaaatagatcgatgatttatgctaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccc

SEQ ID NO: 67980 - protein, 58 aa, Zea mays
  misc_feature: Ceres CLONE 1543307
GAPRGGGRSRTSGSPGLQEFVSPLEKYIFTVDTFSYQEVITKNPQSKSKAFSIIAIFQ

SEQ ID NO: 67981 - DNA, 658 bp, Zea mays
  misc_feature: Ceres CLONE 1543308
actggagctccccgcggtggcggccgctctagaactagtggatcccccgggctgcaggaattcgtctcacccctagaaaaatgaattctccttgaacatgcgtagtaccaacggttagactgtaagaccccgtgcaccttgactatagcttcgcagtgacaaccttgatctaatgtgtaggataggtgggatgtggtgactctctctctaccaatactgacagaccactctttcatataacgatgcctaaccaccgcaccgatcattcgtgtggggggccggatactgcgaggcgggtagtttatctgggactcgatgcttcctacaacactaacgaacgtgtcgccaatgtacgctcaagcgatgattcttgctacatggagtatgactggtataagcctgacttgactgtgagaccgactgtgcgatcacagacgatagacggccataatgtactccggagtagtcgcctttgtgagaatggctctgcagctcacgtatcgaaggtactgccgtcataacatgctgatgactcccaatagctcttatcgacggagtctggtagcacctcaatgtcaactcatcacatcttgctgttgaagaacgtaccaatgcttaggatgttcacctatgagaatagctcgtgaaataaggttac

SEQ ID NO: 67982 - DNA, 632 bp, Zea mays
  misc_feature: Ceres CLONE 1543310
  misc_feature: SWISSPROT Homolog: EC 3.2.1.23 Beta-galactosidase
  misc_feature: SWISSPROT Homolog: EC 2.4.1.12 Cellulose synthase (UDP-forming)
gctggagctccccgcggtggcggccgctctagaactagtggatcccccgggctgcaggaattcgtctcacccctagaaaaaagaaaaaatcaacatgaaaggttggatggtattcagggtccaatttatgttggtactggatgtgtatttagaaggcaggcattatatggttatgatgcccccaaaacaaagaagccaccatcaaggacttgcaactgctggcccaagtggtgcttttgctgttgctgctttggcaataggaagcaaaagaagactaccaaacccaaaacagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaat

SEQ ID NO: 67983 - DNA, 782 bp, Zea mays
  misc_feature: Ceres CLONE 1543312
  misc_feature: Encodes the peptide sequence at SEQ ID NO. 67984
  misc_feature (1)..(1): n is a, c, t, g, unknown, or other
  misc_feature (6)..(6): n is a, c, t, g, unknown, or other
  misc_feature (37)..(37): n is a, c, t, g, unknown, or other
  misc_feature (38)..(38): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (236)..(236): n is a, c, t, g, unknown, or other
nttttnttttgtgtttgttttttcctttttcttttannacaaaaaaaaaannnaaccctggggctccccgcggtggcggccgctctagaactagtggatcccccgggctgcaggaattcgtctcacccctagaaaaaacgccagccatggcggcggctcagtcctccaccgattcgttggctccgcacctccgccgccgtccgcgccgcctcgtattcgaccgccgctacggctgngatctttcgacgaatggacgcaccccgccgaccaagccctctccggcggccgccggaatgttctgtgcgcctgacgatgggcgccgtcccctggttgaagcgcttgccggccttggctcccaatataactattggccgggaaaattttcaaaactcgggcacaaggttttttggggaaacggccccccaaaaaaaacccccccaagaaaaaaaatgcatatcccccggttccccctcgaaaattttgggtggggcgcggggaaattttcttcgctctctatatttttcttttttctctgcccccccccccgtgtggggggcggggcctctgttgtgggacaccttttgcttgtgcttgtgttttcccccccccaaccaagcgtcggggtccctacccgactgagctgcgtttcggcttgagcctatgaattaatttagcgtgcctgtcgcccccgattattggcgtccatttgtcttgtggggtgggcggcgtaacgctgttcttcttgaaatcatatattttacacgcccgctccatattcttta

SEQ ID NO: 67984 - protein, 169 aa, Zea mays
  misc_feature: Ceres CLONE 1543312
  misc_feature (30)..(30): Xaa is any aa, unknown, or other
MAAAQSSTDSLAPHLRRRPRRLVFDRRYGXDLSTNGRTPPTKPSPAAAGMFCAPDDGRRPLVEALAGLGSQYNYWPGKFSKLGHKVFWGNGPPKKTPPRKKMHIPRFPLENFGWGAGKFSSLSIFFFFLCPPPRVGGGASVVGHLLLVLVFSPPQPSVGVPTRLSCVSA

SEQ ID NO: 67985 - DNA, 655 bp, Zea mays
  misc_feature: Ceres CLONE 1543315
  misc_feature: Encodes the peptide sequence at SEQ ID NO. 67986
  misc_feature (655)..(655): n is a, c, t, g, unknown, or other
ctccccgcggtggcggccgctctagaactagtggatcccccgggctgcaggaattcgtctcacccctagaaaaatgtagatgtagagaggctgttctgctgtttccttcgtgatgccgttgtaggctagcagcactagttatggcttccgagcaggtgtggcaaaacggttatgacttatgataggcggatatggtttttaggctcctttgtgttaagtaaccctagttagggttatgtgcacaaatacttgctttgtccctgaggggtctcacctctctatataaggaacctatacaccccctcataatacagaaaagagaaagaggccagaggtccaaccctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaan

SEQ ID NO: 67986 - protein, 36 aa, Zea mays
  misc_feature: Ceres CLONE 1543315
PRGGGRSRTSGSPGLQEFVSPLEKCRCREAVLLFPS

SEQ ID NO: 67987 - DNA, 657 bp, Zea mays
  misc_feature: Ceres CLONE 1543317
  misc_feature: Encodes the peptide sequence at SEQ ID NO. 67988
ggagctccccgcggtggcggccgctctagaactagtggatcccccgggctgcaggaattcgtctcacccctagaaaaagtttcctgcgctgctcagaaagatacggtggacaaggtttgtgaaattgtgaagaagcagcttgctcttcctgaccactctgaagtttgtggtgaatcgaaaattctctgaacttggtgcagattccctggacacagtagagattgtgatgggccttgaagagcacttcaacattagcgtgaaggagtccagcgcgccgaccattgccaccgatgaagacgccgctgacctcattgacaagcttgttgctgtgaaggcatatgccgcatctcttctatcattgtcttaccactctaggtttctatggtctgaagacttgtgattttctccgcactgctgttgctattcccgtgtcgtaataatacgagatgtatcaagcggctgaacacacggtggtgtaatctgttactggctacgtgcattgttgtatgaattgtttctcacccagacaatagaggaacaaactagacgctcgaggtacccaattcaccctatagtgagtcgtattactctcgctcactggccgtcgtattacacggtcgtgactgggaaaaacctgggtggtaccaaatttaatcc

SEQ ID NO: 67988 - protein, 62 aa, Zea mays
  misc_feature: Ceres CLONE 1543317
GAPRGGGRSRTSGSPGLQEFVSPLEKVSCAAQKDTVDKVCEIVKKQLALPDHSEVCGESKIL

SEQ ID NO: 67989 - DNA, 805 bp, Zea mays
  misc_feature: Ceres CLONE 1543321
  misc_feature: SWISSPROT Homolog: EC 1.7.3.3 Urate oxidase
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ggttttcnttnnnannnnnnnngtcntccggacgcncatgaacnnnatacaacctgggactccccgcggtggcggccgctctatttctagtggatcccccgggctgcaggaattcttctcacccctagaaaaaaaagcaaagaagctccgctggtgaagtttgctgatgatgtgtacctgccgacggatgaaccacacgggacgattgaagcaaccttaataagccgtcccatgtcaaagctgtaaaaaaaatgtagtcgtcaggctggtattagactcgtgcttcgtctccccagcatccccaggcttaaaatggacagtaatctgtaagggaaagataaactgtcataaatcgtagcccctatgctttatgtgtggtggtggtaataagtgcacagacttgtattggatgttgtcagctgtatcctgtaggcgtccagcttgtgacatttctcccacggtaaatcccgccgattgcttcctcttgttgtggaaaccctagttaatatcctttggaaaagacaaagaaaaaaaaacctagcacgcctctgatgttacccccaattccccccctttagggggagtccgactttaacccgtcccctcactgggtccgtcctccctataaaaaccctccccgtactgggaaaaaaccctctgggcggtttacccacactttagatcccccctttgcttacaccaatccccctttttacaaacaaactgggatttaaaaaatccaaaaaagtcccccgcccaccgaattccccccttccccaaaatagtttgtcccctctctcttaat

SEQ ID NO: 67990 - DNA, 619 bp, Zea mays
  misc_feature: Ceres CLONE 1543324
  misc_feature: Encodes the peptide sequence at SEQ ID NO. 67991
ggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcggttagcctgatggtgcaccttgctgtgccatggctctgccttgcttcttgggcagctctgctaccagcgctagcatctggaaatgtgtgtgcagcaactccgatactgagagcagattacctaaaattgaacttcagcaccgcttcggcgacccccgacgagtacaagagcttcatcacttctgttcgtgctggcttggtgatcaaagcggggggcaacagcagcgggatccccgtgctggtcgacgaagacgacccgctcgcgctcagatcgtgtctaaacatcagtctagggaacaaggcatggctctccgtaagcttgaagatggatgtatgcagagcctacttcgtgacttacgtagcatgtcagcgctcgtgcctcctcaaaagatcatgccgcacgttctcgacagcgatctgttactaccgtggcccgaggggaacaattccggctcctgcaat

SEQ ID NO: 67991 - protein, 160 aa, Zea mays
  misc_feature: Ceres CLONE 1543324
  misc_feature: SWISSPROT Homolog: EC 3.2.2.22 rRNA N-glycosylase
MKGGTQAVSLMVHLAVPWLCLASWAALLPALASGNVCAATPILRADYLKLNFSTASATPDEYKSFITSVRAGLVIKAGGNSSGIPVLVDEDDPLALRSCLNISLGNKAWLSVSLKMDVCRAYFVTYVACQRSCLLKRSCRTFSTAICYYRGPRGTIPAPA

SEQ ID NO: 67992 - DNA, 629 bp, Zea mays
  misc_feature: Ceres CLONE 1543330
  misc_feature: Encodes the peptide sequence at SEQ ID NO. 67993
  misc_feature (402)..(402): n is a, c, t, g, unknown, or other
aagctggagctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacanccgtctttgatgccaaagccgtctcatttggcaaggaagtttaatggatggctctgtccagaatgaattaagcctggggcctttcaaggcctttcctggggccgggaaaagcccattgaaagttgttcccccaaagggggaggaaaaaaaattttggcccaaaaaaaaatcccccccggggtccccccaaaaagcgggagaaaccctaaaaattaccctgggaggcc

SEQ ID NO: 67993 - protein, 71 aa, Zea mays; identical to SEQ ID NO: 24642
  misc_feature: Ceres CLONE 1543330
  misc_feature (69)..(69): Xaa is any aa, unknown, or other

SEQ ID NO: 67994 - DNA, 635 bp, Zea mays
  misc_feature: Ceres CLONE 1543334
  misc_feature: Encodes the peptide sequence at SEQ ID NO. 67995
agctccccgcggtggcggccgctctagaactagtggatcccccgggctgcaggaattcgtctcacccctagaaaaaagaaaccaatccaaataaaaatcctggagccatcggccgccggcagccacagcagtcgcttccctgatctgccaagcaatggagacgcgtctcttcctcctctgtgctactactgtcgccatcgctctcgtctccgttttgctggtcctcgtcgcccgcggccgcaagcccagcgccggtcgcctcccgccgggtccgccggcgctgctcttcctcgccaagttccttgcgctgcggcgctccatcttcgacctggctccgctgctccgcgacctgcacgcgcgctacggccccgtcatctcggtccgcctcgcccgcacgctcgtcttcgtcgccgaccgccgcctcgcgcaccgcctcctcgtccagggcggcgccaccttcgcggaccgcccgccacccgttgacccaaacagcctcttcagcgccggcggccgtgatgtcagctcctcgccctacggcgcatactggcgcctcgtgcgccgcaacctcgcgggcagaggcgctgcagcccgcccgcgtcgccctcttcgcgcccgccaggcggtgggcgtgcgac

SEQ ID NO: 67995 - protein, 160 aa, Zea mays
  misc_feature: Ceres CLONE 1543334
  misc_feature: SWISSPROT Homolog: EC 1.14.99.9 Steroid 17-alpha-monooxygenase
METRLFLLCATTVAIALVSVLLVLVARGRKPSAGRLPPGPPALLFLAKFLALRRSIFDLAPLLRDLHARYGPVISVRLARTLVFVADRRLAHRLLVQGGATFADRPPPVDPNSLFSAGGRDVSSSPYGAYWRLVRRNLAGRGAAARPRRPLRARQAVGVR

SEQ ID NO: 67996 - DNA, 688 bp, Zea mays
  misc_feature: Ceres CLONE 1543337
  misc_feature: Encodes the peptide sequence at SEQ ID NO. 67997
gctgaatctagcctcgcaggcggccgactctagatcagtaaatcccccgggctgcaggaattcgtctcacccctagaaaaaagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttcccactttatgaccctgggttttgctaaagatggaactttagtggtgttactgtatgatggcaagaaccttttgctgccgaaggggtatgttttgaagttcatgctaccttttaaagtacggaatacccttgtgccaaaaaaaaaaaaaaaaacaaaacgctcgggtaccccaattccccccaaaaggaaggccaattaccgcccccctcctgggccccctttttaaaaactcgggaagggggaaaacccgggggtttcccaaatttaatccctttgggaaaaaatccccctttttccccgggtgggggtaaatcgaaaaaaggccc

SEQ ID NO: 67997 - protein, 60 aa, Zea mays; identical to SEQ ID NO: 2158
  misc_feature: Ceres CLONE 1543337
  misc_feature (3)..(42): Pfam Name: Ribosomal_L29e Pfam Description: Ribosomal L29e protein family

SEQ ID NO: 67998 - DNA, 657 bp, Zea mays
  misc_feature: Ceres CLONE 1543338
  misc_feature (208)..(208): n is a, c, t, g, unknown, or other
  misc_feature (211)..(211): n is a, c, t, g, unknown, or other
  misc_feature (212)..(212): n is a, c, t, g, unknown, or other
  misc_feature (226)..(226): n is a, c, t, g, unknown, or other
  misc_feature (269)..(269): n is a, c, t, g, unknown, or other
  misc_feature (270)..(270): n is a, c, t, g, unknown, or other
  misc_feature (349)..(349): n is a, c, t, g, unknown, or other
gcggtggcggccgctctagaactagtggatcccccgggctgcaggaattcgtctcacccctagaaaaaatcaaggaacagtgcaaactagaagaaacctccgtcatcagcgacctctccccaacggcgccgacgatggcgcaacagcagacgcagctaaccactggctcgggcatcctggatgccgtcccgctcttcgtcgtcatccntcnnctcgcaggcccacngtcctggggccctcgtggttctggaatagtacaaggctgggcnnttccgagaaaagcaaacccacccccccgggggaaaggggaaaaaagaaaacccaacagggggggaaacgcgggggcgcnccccccccaccagcgcgcggaggaggaggaggagaacgcacgaaagcacagagaccgcaaaaaccccgccacaacgcgactccaaaacacaccacactagcccacccggaacgaacacgagacgccacgtacggcaacaaaggcgacggcgccgacaagcggcgttcgcacacgcgtgtgtcctgttctgcaataaattcacacttgttgtggtcgtagttatcctgtgctctgatcggtacgtatatgatttttgctccgcaccttgttggtgtacacgttgtgcatgtgagtctgaacggtcctga

SEQ ID NO: 67999 - DNA, 440 bp, Zea mays
  misc_feature: Ceres CLONE 1543339
  misc_feature (143)..(143): n is a, c, t, g, unknown, or other
  misc_feature (144)..(144): n is a, c, t, g, unknown, or other
  misc_feature (173)..(173): n is a, c, t, g, unknown, or other
  misc_feature (174)..(174): n is a, c, t, g, unknown, or other
  misc_feature (196)..(196): n is a, c, t, g, unknown, or other
caccgcggtggcggccgctcagaatagtggacccccgggctgcaggaattcgtctcacccctagaaaaaaagcggcactcgcacgatcaatgtacacattgcccgtccgcgccaccacatccagcgtcgtcgccaagcctcgnncaacccccgggcgtcctctcctcaggtcnnggtcgcgcccagccagctatcngaacgcccgtctcgccgccccgcacgttttgtaacgcacgcggcacttaagatccaaccaaaaaatccaaaaaaaaaaggaaggcgttcccccacccccgggggaaaaaaaagggaaaaaaaaaaacccccaaaaaaagggggaaaaaaaaaaaaaaaaaatgggcccggggggcccctttttttttttttaaaaaaaaaaaaaaaaagagggcccccacaaaaaaaaaaaaaaccccccccaa

SEQ ID NO: 68000 - DNA, 672 bp, Zea mays
  misc_feature: Ceres CLONE 1543346
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaaatttctaagcattcatatattgatttcttgaaatagaggtggtttcgaaaatctcctgattttgatggccccatggcatgttttcttctagttatatcatatatatatgcactatgtaatgtctatgaacaagtggtgctcaactgtgattgctatgttgaagcatgcttcctagttaccttccatacttgtctaatatattgttctctctttaactcagtattgttatctctattaatgtgtattgcatatctactgctatgctatatatgccctgtgccgactttaacaaaaaaaaaaaaaacgatacgctcgaggaacacaattcaccctatagtgagtcgtattacgcgcgctcactggacgtcgatttacaactacctgactggtaaaaccctgtcgctacccaacttaatcgccttgcagcacatcccccttatcccagcaggcgtaatatctaataggcccgcaccgatcgcccttccaaacagttgcgcaacctgaatggccaatggaaattgtaaacgttaatattttgttgaaattcgcgttacatttttgttaaatcagctcatttgtttaaccaataggc

SEQ ID NO: 68001 - DNA, 806 bp, Zea mays
  misc_feature: Ceres CLONE 1543347
  misc_feature: Encodes the peptide sequence at SEQ ID NO. 68002
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (19)..(19): n is a, c, t, g, unknown, or other
  misc_feature (26)..(26): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (806)..(806): n is a, c, t, g, unknown, or other
nnnnaaaagaggagggganaaaattntccttnnnggctcctcnnnccacaccataacacaccgcggtggcggccgctctagaactagtggatcccccgggctgcaggaattcgtctcacccctagaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctcgggatctgcgtctgttcatatgcctgatgccgacttgtgctgtatgtagttgcttgaatccagtcgtgttttgctaccctacccccccccatgtatcatctgtctccgcggacggcaataatcataggacataacaagttcagaagattgattccccaaacgacaaaaaaaaaaccgaggcggcccggaggtacccaatttcgcccccataggtgaggccttaataaccccccgccccccccgggcgggcgtggtttgaacaaacctcgcgtgacctggggtgaaacccccgctggcggcttaccgccagactgtaaaatctcactgcggcaacgcccaaagtcccaacccgactcggcccctaccctttgggttn

SEQ ID NO: 68002 - protein, 58 aa, Zea mays; identical to SEQ ID NO: 46528
  misc_feature: Ceres CLONE 1543347
  misc_feature (6)..(56): Pfam Name: UPF0057 Pfam Description: Uncharacterized protein family UPF0057

SEQ ID NO: 68003 - DNA, 598 bp, Zea mays
  misc_feature: Ceres CLONE 1543364
tggagctccccgcggtggcggccgctctagaactagtggatcccccgggctgcaggaattcgtctcacccctagaattacttactggtcctcactcccacaccaaccaaccaacctcctctgcctgccgcttctcctgctgcgggcggtcacggctgcaagtactagaggaagacatccgcttccattactgcgcctgcggaggatcggaagaaccagtagcggaaggcttcgattttcggcgggcgcaataaatttcccgcatggctcggagggccgcgtcctcgctcgtctcccgctgcctcctggcgagggcccctgccggcgcgccgccccgctgccccctctgcgctgcgcaggacagttgcctgcagatgggatgcacatgctgttgcccagtgtccttcagaagtcagcactgcacacagtagagagccatcacccgtcagtcatgtgactaccaaactcctcattatggcactttgttgatccccaatccggaaaaccttccaactctggaccctcctaaaggggaaggaaattgccccgggggcttaaggggaccccaaagagaccttaacccggccaaaaccgccccc

SEQ ID NO: 68004 - DNA, 586 bp, Zea mays
  misc_feature: Ceres CLONE 1543370
  misc_feature: Translation starting site: 226
  misc_feature: SWISSPROT Homolog: EC 2.7.9.1 Pyruvate, phosphate dikinase
  misc_feature (84)..(84): n is a, c, t, g, unknown, or other
  misc_feature (87)..(87): n is a, c, t, g, unknown, or other
  misc_feature (89)..(89): n is a, c, t, g, unknown, or other
  misc_feature (92)..(92): n is a, c, t, g, unknown, or other
  misc_feature (93)..(93): n is a, c, t, g, unknown, or other
  misc_feature (95)..(95): n is a, c, t, g, unknown, or other
  misc_feature (282)..(282): n is a, c, t, g, unknown, or other
  misc_feature (292)..(292): n is a, c, t, g, unknown, or other
  misc_feature (303)..(303): n is a, c, t, g, unknown, or other
  misc_feature (309)..(309): n is a, c, t, g, unknown, or other
  misc_feature (328)..(328): n is a, c, t, g, unknown, or other
  misc_feature (381)..(381): n is a, c, t, g, unknown, or other
  misc_feature (384)..(384): n is a, c, t, g, unknown, or other
  misc_feature (441)..(441): n is a, c, t, g, unknown, or other
  misc_feature (522)..(522): n is a, c, t, g, unknown, or other
ggagctccccgcggtggcggccgctctagaatagtggatcccccgggctgcaggaattcgtctcacccctagaaaaaacccggnttntncgnncncttctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcangaggggatcngaaggatggcngcgtcngtttccagggccatctgcngttcagaagccgggctcaaaatgcaccagggacagggaagcgacctccttcgnccngccgattcgtcgcagcggcaaagcccccgcacgccaaagcccgcgggggtcatcggntcccaactccgggggggggaagggggccagcatttgctccccccctaaagggccgtcccttaaacccccgccccaattccnaacgaccaaaaaagaaggggggttccccctttcgggagaggggcaaaaaagagggggcaacaaa

SEQ ID NO: 68005 - DNA, 580 bp, Zea mays
  misc_feature: Ceres CLONE 1543385
  misc_feature: Encodes the peptide sequence at SEQ ID NO. 68006
  misc_feature (401)..(401): n is a, c, t, g, unknown, or other
  misc_feature (445)..(445): n is a, c, t, g, unknown, or other
  misc_feature (454)..(454): n is a, c, t, g, unknown, or other
ctccccgcggtggcggccgctctagaactagtggatcccccgggctgcaggaattcgtctcacccctagaaaaaactttcgcaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttattgggattgatttggggacaacgaactcatgtgtttnctgttatgggagggaaaagaccccaaaggtatttgagaatgctngaaggtgcnagaaaccaacaccccatcgggtttggcccctttttctcccccaaaaagggggaaaaaaaaactttttggggaaaaaaccccccccccaaaggggggggggggggagagaaaaaaaaaacacacaaa

SEQ ID NO: 68006 - protein, 126 aa, Zea mays
  misc_feature: Ceres CLONE 1543385
  misc_feature (67)..(67): Xaa is any aa, unknown, or other
  misc_feature (82)..(82): Xaa is any aa, unknown, or other
  misc_feature (85)..(85): Xaa is any aa, unknown, or other
MAASLLLRAVRRRELASPLGSLGASIQSTCVANICSKWGRFARPFSAKAAGNEVIGIDLGTTNSCVXCYGREKTPKVFENAXRCXKPTPHRVWPLFLPQKGGKKNFLGKKPPPQRGGGGREKKNTQ

SEQ ID NO: 68007 - DNA, 689 bp, Zea mays
  misc_feature: Ceres CLONE 1543395
  misc_feature (531)..(531): n is a, c, t, g, unknown, or other
  misc_feature (537)..(537): n is a, c, t, g, unknown, or other
  misc_feature (606)..(606): n is a, c, t, g, unknown, or other
gctggagttcaccgcggttgggggcgcttttaaacttgtggatcccccgggcttgcggatatcgttttcaccccttgaaaaagaggcgccagggccgaatctcctgcgtgacttggggcgtcctccccgaagttttctcccggccgaaggcggcgcgaccggacaaccagcgtgagcgccaccggcgaaatgaactcgcggcaaccagcgtgaacccgaaccgtgagcgcccggcggcgccggaagcccaacgccaagaactcccaggacgggctcacccccggagcagcgccgcgagagggacaagaaagctctggaggaaaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttngtgatngagaataatgcgtggttttcctggcttaaaaaaaaaaaaaaaaacgaagacgctcgaggtacccaattncgcccctatagtgagtcgtatttacgcgcgctcacctggccgtcgtttttacaaacgtcgtgacctgggaaaaacccctggcc

SEQ ID NO: 68008 - DNA, 612 bp, Zea mays
  misc_feature: Ceres CLONE 1543396
  misc_feature: Translation starting site: 91
gcggtggcggccgctctagaatagtggatcccccgggctgcaggaattcgtctcacccctagaaaaatgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcggggcttagttttgtgaaacatttactgtttttgagaaacccatgttactgtatccccttgatgtcaaactttttagcacaatttgtggttcctgaaaggtttggttgattgttgcagctaaatgtttgaattgtcctaaaccctaaaaaaaaaaaaaaaacgaaaacctccaagggaccccattccgccctaaagggaggcctatttacccccccctccctggcccgtccttttaaaaccggcgggaaatggagaaaaa

SEQ ID NO: 68009 - DNA, 700 bp, Zea mays
  misc_feature: Ceres CLONE 1543401
  misc_feature: SWISSPROT Homolog: EC 3.2.1.23 Beta-galactosidase
cgcggtggcggccgctctagaactagtggatcccccgggctgcaggaattcgtctcacccctagaaaattacaagaagtttctgacttccatgcatggatttgtgcgctcctaaatcttcagcatgccttccaacacacgaagaacatcagcacgggcaactatacctgttgatagtgtttagaaccccattaggcttgcaacatactctgtgttgtcaatgttgattaaggataatacaaatcaagtatgtacatgcagttttttttatctctagtttgtcagcattctgatactcccaaagaaaaaaaaaaaaaaaaacgagacgctcgaggtacccaattcgccctatagtgagtcgtattacgcgcgctcactggccgtcgttttacaacgtcgtgactgggaaaaccctggcgtttcccaacttaatcgccttgcagcacatccccctttcccccagctggcgtaataccgaaaaaggccccgcctccaatcgccccttcccaaacattttgcccacccttgaaatggcgaaaggaaaatttggaaaccgctaaatattttttgttaaaaatttcccggttaaaatttttttgttaaaatacacccccattttttttttaccccaaaataggggccgaaaatcgggaaaaaattccccctttaaaaatataaaagaaaaataactccccaagaaa

SEQ ID NO: 68010 - DNA, 672 bp, Zea mays
  misc_feature: Ceres CLONE 1543403
  misc_feature: SWISSPROT Homolog: EC 3.2.1.23 Beta-galactosidase
  misc_feature (672)..(672): n is a, c, t, g, unknown, or other
ggagctccccgcggtggcggccgctctagaactagtggatcccccgggctgcaggaattcgtctcaccaactaataactaaaacgatggatcggatcatctgcatgcatgcatatgcagtatgctgcttgcctagctgcctgtaacgaatatgaatgcataaaataacgcccctgctgctcccatatgcatcagcagtgtgtaccactatatatgttatatactgtatttcgctaccgaataaaaacataaataaaagatccagtgtcgtctgcacctttgttataaaaaaaaaaaaaaaacgagacgctcgaggtacccaattcgccctatagtgagtcgtattacgcgcgctcactggccgtcgttttacaacgtcgtgactgggaaaaccctggcccaacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgatccattttggaacaagagtccan

SEQ ID NO: 68011 - DNA, 650 bp, Zea mays
  misc_feature: Ceres CLONE 1543404
  misc_feature: Translation starting site: 361
  misc_feature: SWISSPROT Homolog: EC 3.2.1.23 Beta-galactosidase
cccgtccaccacgttcatagccgctctagaactagtggatcccccgggctgcaggaattcgtctcacccctagaaaaacggatacagaaacactttgtggagggtttgtttttttggggtcatgttttagttttgattcttacgcgtgcgtgggtgaggccttttggtttttgaatgagatgtaattattgcggcacatatttagaagccatgttccaaccggggattacattttcgttttgtaatcccaaaaactgttttgttgaccaaagtttgactttatatttttaaattctaaactgaaatacaaaaaaaaaaaaaccggaccggaccgaaaacggtaaattttaccgccacttgatgtttaaaaaaaaaaaaaaaacgagacgctcgaggtacccaattcgccctatagtgagtcgtattacgcgcgctcactgcccgtcgttttacaacgtcgtgactgggaaaccctggcgttacccaacttaatcgccttgcagcacatccccctttcccaagctggcgtaataccgaaaaaggcccgacccgatgcccctttccaaaaatttgcccccccctgatggccaaatgaaaattttaacccgtaaattttttgttaaaatccccggttaaatttttggtaaaac

SEQ ID NO: 68012 - DNA, 700 bp, Zea mays
  misc_feature: Ceres CLONE 1543414
  misc_feature: Encodes the peptide sequence at SEQ ID NO. 68013
  misc_feature (68)..(68): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (184)..(184): n is a, c, t, g, unknown, or other
  misc_feature (185)..(185): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (249)..(249): n is a, c, t, g, unknown, or other
  misc_feature (250)..(250): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (274)..(274): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (280)..(280): n is a, c, t, g, unknown, or other
  misc_feature (293)..(293): n is a, c, t, g, unknown, or other
ccccgcggtggcggccgctctagaactagtggatcccccgggctgcaggaattcgtctcacccctagnaaacagtttgcgtatatctgtgattgagattgaggtcatgtagatatttctttttttttatagacatctgttgttcggatcttctcttaatcgatcaagtttccgacnnnnnnnannaaaaaaaaaaaaaaaaaaaaaaaaaaaaaaaaaaaaaaaaaaaaaaaaaaaannnnnnnnaggnncccannnnncccccaaaaaaaagncnnnanacggggcgggggngggggaagtccctttacccccccggggaccccaaaaccccccgaaggggccccctttaaacacccccccactggcccccccttttaaaaaggggggaaaaaaaaaaaaaaaggggcttccccaacctccctccccagagtgggcccccccttttttggccgacggggaaaaataaccaaaaaaaaacccaccaaaaaacccgttcaaaaaattttgcaaacccaacccgctttatttgaaaaaaggaggcgcaaaatattttaaaatcacccccccccctcaaaatttattaacccccaatgcggtttgaataaactgtacaaagcagaaaaaacaaaaaaaaccccccttttaaaaaacaagaaaaaaccccccccccacaataggggggaaacaaacctccccca

SEQ ID NO: 68013 - protein, 36 aa, Zea mays
  misc_feature: Ceres CLONE 1543414
  misc_feature (23)..(23): Xaa is any aa, unknown, or other
PRGGGRSRTSGSPGLQEFVSPLXNSLRISVIEIEVM

SEQ ID NO: 68014 - DNA, 644 bp, Zea mays
  misc_feature: Ceres CLONE 1543424
  misc_feature: SWISSPROT Homolog: EC 3.2.1.23 Beta-galactosidase
  misc_feature (634)..(634): n is a, c, t, g, unknown, or other
ggagctccccgcggtggcggccgctctagaactagtggatcccccgggctgcaggaattcgtctcacccctagaaaatgtactaccatcagacccatccattcgtccgtccgtcgagtgaacagtgtggtcttccctgtactctacttgttcagatcgtaggcgtgtagtagttgcaccagccggcgtatgctcatgatcgatgtgtgtgctcatcaatcaatgtcaatggctgcctgctgtaagcggtcgatgtaaactaagcacagacgcatgtatcgtcatcagtggatgaatcaatctatcgatggcctgtgccattcatttttgaatcgattaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtagcgttaatattttgttaaaattcgcgttaaatttttgttaatcagctcatttttttaaccnatagccgaat

SEQ ID NO: 68015 - DNA, 667 bp, Zea mays
  misc_feature: Ceres CLONE 1543433
  misc_feature: Encodes the peptide sequence at SEQ ID NO. 68016
  misc_feature (374)..(374): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (555)..(555): n is a, c, t, g, unknown, or other
cggccgctctcgaaatcgtggatcccccgggctgcaggaattcgtctcacccctagaaaaaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggaccgggaacggccccctcgggggccttccccgggcgtcgaacaaccgactcataactggtacggacaaggggaatccgactgtttaattaaaacaaagcattgcgacggtcctcgaggatgctgacgctttgtcgcccccccccgggggggggaggggggaantnnanaaattcaacccacccccgggtaaacgggcgggagtaactatggactctcttaaggtggggaaatgcctcctcctctaattagtgacgggcatgaatggattaacgagattcccacggtcccgggctactatgccggcggaacccccgcccagggaaaggggttttgccggaatcancgggggaaagaaacaccctggttgacccttggcctcttagccccaaccgttggggaaatggacttttcgcggggggggggaccaagcgggggaccctccccggcccccaatg

SEQ ID NO: 68016 - protein, 111 aa, Zea mays
  misc_feature: Ceres CLONE 1543433
RPLSKSWIPRAAGIRLTPRKKSAKRIRNFGKRIGSEGWARGSRPRTRRLLAECSSCSRGESGPPRAGRGTDRERPPRGPSPGVEQPTHNWYGQGESDCLIKTKHCDGPRGC

SEQ ID NO: 68017 - DNA, 626 bp, Zea mays
  misc_feature: Ceres CLONE 1543440
  misc_feature: Encodes the peptide sequence at SEQ ID NO. 68018
  misc_feature (626)..(626): n is a, c, t, g, unknown, or other
ggatcccccgggctgcaggaattcgtctcacccctagaaaaaagtactccacttccaatcgccgtctcataaatccgggctgccacttccgcctccatcgccgccagccgccgccttctcttcgccagttactccacttgcccgcaggccgcaccgcaccgccaccgctttcatcggacgatccactgagcaagccacgccaggcaggggctcgtacagggcgagagaaacccgcgcgctcgcccctgtcctgccgcgggatcgcagttgccgtccgcttcatccccggacccggaggtaggcaccaggcaggcggcggcaatgctaccgggctcgccggtgaagcgcctgctgcggcgggcggccaaggggcggcgggagaaggccgagctggcggggctggccgcggcggccgccgcgctgctgctgctctgcgccgcctcgctccgctgctcggccaccgcgcgcgggaggctctgggccggtggggtctccatcccggcggcggggagtggcggcaaggaagagtgcgacctgttcgaaggggacggggcctgggctggtcggcagcggccgggtacccgctcctacgactcccggggaatgccccgtttccctcgacgttn

SEQ ID NO: 68018 - protein, 101 aa, Zea mays
  misc_feature: Ceres CLONE 1543440
MLPGSPVKRLLRRAAKGRREKAELAGLAAAAAALLLLCAASLRCSATARGRLWAGGVSIPAAGSGGKEECDLFEGDGAWAGRQRPGTRSYDSRGMPRFPRR

SEQ ID NO: 68019 - DNA, 606 bp, Zea mays
  misc_feature: Ceres CLONE 1543443
  misc_feature: Encodes the peptide sequence at SEQ ID NO. 68020
acccgcggtggcggccgctctagaactagtggatcccccgggctgcaggaattcgtctcacccctagaaaagcttcagcaaaaccgcgccccaccgcttccccgttccccaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtgcaggcttctgattcggatttttttatgcgctgttcgtgctgtgtggtgtggtgactagagtggaatattggagtgcttccagatatcgatagtcgagtcgaatcgattcttttcaaagatgccactggaaatggcagaatgctgaaatgtttgctctagtttatgcgcacataggtaagcttgtatagtttggtcgggctgtgacttttgggctgtcaattttagtttttgggcggtatgtgggctg

SEQ ID NO: 68020 - protein, 54 aa, Zea mays; identical to SEQ ID NO: 52963
  misc_feature: Ceres CLONE 1543443
  misc_feature: SWISSPROT Homolog: EC 6.3.2.19 Ubiquitin--protein ligase

SEQ ID NO: 68021 - DNA, 664 bp, Zea mays
  misc_feature: Ceres CLONE 1543447
  misc_feature: Encodes the peptide sequence at SEQ ID NO. 68022
ggagctccccgcggtggcggccgctctagaactagtggatcccccgggctgcaggaattcgtctcacccctagaaaaatctcaacgcaaacccaactgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggaaggggacgagacccgcggcttcgacatgtgcccatggacacccccggcgcgtaccgcctggtagaccgggacaccggccgcagcgtcatcgttggggcggcaccgacgacagcgacgatgcctccatgccgtccccggcggtgctctcccggaccaccgaccgccgccacagcaaggtgttgggggaggtacaggtatcgggtatttcggcaggttcaaggcccaaaaaataaaatcctttggtcacgaggtcagctccacgcaagaagggagagttcttatccgctcaagcactgccctggtctgatgaaaccttccttccaatggctcttgatgatgaagaaggaaagctttttggagaaaaagaaagcatgtccccaaaccctggaacgccacccgaagt

SEQ ID NO: 68022 - protein, 63 aa, Zea mays
  misc_feature: Ceres CLONE 1543447
MEVAGAQARAVPLLLRNTASLRTSVSVSCTGSRRSWVAAATAEGDETRGFDMCPWTPPARTAW

SEQ ID NO: 68023 - DNA, 626 bp, Zea mays
  misc_feature: Ceres CLONE 1543448
  misc_feature: Translation starting site: 165
atagctggagcttcccgccgtgcaacaatcttccaaactacaagatcccccgggctgcaggaattcgtctcacccctagaaaatctcccacagccgccgctacgctttggctgcatgactcgctcctcttcggagcctccctttcgccggcggcgtaggaagagatggcagagcgtttgacccgtatcgccatcgtctgcgaggacaagtgcaagcccaagaagtgccgccaggagtgcaagaagagctgccccgtcgtcaagactgaaatgtccatttgatgccattgaaatcatcaaccttccaaaagacttggaaaaggataccactcaccgatatgggcctaataccttcaagttgcacaagttgcctgtcccaaggcctggtcaggttttgggccttgttggaaccaaccggattggaaagtcgacagctcttaaagtgttggctggcaagctgacacctaacttggggcgcttcaaaaacccacctgattggcaggaaattcttacatactttcgtgagtctgaacttcagaactacttcacacgcatattggaagataacctgtaggcaatcatcaaacctcagtatgttgaccacattccacaagctgtgcatgggaa

SEQ ID NO: 68024 - DNA, 646 bp, Zea mays
  misc_feature: Ceres CLONE 1543449
  misc_feature: SWISSPROT Homolog: EC 2.7.11.1 Non-specific serine/threonine protein kinase
tccccgcggtggcggccgctctagaactagtggatcccccgggctgcaggaattcgtctcacccctagaaaaactggcattttggcggttgacagtaataaccgttgtttaagatatattccccacctctctttcacatcaagagaaaggcattactgttgcatgccaaacatggtagtgatctactgcaattcagaagggatatgcttataagaaattcggtacacaatcataatggcacatggttttttatgtttttctgaattgtcttcaactcgttagaatatattaagcttggtatagctaatttttttcttcattaaattgatataggtataaggcatttgatgaagtccaatgcattgaggtcgcctggaatcaaatctacatagatgtggtgatgcagcgtccagataatcttgataggctctacacagaagttcatcttctgaagtcactcaagcatgaaaatgttatcaagttttattattcatggattgatgaccacagtaagaaaattaatgtcatcacagagttgatcacgtcctggaacctcacgcatttacatcagaaacatccacgtgttacctgaaagcaataaagaattgggcaaggcagattcttcatggattggattacctgccta

SEQ ID NO: 68025 - DNA, 606 bp, Zea mays
  misc_feature: Ceres CLONE 1543450
  misc_feature: Encodes the peptide sequence at SEQ ID NO. 68026
  misc_feature (489)..(489): n is a, c, t, g, unknown, or other
ggagctccccgcggtggcggccgctctagaactagtggatcccccgggctgcaggaattcgtctcacccctagaaaaaacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcacgcccagaaatccggccaccttncccagaacaatggcatcaagtggcgcgggaactcttggcctgtcagaccggctcccgaccccaagggacgtccaaggggggggcctcctttcgggcgggtaacttaaaaaccctggg

SEQ ID NO: 68026 - protein, 163 aa, Zea mays
  misc_feature: Ceres CLONE 1543450
  misc_feature: SWISSPROT Homolog: EC 3.2.1.4 Cellulase
  misc_feature (130)..(130): Xaa is any aa, unknown, or other
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKSIPHKKPGPPPPDQYTEALHKALLFFTPRNPATXPRTMASSGAGTLGLSDRLPTPRDVQGGGLLSGG

SEQ ID NO: 68027 - DNA, 653 bp, Zea mays
  misc_feature: Ceres CLONE 1543457
  misc_feature: Encodes the peptide sequence at SEQ ID NO. 68028
  misc_feature (411)..(411): n is a, c, t, g, unknown, or other
ccgcggtggcggccgctctataactagtggatcccccgggctgcaggaattcgtctcacccctagaaaaaatccctccttccccgtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcagtgcggatgcgcgcgccctctcgcggggtccgcgggggctccgcgctgcgggtcacgtgcgataacgtggtgggggatcgacctangcaccacctactcggctgtcagccgccatggaggggcggaaagccgaccgtcgttcaccaacgtcagagggcgggccgcacaactccctcccttaggggcgtccaccagacaggggaagcgctggtggggcaaaacccttaaggcccagggggtcctgaaccccggaaaacccttttttttttggtaaaggcttattcgggcccaaaatttcctaaggcaaaaaaaaggccaaaaaggtttt

SEQ ID NO: 68028 - protein, 121 aa, Zea mays
  misc_feature: Ceres CLONE 1543457
  misc_feature (75)..(75): Xaa is any aa, unknown, or other
MASFTCSQVGAAAAGGTSPFLGYRRRSGPGGAIPSSSLFVGRRLAAVRMRAPSRGVRGGSALRVTCDNVVGDRPXHHLLGCQPPWRGGKPTVVHQRQRAGRTTPSLRGVHQTGEALVGQNP

SEQ ID NO: 68029 - DNA, 848 bp, Zea mays
  misc_feature: Ceres CLONE 1543457-R
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
nnccgaattgggtacctcnagcgtctcgttttttttttttttttcgatcaaattaaatttgaataaaaaccttgtgccctgtctttgaactttatatagcattcagccaattgttgagtcaaaatcacgagaaaagttcgcgaaacactaccgctatcaactccatactagatagcctacagtaaaaatcccaacacaaaaaaggaactatttgctcactctcctttatgccaaccatgctcaacacatggtcatgcatcgatcacccctcaattgctatctgtgaagtccgcatcaatgacatccccatcattctgcgctggtccggtaccaggggtaggcccagcctcagcaccaggagtaggcccagcagcactagcaccagactggttatacattgcctggccaatctgcatcacctcctggttcaaagcagacatggcatccttcatactctgtgttgatccaccagatattgcctctttgagctcctggagcttcacatccaccttctctttcacgggagcggggactttatcgccgagctccttcagttgcttctcaggctggtaagaccacaaaatcggcctgatttttttgtgtcaaattgcatctctctttccctttggccctcccttggggcaaaaaattatcgggctttctctaaccattgctgtcaagcctcatgcgctgtaggtaaccttgcttagaccccaagtgatatgggggattgccccctgagtgtacttttgcaaggggaccccgttgagtgaatgggcgaagccaactcgtgaaagggtcatcgcccacttttgttccttccggaataattgcggaaatagcgtccc

SEQ ID NO: 68030 - DNA, 656 bp, Zea mays
  misc_feature: Ceres CLONE 1543458
  misc_feature: Encodes the peptide sequence at SEQ ID NO. 68031
ctggagctccccgcggtggcggccgctctagaactagtggatcccccgggctgcaggaattcgtctcacccctagaaaaaattgcaagccttcccggttacttgttcactagcaaggtcgggacggcatggccctaggagctgcgtaccatcactacctgcagctcgcctgcgaccatggcaccgccacaatcgctctgctcctcggcgtacttatcatcctcgtcatccgcctagtatccgcagggcgaaccggctcaacctcagccaacaaacgtaagcagcaactgcggcttccgctcccgccttcgcccccgggcaagctgcccatcatcggccacctccacctcatcggcgccgagactcacatctccatccgggacctggacgccaagcacgggcgcaacggcctgctgctcctccgcatcggcgccgtgcccaccctgttcgtgtcctcgcccagcgcctccgacaccttcctgcgaaaccaggaccacatcttcgcgtcgcggccgccgtccatggctgccgagatcatccgctacgggccctccgacgtcgcgttcctccctacggaaagtactgacggcagggcaagaaactcctcaccacgcacatgctcagcagcaagaaggtgctgtccttccgccatggcca

SEQ ID NO: 68031 - protein, 176 aa, Zea mays
  misc_feature: Ceres CLONE 1543458
  misc_feature: SWISSPROT Homolog: EC 1.14.13.88 Flavonoid 3',5'-hydroxylase
MALGAAYHHYLQLACDHGTATIALLLGVLIILVIRLVSAGRTGSTSANKRKQQLRLPLPPSPPGKLPIIGHLHLIGAETHISIRDLDAKHGRNGLLLLRIGAVPTLFVSSPSASDTFLRNQDHIFASRPPSMAAEIIRYGPSDVAFLPTESTDGRARNSSPRTCSAARRCCPSAMA

SEQ ID NO: 68032 - DNA, 613 bp, Zea mays
  misc_feature: Ceres CLONE 1543462
  misc_feature: Encodes the peptide sequence at SEQ ID NO. 68033
acccgcggtggcggccgctctagaactagtggatcccccgggctgcaggaattcgtctcacccctagaaaaagatcccgggcgcaccccgtcacggcgtcaccgcaccacaggctctgcccctcttctcttttcctgcaggcggcaggccagcacatgacgacggggccttggcgccgtggcggccgcgccacgaccaacctcgcgctcctcctgctgctcgcgtgcgtcgccgtcgccgtccgctccatcccggccgcgctcgcccaggccacggtatccaccagcaccgtcgccggcgtggacttcaccaccttctccttccccgggttcgacaagaaccccaccgacctgacgctgtgggggaacgccagcgtcaaccagaacgcgctgcagatcacccccgacacaggcaacaacgccaatagcttcctcgtcgaccaggcaggccgcgcattctactacacgccgttcacgctctggacccccaacgcgtccagctccaactccagcgccgccggcggccggcgcgtcgcgtccttctccacggtgttcaaggccaacctctaccgccagaacacgaccgtcaagggcgagggtctggcgtccgtcgt

SEQ ID NO: 68033 - protein, 152 aa, Zea mays
  misc_feature: Ceres CLONE 1543462
MTTGPWRRGGRATTNLALLLLLACVAVAVRSIPAALAQATVSTSTVAGVDFTTFSFPGFDKNPTDLTLWGNASVNQNALQITPDTGNNANSFLVDQAGRAFYYTPFTLWTPNASSSNSSAAGGRRVASFSTVFKANLYRQNTTVKGEGLASV

SEQ ID NO: 68034 - DNA, 652 bp, Zea mays
  misc_feature: Ceres CLONE 1543464
  misc_feature: Translation starting site: 142
  misc_feature: SWISSPROT Homolog: EC 3.2.1.21 Beta-glucosidase
ctccccgcggtggcggccgctctagaactagtggatcccccgggctgcaggaattcgtctcacccctagaaaaagcaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatctttggtgctgccacttcagcataccaaattgaaggggcttggaacgaaggtggaaaggggccaagcacttgggacgacttctgccacaaccatccggagtggatagcggacgggagcagtggggatgttggagcaaactcctactatctgtatagggaggacgtcagattgctgaaggaaaatgggtatggacgcctacaggttctccatctcttggcccagaatattgccaaaggggacactcgagggaagcattaaccataaa

SEQ ID NO: 68035 - DNA, 661 bp, Zea mays
  misc_feature: Ceres CLONE 1543465
  misc_feature: Encodes the peptide sequence at SEQ ID NO. 68036
ggagctccccgcggtggcggccgctctagaactagtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttcccacttcggcaaggggcagagcgaggggcaacagaccatgaaggaactgcctgggcggcaagggcgcgaaccctggcgagatggccagcatcgggctgtccgtgccccccagggttcccggtgtccaacggaagggtgccaa

SEQ ID NO: 68036 - protein, 125 aa, Zea mays
  misc_feature: Ceres CLONE 1543465
  misc_feature: SWISSPROT Homolog: EC 2.7.9.1 Pyruvate, phosphate dikinase
MTASVSRAICVQKPGSKCTRDREATSFARRSVAAPRPPHAKAAGVIRSDSGAGRGQHCSPLRAVVDAAPIQTTKKRVFPLRQGAERGATDHEGTAWAARARTLARWPASGCPCPPGFPVSNGRVP

SEQ ID NO: 68037 - DNA, 724 bp, Zea mays
  misc_feature: Ceres CLONE 1543466
  misc_feature: Encodes the peptide sequence at SEQ ID NO. 68038
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
nnnnnnccccccccggggacaccgcggtcgcgggaggatggattaaaatcgcggcggcgggggctgagggggggtgggggccgctcttttatagtggatcccccgggctgcaggaattcgtctcacccctagaaaaaaccttccagagcccactggtcctcggcggcggcggacatgagctgtgtggaactacgtcgtcacggcgcacaggcccactagcgtctgccactcctgcgtaggcaactttaccagccccaaccagctcagccttattatcgcgaaatgtacccggatcgaaatccatttgcttacccctcagggcctccagccgatgcttgttgtgcctatatatggaagaattgcaacgattgagctcttccggcctcataatgagactcaggactttcttttccttgctaccgacaggtacaaattctgtgttatgaactgggatgcagaaaagtcacacctaatccccagagccgtgggcgatgtttctgatcgcattgccccgccctccgaacatgggacagagtggaatcattgcccctggactgaagaatccttggggcattctcctctatgagggggttactcaaaggtgttcccccttttgacacccaaggggcgggcctgaaacggaagcttttccttcttctcccaccttggaagggacctttcccggatacctgcgagccttccaaaatttcctctccagaggggg

SEQ ID NO: 68038 - protein, 84 aa, Zea mays
  misc_feature: Ceres CLONE 1543466
MLVVPIYGRIATIELFRPHNETQDFLFLATDRYKFCVMNWDAEKSHLIPRAVGDVSDRIAPPSEHGTEWNHCPWTEESLGHSPL

SEQ ID NO: 68039 - DNA, 619 bp, Zea mays
  misc_feature: Ceres CLONE 1543467
  misc_feature: Encodes the peptide sequence at SEQ ID NO. 68040
ctccccgcggtggcggccgctctagaactagtggatcccccgggctgcaggaattcgtctcacccctagaaaaagccctccccctctctctccctctccctctctcgacgacacaccaggccaccacgcacatgctttgtcccatggatgccgaccacctcatggtgttcaagaccatgctcgccgtcaggtggtagtcccggcgagcgagatctccccactccaggctctctcccatcgctcgctgccgcctcatgttgtttgcggccgtgctcgccaaccgcggcacggaggcgtcgatccgaccgggagcccttcgcaatggacaaagccttcctcctctccggcaatgagggcatcgtcggctcgtcgctaacatggggaagaggtaggagtagctcagcagtaggatggagtggccaggacagctcggtgcccacccgtcttcatcgatcgggaccctcttcccctctagcgagctattcccagtttcgagaacaagattaaaatagcttcgtaggcttttatgtggtttagatttgcatatctatctctcaccattaaaagcacaccagatctggtagcttcagctccaaacaacaagaaacctgagagctgt

SEQ ID NO: 68040 - protein, 61 aa, Zea mays
  misc_feature: Ceres CLONE 1543467
MDKAFLLSGNEGIVGSSLTWGRGRSSSAVGWSGQDSSVPTRLHRSGPSSPLASYSQFREQD

SEQ ID NO: 68041 - DNA, 645 bp, Zea mays
  misc_feature: Ceres CLONE 1543468
  misc_feature: Encodes the peptide sequence at SEQ ID NO. 68042
ctccccgcggtggcggccgctctagaactagtggatcccccgggctgcaggaattcgtctcacccctagaaaaaattatcacctccggaaggccaaaaccactcgtcatcctgtgcccccctccgtccactctcggccccacgcctccatggtcaccgccacgacaaccccgccgcaatgctggcgagggctccccgccttggcccgggcacctccacccctctcctctcctcttcggccgcgtgccgtagcggctgcggctcccatctatcctctcaggcgccgcatcgctattactacaaccagaggaaggcgaggcacactggactgttcccccaggtgtacgctggaaaccgccggccctggcttcgaccctctggggctctacgaggaggggtctaattctctgtcgcggtctcccctgtctaccttctttggtatcatggcgccggtatttgggagctccagcggcggtggtgcaagtagggagaaggcgtccgggcgaggagcagcagctgcaattgaggatagctccattgacattggtgacttcttcaagggccctctaccctgggaaagtcctgaagctccttggttttttggcctttgtctcggcttggtgtgtatatacctttggggtggagt

SEQ ID NO: 68042 - protein, 67 aa, Zea mays
  misc_feature: Ceres CLONE 1543468
MAPVFGSSSGGGASREKASGRGAAAAIEDSSIDIGDFFKGPLPWESPEAPWFFGLCLGLVCIYLWGG

SEQ ID NO: 68043 - DNA, 648 bp, Zea mays
  misc_feature: Ceres CLONE 1543471
  misc_feature: Encodes the peptide sequence at SEQ ID NO. 68044
  misc_feature (420)..(420): n is a, c, t, g, unknown, or other
  misc_feature (491)..(491): n is a, c, t, g, unknown, or other
  misc_feature (492)..(492): n is a, c, t, g, unknown, or other
  misc_feature (646)..(646): n is a, c, t, g, unknown, or other
gcggtggcggccgctctagaactagtggatcccccgggctgcaggaattcgtctcacccctagaaaaaaccctctctatcccagggaagctaggcaaaaaagctcgtgctggacgacttctcccctgtcgatccacgaccatgatgcagcatctccgtctcagccagccgagcccatgcctctgcggcctgcgggcggcacggcctatgctcgcgctcggcgcagcagcatcccgttcgcggcccgccggaaaactgcaaccgagcgcctgcctcggcctcagccatgtagccccagccgcggcgagaggacagtcccgtccacgtgccgttgccaactcggcgctgggagcatcgcctacgatcgtgcatgtaggatgcaagctgctgctgcagatcttcgccgccgacagccagcagncggggcttctaaagctttcctgccaatccccagcctttttggttccagggcgcgcccccagaacccccccnnttttggggtgccccggaatccccccctaaaaccggggcccccccgggggctttaaaaaaagggccccgagaaaaggggcacctcccggggggggctttggggacaacccccccccgttttccccccggggggggaaaggggggggagaaaaaanaa

SEQ ID NO: 68044 - protein, 126 aa, Zea mays
  misc_feature: Ceres CLONE 1543471
  misc_feature (94)..(94): Xaa is any aa, unknown, or other
  misc_feature (118)..(118): Xaa is any aa, unknown, or other
MMQHLRLSQPSPCLCGLRAARPMLALGAAASRSRPAGKLQPSACLGLSHVAPAAARGQSRPRAVANSALGASPTIVHVGCKLLLQIFAADSQQXGLLKLSCQSPAFLVPGRAPRTPPXLGCPGIPP

SEQ ID NO: 68045 - DNA, 643 bp, Zea mays
  misc_feature: Ceres CLONE 1543475
  misc_feature (260)..(260): n is a, c, t, g, unknown, or other
  misc_feature (373)..(373): n is a, c, t, g, unknown, or other
  misc_feature (579)..(579): n is a, c, t, g, unknown, or other
agctccccgcggtggcggccgctctagaactagtggatcccccgggctgcaggaattcgtctcacccctagaaaaagcgctcctctgtctcggcgacgactgtgctaccgccgccgccgccgcaagacttcgtcgggcactttgccggcgacgatttcccaccaggtgcttgctatggaacttttgaggcgttcagatacaagatccctggattgctaaagatcagatacattgggcaaaccaccgttggcagcgctgcnatttttgggcttttcttgggggctgggagcttgattcactgtggaaaatcctactagtttgtttcccttttttttttctgaagtctgaacacacctttgtcgatgggcttccntgaaaactattcaatgcctgtttcatgtaacagctaatagctcagggttggaaaagaacaatcaagttatgtcctagttttggtgtggatggaaatagaatcaacgttcatctgcaaaaaaaaaaaaaaaacgagacgctcgaggtacccaattcgccctatagtgagtcgtattacgcgcgctcactggccgtcgttttacaacntcgtgactggggaaaaccctggcgttaccccacttaatcgccttgcagcacatccccctttcgg

SEQ ID NO: 68046 - DNA, 638 bp, Zea mays
  misc_feature: Ceres CLONE 1543478
  misc_feature: Translation starting site: 358
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaaacttcgtcgtcgtcgcacggattggcattggctgccctccggccctgttcctcgtcctcctcatcaaatcccgtctcctcagtcctcccaataatggtggcgtggtgagaaatccttccgtccggccgtcgtcttagaagatgaactgttcctcttgctgcgccgctgccactccatcttctccggcgcttctcgccaggccgcgggtgagcgcactcctgtccccttctccccaccgccgcatcatctttttcttccttcttcgcgagcgcgctatatgcatccgccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatt

SEQ ID NO: 68047 - DNA, 653 bp, Zea mays
  misc_feature: Ceres CLONE 1543495
  misc_feature: Translation starting site: 126
  misc_feature (310)..(310): n is a, c, t, g, unknown, or other
  misc_feature (314)..(314): n is a, c, t, g, unknown, or other
  misc_feature (360)..(360): n is a, c, t, g, unknown, or other
  misc_feature (498)..(498): n is a, c, t, g, unknown, or other
ctccccgcggtggcggccgctctagaactagtggatcccccgggctgcaggaattcgtctcacccctagaaaaaacttcccgaaccctaccggcggcgcagcagcatcacaaccaccacccgaagatggtgaagtttctgaagcccggcaaggccgtaatcctcctccagggcagattcgccggccggaaagcggtgatcgtgcgcgtgttcgaagagggcacccgcgaccgtccctatgggcactgcctcgtcgccggcctggccaagtacccccagaagtgatccgcaaggactccgccaagaagacngccnagaagtccccgcgtcagtgctttcatcagctcgtcaatttcactcnactcatgcccacccgctacaccctcgacgtcgacttcaaggacgtcgcctcgggcgggccccgacgcgctctccacccgggacaagaaggtcgaggcctgcaaggcccgcaaggccgcgcctcgaggaagaggtcccngaccccgcaagaacaggtggtttctttaccaagctcccgcttctaggccgccgggcaccccgcaatagggactggctttaatttgccaattttgttggtaccggaaaccttttaaactttctcctggttttgggtattgcccttttttaaggaat

SEQ ID NO: 68048 - DNA, 651 bp, Zea mays
  misc_feature: Ceres CLONE 1543498
  misc_feature: Encodes the peptide sequence at SEQ ID NO. 68049
tggagctccccgcggtggcggccgctctagaactagtggatcccccgggctgcaggaattcgtctcacccctagaaaaatccgtcccgatcccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcacaatccttggctacgtccccggaatcatctacgcgatctatgtccttgttgctctcgactctgaccagcacgagagggaatactacacccttgcttagagcatctggttgtgccaggcgggcctgcacagttgagtcgaaatcagtatttttttttctcatgtggattgtctgacatggcataagcggcaatggggtaccaagtgttgtggtctatatctctgttaccccacttgtgagctctcttttatgtgctccagttattcaatctgtatttgtgaactacaggagataggatgcccatgtatcttcgaaaaaaaaaaaaaacgaggcgctcggggacccaattcccctaaagtgatcctataacccccgctactgcccgtgttttcaacgtcggactgggaaaacctggcgtc

SEQ ID NO: 68049 - protein, 72 aa, Zea mays; identical to SEQ ID NO: 51501
  misc_feature: Ceres CLONE 1543498
  misc_feature (7)..(58): Pfam Name: UPF0057 Pfam Description: Uncharacterized protein family UPF0057

SEQ ID NO: 68050 - DNA, 766 bp, Zea mays
  misc_feature: Ceres CLONE 1543504
  misc_feature: Encodes the peptide sequence at SEQ ID NO. 68051
  misc_feature (24)..(24): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttgggtggtgttttccttttctnctgggcgcggnnagattnnnnnnnnntttttggagtccccgcggtggcggccgctctagactagtggatcccccgggctgcaggaattcgtctcacccctagaaaagcgaccccaggtcagtcgggactacccgctgagtttaagcatataaataagcggaggatgaagatgatgacgagtgatggagctcctcgagacaatggaccgtgcttcatccaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggcgtgtttgtgtgtgggcacacttgccagccagcagaggcgcctgcttgtacccaaattactgtttccattgtgcgtcatcatcgggctaacattggcactaatgtccggtttggggtaatgcttcaaaaaaccgcaatatattataaatataacgaggcccctcgaggtaccccaatttcccccctattaggggagtccgaattacccccccgctccactggccctttcgttttttctaccctcccagaagtggggaaaaaacccctgggggtttacccccgacttgtattcggctttgtcagatataattcccctctttttgctcagggctggggggaaatgtgcg

SEQ ID NO: 68051 - protein, 61 aa, Zea mays
  misc_feature: Ceres CLONE 1543504
MKMMTSDGAPRDNGPCFIQQWSGYTRPRGDHKKGAYIHVLELFSFTPHRDVLFLLLSCYNG

SEQ ID NO: 68052 - DNA, 627 bp, Zea mays
  misc_feature: Ceres CLONE 1543506
  misc_feature: Encodes the peptide sequence at SEQ ID NO. 68053
  misc_feature (538)..(538): n is a, c, t, g, unknown, or other
ctccccgcggtggcggccgctctagaactagtggatcccccgggctgcaggaattcgtctcacccctagaaaaagtccgcaaacccctctcgatcgacacacgcagccgcgacccatcgagacctgacccgatcctcccgaggccgccagccttatcctctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcnagctgcagctaagaccaacgatcttgctggagatgggacaaccacctctgtggtccttgctcaggggctaattgctgagggggttaggg

SEQ ID NO: 68053 - protein, 139 aa, Zea mays
  misc_feature: Ceres CLONE 1543506
  misc_feature (110)..(110): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRXAAAKTNDLAGDGTTTSVVLAQGLIAEGVR

SEQ ID NO: 68054 - DNA, 632 bp, Zea mays
  misc_feature: Ceres CLONE 1543507
  misc_feature: Encodes the peptide sequence at SEQ ID NO. 68055
  misc_feature (573)..(573): n is a, c, t, g, unknown, or other
  misc_feature (618)..(618): n is a, c, t, g, unknown, or other
ctccccgcggtggcggccgctctagaactagtggatcccccgggctgcaggaattcgtctcacccctagaaaaaaggcccacatggcagcctctgcactgcaggatctcatcccctccggctgcccgtgcccagacgtcgtggcgcggcggcggcggtcggtctggtagggctcccctcctttccaccagagcagaacatatagtcatagatcagtgtcacaccacgacccgccagccagaccgccacttgccaaccaacgcctttccctcctcctcctccgcctccgggcgctagcgggaatggacgccgccgagctgcccctcgtctaccacatcggcctggtgctggccgcgctctgggccgccgccgccgtcggcttccgcggctccctcctctacctcctcgccttcctctacctctacatggtaaatgctcgctgtgcagtgagactgcggaagaggatacaacatgaagagatgaaatctgcctaccaacgaaggctcctctctgatgcagaatcagcacgctggttaaaccatgcaatcgacaagatgtggcctgtctgtatggnagaagatcgtttcaaaacttctacggcccatcataccatggttcnttggataagttcaa

SEQ ID NO: 68055 - protein, 110 aa, Zea mays
  misc_feature: Ceres CLONE 1543507
  misc_feature (91)..(91): Xaa is any aa, unknown, or other
  misc_feature (106)..(106): Xaa is any aa, unknown, or other
MDAAELPLVYHIGLVLAALWAAAAVGFRGSLLYLLAFLYLYMVNARCAVRLRKRIQHEEMKSAYQRRLLSDAESARWLNHAIDKMWPVCMXEDRFKTSTAHHTMVXWISS

SEQ ID NO: 68056 - DNA, 624 bp, Zea mays
  misc_feature: Ceres CLONE 1543508
  misc_feature: Encodes the peptide sequence at SEQ ID NO. 68057
  misc_feature (397)..(397): n is a, c, t, g, unknown, or other
  misc_feature (435)..(435): n is a, c, t, g, unknown, or other
ggagctccccgcggtggcggccgctctagaactagtggatcccccgggctgcaggaattcgtctcacccctagaaaagtttgtggcgtgcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaaggactcaggcaatggccgcgttggtgccactgcagccgtctactctgccgccatcctggagtacttgactgccccgagtctggagctggctggnaacgctagcaggatctgaaggtgaagcgatccaccctnccacctaccgttggccattcccggaaaccaagaactgaaacccctcatcaaggcaccatcgcaagggtgaagggttcctcccccaaatccccaaatccttggattcacaagtcctccccggggggggaaaacttgggaatgcccctttggtagttttaaccgggaaattttcggggggcccccccgcgc

SEQ ID NO: 68057 - protein, 88 aa, Zea mays
  misc_feature: Ceres CLONE 1543508
  misc_feature (32)..(89): Pfam Name: Histone Pfam Description: Core histone H2A/H2B/H3/H4
MAGKGGKGLLAAKTTAAKSAEKDKGKKAPISRSSRAGLQFPVGRIHRQLKQKDSGNGRVGATAAVYSAAILEYLTAPSLELAGNASRI

SEQ ID NO: 68058 - DNA, 643 bp, Zea mays
  misc_feature: Ceres CLONE 1543509
  misc_feature: Encodes the peptide sequence at SEQ ID NO. 68059
  misc_feature (373)..(373): n is a, c, t, g, unknown, or other
  misc_feature (400)..(400): n is a, c, t, g, unknown, or other
  misc_feature (426)..(426): n is a, c, t, g, unknown, or other
ctcaccgcggtggcggccgctctagaactagtggatcccccgggctgcaggaattcgtctcacccctagaaaaactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaaagagtcgtcgtcgcagggcatccgctgcgactacatcggctccgccaccacctgatcatggtgacgacgacgacgctgatgctgttcgccgggcggttcngggctgggcgcgtcgggcgacccgcanggcgacggcggggctgaagctgggangcgcgcgactccgggctgcaaaacgggtgaccccggcggggtcaacctcgcccaaacgcttggcctgggggggccctcgggcaaattcctcgggggtcggatcgtgggtcgggctcaaaaaaaccgggggcccttgaaacaaattatcgggctgatccctaaggccgcccttgtttaaaattaaaaccaaaagcctcaattcgggccccccgggcgg

SEQ ID NO: 68059 - protein, 53 aa, Zea mays
  misc_feature: Ceres CLONE 1543509
MASQLSAAVPRFHGLRGYAAPRSAVAALPSVRVGRKESSSQGIRCDYIGSATT

SEQ ID NO: 68060 - DNA, 753 bp, Zea mays
  misc_feature: Ceres CLONE 1543516
  misc_feature: Encodes the peptide sequence at SEQ ID NO. 68061
  misc_feature (753)..(753): n is a, c, t, g, unknown, or other
tagacctggagctccccgcggtggcggccgctctagaactagtggatcccccgggctgcaggaattcgtctcacccctagaaaaaatttctaacaagttcatccgaggcctctgcggtgacccgcagaccgagcagctggccttcgagggctacaggagggcgctgctgcagcccgagttccggctggagaagaagacggccaacgcgctgaccctgcagctgatcagggagaagcagtggggctccctggagctgctggtcgaggacttcagggcccacggcgtgctcccggagaagcggacgtgcgcgcggctcgtcgcctgctgcatcagggcggggaggttcggcctcgccgacgcggtgctcggggtcctcgaggcgaagaagggagcccccgctgccatggccttcaccccggccatgcaggcgtacaacaggctgcacatggtcccggaaaacggtgcttctgtacgggcagccaagggtggcccgggttgcccttaaccccaacccctaccggtgccccaatggcggcttgccgcgcgcctgggcgaacccgaaactggggcctatcgctggtcaaagcggaacaggggccccccaaggggtgccccccccgaaaagcgtgcggtgagaacttacgggggctcttctcgccaagccccttgggaaaaagcttgcgctaaaccccctgtaaccctcctgtccggcctctcgtcccctaataatggaaaacggcaatggggcccccn

SEQ ID NO: 68061 - protein, 167 aa, Zea mays
  misc_feature: Ceres CLONE 1543516
RPGAPRGGGRSRTSGSPGLQEFVSPLEKISNKFIRGLCGDPQTEQLAFEGYRRALLQPEFRLEKKTANALTLQLIREKQWGSLELLVEDFRAHGVLPEKRTCARLVACCIRAGRFGLADAVLGVLEAKKGAPAAMAFTPAMQAYNRLHMVPENGASVRAAKGGPGCP

SEQ ID NO: 68062 - DNA, 808 bp, Zea mays
  misc_feature: Ceres CLONE 1543524-R
  misc_feature: SWISSPROT Homolog: EC 3.2.1.39 Glucan endo-1,3-beta-D-glucosidase
gacgattgggtactcgagcgtctcgtttttttttttttttttattttttttaaaaacaatatatagatacaatctcactctacttgtacattagacacatgtactaccgtccacagagctcacggcgacactgacagcgtccaatagttcttttacacgaagtcacactcacacgtcccagcctgtcccaaggcaggcagggcagctgaaaaggaacgggaaatttcttccggtacgacgaaacaaacaagaggatctgcactgcactgcactgcactacgctacaacacgccaaccacggcaacaaccgcaattattcggtccgcccagagcccttcccttgctgtagcctgtaggcacgcacaacctttttcactcggcaatccagtccatcgtgcgtgcgtggtactcgcaaaactaatcatgtgccacggggttggcaccgccgtgcgccgtgcattattggcctcccccggtgtacacgcatgccccgtagcttgggtcgtcggaggtgagcgtggcggacgcccggaagtcgcagttccacgggtgccgcccggccgcctggtacagctggttcacggcgtacgcggcgtgcgcgcgcaccgtgttgggctcgaagcaagcgccgccgggctggatggcgctgcagtcgacgcccacctgcgagcacgcgtagtccagggtccgcctgcagctccgcgtccgaagggccgggccgacgccacgtaacaacccggccgccccttggggctggggccgggtaccgcccccggcccccgtcccggaacccccggcgcggcggggt

SEQ ID NO: 68063 - DNA, 643 bp, Zea mays
  misc_feature: Ceres CLONE 1543524
  misc_feature: Encodes the peptide sequence at SEQ ID NO. 68064
  misc_feature (643)..(643): n is a, c, t, g, unknown, or other
ctccccgcggtggcggccgctctagaactagtggatcccccgggctgcaggaattcgtctcacccctagaaaaaagcggcgcccaggcatacgattccctgcgtcatctggctggccgacgggctgcgtgttttaacggctccactcctaacactggctgagctcagcccacacttggcctggcctcgttctgctgaagctcgacccgttccccctaatcttctccaatccctttcttctgggctctgacagggtgacgaatcccatgggcgccgcggcgaggaagcccgccgccgctggggtgttgccaatctggctctgcctcgtctgcgcgtcgagagcgcagccgtacatcggcgtcaactacggcgaggtggcggacaacctgccgtcggcggacgagacggcgaggctgctcaggtcgacgtccatctccagggtgcggctgtacggcgtggacgcggggctgatccgcgcgctggcggggtccggcatctccgtggtggtgggcgtggcaaacggcgacatcccctcgctggccgcggacccggcggccgcgtcccggtggctggccgccaacgtgctgcccttcgtcccggcgaccaccatctcccgccgtgccgtcggcaacgaggtgctggan

SEQ ID NO: 68064 - protein, 125 aa, Zea mays
  misc_feature: Ceres CLONE 1543524
  misc_feature: SWISSPROT Homolog: EC 3.2.1.39 Glucan endo-1,3-beta-D-glucosidase
MGAAARKPAAAGVLPIWLCLVCASRAQPYIGVNYGEVADNLPSADETARLLRSTSISRVRLYGVDAGLIRALAGSGISVVVGVANGDIPSLAADPAAASRWLAANVLPFVPATTISRRAVGNEVL

SEQ ID NO: 68065 - DNA, 723 bp, Zea mays
  misc_feature: Ceres CLONE 1543531
  misc_feature: Encodes the peptide sequence at SEQ ID NO. 68066
  misc_feature (652)..(652): n is a, c, t, g, unknown, or other
  misc_feature (723)..(723): n is a, c, t, g, unknown, or other
ctccccgcggtggcggccgctctagaactagtggatcccccgggctgcaggaattcgtctcacccctagaaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccnttgaggtcgagtcttctgataccatcgacaatgtcaagggccagatccaggacaaggagggcatccctccn

SEQ ID NO: 68066 - protein, 166 aa, Zea mays
  misc_feature: Ceres CLONE 1543531
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTIT

SEQ ID NO: 68067 - DNA, 644 bp, Zea mays
  misc_feature: Ceres CLONE 1543550
  misc_feature: Translation starting site: 199
  misc_feature (257)..(257): n is a, c, t, g, unknown, or other
  misc_feature (258)..(258): n is a, c, t, g, unknown, or other
  misc_feature (263)..(263): n is a, c, t, g, unknown, or other
  misc_feature (264)..(264): n is a, c, t, g, unknown, or other
  misc_feature (283)..(283): n is a, c, t, g, unknown, or other
  misc_feature (288)..(288): n is a, c, t, g, unknown, or other
  misc_feature (295)..(295): n is a, c, t, g, unknown, or other
ggagctccccgcggtggcggccgctctagaactagtggatcccccgggctgcaggaattcgtctcacccctagaaaaaagcgtctagcctctgcctgcgctcccacaccagaacaccacaccgctccgcgtgcgtcgcccgcactcctcgcctctgcccgtctgcctaccgtgccccgtgcgtgcgtgctccccaccgatgcagcccgcgaacgcgggcgtgccgagccacagccggaatgaagctcaggaacgttnncgcgnncgcccgtcgctgccccggntcccnggaaccngggccccctgaggggccggcaatttaggcgttcgcccccggcccgggcaaccgcggggggaaaagggccccaaacccccttttaaaatggaactcggtggcggccccgggcccctaaagaaaaaaaaatttgccccaaaaaaaagggggaaccccccccgggggggagaaaaaaaaaaaaaaaaaaaaaaaggtttttgtgaaaaaccccccccccggggtttgggggttcccccccccaaaaaaattttccccggggggagaaagggggccccccgggggggggaaattctcccggggggtttttaaaaccctttttgaaaaaaaaaaactttgggtcctcccaagag

SEQ ID NO: 68068 - DNA, 675 bp, Zea mays
  misc_feature: Ceres CLONE 1543554
  misc_feature: Encodes the peptide sequence at SEQ ID NO. 68069
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
tggagctccccgcggtggcggccgctctagaactagtggatcccccgggctgcaggaattcgtctcacccctagaaaaagactactgcataaggctggtcggtctgtaacctgatccgagagtctgtctgttggtaaaaaattaattgactactggaatttgttgacttggtatctgaaagattttatttttatttgtgtgtgaagttttcnnnnnnnnnnnnnnnnnnnnnnnnnnnnnnnnnngaaaaaaaaaaaaaaaaccgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagccgccataatagcgaagaggccggcaccgatcgcccttcccacagttgcgcaccctgaatggcaaatgaaaattgtaagcgtttattattttgtaaaaatccgcggtaaattttttgtaaaatcacctcatttttttaaccaataggcccgaattcggcaaaattcccttataattcaaaaagaataaacccgagataaggtttgagggtttttcccagttttggaacaaaaaatcccctttttaagaaaacgtggcactccaacctcaaa

SEQ ID NO: 68069 - protein, 35 aa, Zea mays
  misc_feature: Ceres CLONE 1543554
GAPRGGGRSRTSGSPGLQEFVSPLEKDYCIRLVGL

SEQ ID NO: 68070 - DNA, 621 bp, Zea mays
  misc_feature: Ceres CLONE 1543559
  misc_feature: Encodes the peptide sequence at SEQ ID NO. 68071
  misc_feature (518)..(518): n is a, c, t, g, unknown, or other
ctccccgcggtggcggccgctctagaactagtggatcccccgggctgcaggaattcgtctcacccctagaaaaagcataggccgtcgagttcagtcactccgctactgtagtactgtcttaaaccctcgtcgtcgtctttccgccgcccgtcgcttcgttcctcgcttccccccacaggcccacactctcgcgcgcatcacggcggcggcggcgaatcaccgcgtggccctccacctaagtcctagcccaagcgtaagcgatcgctctccccatcagccaccatggcgccacgcccccgcaagcgggcctcgcgccccaagccccgcccgggctcccgacgtggcggcggcggaggggacgactatcccttctttgagtccgagcccaagcgccgccgtggaggccgtgacgaggacatcgagagcgaggacagcgacgacgacggcgtggctgcgtttgggggcggatttggtaaggatggggacgagcgcggtagggaggaggaggacgaggaacngtgggggggagaagaagatgcggatgacgaaggagtggctgaagaaggtcactgaggtcgctaagagggggcaggaggatgacgaggaggacgagtcgggagg

SEQ ID NO: 68071 - protein, 96 aa, Zea mays
  misc_feature: Ceres CLONE 1543559
  misc_feature (79)..(79): Xaa is any aa, unknown, or other
MAPRPRKRASRPKPRPGSRRGGGGGDDYPFFESEPKRRRGGRDEDIESEDSDDDGVAAFGGGFGKDGDERGREEEDEEXWGGEEDADDEGVAEEGH

SEQ ID NO: 68072 - DNA, 587 bp, Zea mays
  misc_feature: Ceres CLONE 1543560
  misc_feature (227)..(227): n is a, c, t, g, unknown, or other
  misc_feature (271)..(271): n is a, c, t, g, unknown, or other
  misc_feature (272)..(272): n is a, c, t, g, unknown, or other
  misc_feature (279)..(279): n is a, c, t, g, unknown, or other
  misc_feature (283)..(283): n is a, c, t, g, unknown, or other
  misc_feature (284)..(284): n is a, c, t, g, unknown, or other
  misc_feature (296)..(296): n is a, c, t, g, unknown, or other
  misc_feature (352)..(352): n is a, c, t, g, unknown, or other
  misc_feature (357)..(357): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (508)..(508): n is a, c, t, g, unknown, or other
  misc_feature (511)..(511): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
cgcggtggcggccgctctagaactagtggatcccccgggctgcaggaattcgtctcacccctagaaaactcccgacgccatccccacgaacgccttctccgacaccgtctccgctccgccgtcttctccgacgtcgtcaacttcccctcgacaagagtgcaaagtggaaacaacacatgaagtcgacatggagaagggaaaatgcactacagtccacatgaaacttngtgaaaaagaattaaatccccaagttcccctatgagagacttgnnatacagntttnnatgtatatgccnatctatttgtgtgaaatggaatgaccttgatgaatggataggctccccaatgcttnagttngctgctgccgcctcagtttgctaccggagaggcttcacccgcaattaccacctttatttgcccacaaacatttgggatattggtaaaagttggattggttattgggtaaaccccttttttttnnnnnnannnnnnnnnnagaannnnaggnaanaaagaaaaaaaaagnannaaaaaaaaaaatattttttttaaaaaaaaaagcggggagccttgggggcgcccttttt

SEQ ID NO: 68073 - DNA, 692 bp, Zea mays
  misc_feature: Ceres CLONE 1543561
  misc_feature: Encodes the peptide sequence at SEQ ID NO. 68074
  misc_feature (270)..(270): n is a, c, t, g, unknown, or other
  misc_feature (276)..(276): n is a, c, t, g, unknown, or other
  misc_feature (404)..(404): n is a, c, t, g, unknown, or other
  misc_feature (407)..(407): n is a, c, t, g, unknown, or other
ctggagctcaccgcggtggcggccgctctagaaatagtggaacccccgggctgcaggaattcgtctcacccctagaaaaacccgttcgcctctcaccttttcgctgtactcactcgccacacacaccccctctccagctccgttggagcctccgaacagcagcaggcgcggggcggtcacgtagtaagcagctctcggctccctctccccctgctccatatgatcgtgcaacccatcgagctacgcgcgtggactgccttccctgggtcngcgcangagggggatcgaaggatgacggcatcggttcccaagggcatctgcgtacagaacgccggctcaaaatggcccaggaccagggaagcgacctctttcccccgcgattggttcaaaggccgaggcccccnaancccaaacccccggggtattccgctccaaatcggggcgggaaggggccacaattgctcccccctaaaaggcctcctttaacccccccccaaacaagaacaaaaaaaggggttcccccttgcgcagggccaaaaacgggggcccaaaacccttaaaaaccttttggggcgaaaggggccaacctgggggaaaatgggaaaatttgggttttggtgcccccccgggttccagggttccaagaggggggttccccaattacccgaaaacccggggggcccccccccccc

SEQ ID NO: 68074 - protein, 64 aa, Zea mays
  misc_feature: Ceres CLONE 1543561
  misc_feature: SWISSPROT Homolog: EC 2.7.9.1 Pyruvate, phosphate dikinase
  misc_feature (38)..(38): Xaa is any aa, unknown, or other
  misc_feature (39)..(39): Xaa is any aa, unknown, or other
MTASVPKGICVQNAGSKWPRTREATSFPRDWFKGRGPXXPNPRGIPLQIGAGRGHNCSPLKGLL

SEQ ID NO: 68075 - DNA, 864 bp, Zea mays
  misc_feature: Ceres CLONE 1543563-R
attgggtacctcgagcgtctcgtttttttttttttttttggttccttggaccagtgattaacagtagtatcatcatatcatatatagtagtatacataataacagctagctagaagcagcagcagatgcatgcaggtggtagctaataacaaaaggtagtgataaaagctagtagtactctgatttagtagcaagaagaaagaaagaacgaacgaacaaattaaacagatggcgcccagctcgcatcgtatgtcctgtggtcgtcgcatccatggcgccatgcatgcaatgcaatgcagctagctactcatcctcgtggccatggctttccacctcgtcgtcctgaccatcgccggccctccccttgccaatgccgtcctcctctccgtcgaaatcctcagcgccgccgtcctgtccaccttcattattagtgttattattattgcccccgccgccggaggcctgctccctgtccatcccgaaccccggcgggccgtagcgcacgtcggggtacttgaccaccgcgtccagcagctccgagctcgcctgctttgcctggcccaagcgggagtagaggcggtccagctcgtcgaagtaggggcacgtcttggcgtgccgcggccgcttcttgccgctctccttggccttgcggaaataccggttgatgttctcccacttctccttggcaacgcttgggggctgcggccctaagcccgcccgccagccattggggggggcttcaccttccctcccaaaagggggggcccctttgaacccccggggcttccctgggaaatacggcccccttcccatgccccccgttcccgccaacccccggtgattctaaacgggccctctccaatc

SEQ ID NO: 68076 - DNA, 888 bp, Zea mays
  misc_feature: Ceres CLONE 1543563-R2
acgtgattacagtagtatcatcatatcatatatagtagtatacataataacagctagctagaagcagcagcagatgcatgcaggtggtagctaataacaaaaggtagtgataaaagctagtagtactctgatttagtagcaagaagaaagaaagaacgaacgaacaaattaaacagatggcgcccagctcgcatcgtatgtcctgtggtcgtcgcatccatggcgccatgcatgcaatgcaatgcagctagctactcatcctcgtggccatggctttccacctcgtcgtcctgaccatcgccggccctccccttgccaatgccgtcctcctctccgtcgaaatcctcagcgccgccgtcctgtccaccttcattattagtgttattattattgcccccgccgccggaggcgtgctccctgtccatcccgaaccccggcgggccgtagcgcacgtcggggtacttgaccaccgcgtccagcagctccgagctcgcctgctttgcctggcccaagcgggagtagaggcggtccagctcgtcgaagtaggggcacgtcttggcgtgcgccggccgcttcttgccgctctccttggccttgcggaagtacttggttgaatgtttctcccacttctccttgcaaggcattggcgctgcggcccgtatgcccgtccgccgccattgcgagacgctcaccttcctcccacaagaggggccctttgaagccccggggctccctggaaaccagccccttcccaggcccccgtttcgctacctcggaataaaggggtccttccaaccctgggtggcttggggggaccaaccagccgaacagaagactctgaaaggtgtccaaaccggaaccccatgactccaacccctgtgagggggg

SEQ ID NO: 68077 - DNA, 677 bp, Zea mays
  misc_feature: Ceres CLONE 1543565
  misc_feature: Encodes the peptide sequence at SEQ ID NO. 68078
  misc_feature (49)..(49): n is a, c, t, g, unknown, or other
  misc_feature (264)..(264): n is a, c, t, g, unknown, or other
  misc_feature (267)..(267): n is a, c, t, g, unknown, or other
  misc_feature (301)..(301): n is a, c, t, g, unknown, or other
  misc_feature (333)..(333): n is a, c, t, g, unknown, or other
  misc_feature (418)..(418): n is a, c, t, g, unknown, or other
  misc_feature (424)..(424): n is a, c, t, g, unknown, or other
ttcaccgcggtggcggccgctctagaactagtggatcccccgggctgcnaggaattcgtctcacccctagaaaaacctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttncancgcgctgccgcctacgcctcttcccgcgcggccnatgcggcacctgccaccccgccgcctggcacngggaagaccgggggcgggcagatcaccgacgagttcaccggcgctgggcgccatcggcatgtgtgccaggtgatcggcggcgtcnttgacntgccccttcgatgagggcctcccggcaatcctcaggggggctgaggtgcttgaaaaaaaatttccccctggggttcaaggggggcccaccccccttggaaaaaaagggggggccccccccccttttggacggcccgaaggggtttttcccggggaaaaggtgccccaaaaatggggcccccccaacccgggggtgtggggggggggcccccctggggcccaataaaatgttttttggggaacacctatggaaa

SEQ ID NO: 68078 - protein, 98 aa, Zea mays
  misc_feature: Ceres CLONE 1543565
  misc_feature: SWISSPROT Homolog: EC 3.6.3.14 H(+)-transporting two-sector ATPase
  misc_feature (41)..(41): Xaa is any aa, unknown, or other
  misc_feature (42)..(42): Xaa is any aa, unknown, or other
  misc_feature (54)..(54): Xaa is any aa, unknown, or other
  misc_feature (93)..(93): Xaa is any aa, unknown, or other
  misc_feature (95)..(95): Xaa is any aa, unknown, or other
MASRRVVSSLLRSASRLRAASPAAPRPRAPPHRPSPAGYLXXRAAAYASSRAAXAAPATPPPGTGKTGGGQITDEFTGAGRHRHVCQVIGGVXDXPLR

SEQ ID NO: 68079 - DNA, 749 bp, Zea mays
  misc_feature: Ceres CLONE 1543566
  misc_feature (294)..(294): n is a, c, t, g, unknown, or other
gcggtggcggccgctctagaactagtggatcccccgggctgcaggaattcgtctcacccctagaaaaagattctgccttttttgttccgtgatatttctcgattttggttcttggtctctgtaagatatggttttgtgtaaatggttttatcaagtgacgaggacaagttcgatcgtactaattggtagcagtgacaggtgctggttactgatgccctggccatctccagcaggcaacgtaaacagccgtgtaaaaatactgttttacgttacagattgtaatgtttgcaaacnaaaccaataacccgactagacacatgaatattatatgaacatccatcttatttaccgaattttagtgtttaaaaaaaaaaaaaccgagcctcttttaggtaccccaattcccccctacaaggggattcgtattaacccgccgcttccgtgggcccgccgttttaaaaaacctctcgggacctggaaaaaaccctctggcttttaccccaatttaaattccgctttgtccaacaaaatcccccctttttcgcacagcttgggtaaaaatccccaaaaaaagggccccccatccgaaacctccctttccaaaaatattttgacccccccctgtaaagcgcggaaaagggaaaatatttgaacccccctctaataattttctttgtaaaaaatttcccccactatatatattttgcgaaaatataatccatctctttttttttataacaccgtagggg

SEQ ID NO: 68080 - DNA, 678 bp, Zea mays
  misc_feature: Ceres CLONE 1543570
  misc_feature: Translation starting site: 159
  misc_feature: SWISSPROT Homolog: EC 4.1.2.13 Fructose-bisphosphate aldolase
  misc_feature (359)..(359): n is a, c, t, g, unknown, or other
  misc_feature (678)..(678): n is a, c, t, g, unknown, or other
acagctggagctccccgcggtggcggccgctctagaactagtggatcccccgggctgcaggaattcgtctcacccctagaaaaagcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccantacatcaccgcccgtgatcctcggcgaggagaccctgtaccagaagaccaaggatggcaagccttttgttgatgtcctcaaggagggaggcgtcctccctggcatcaaggttgacaaaggcaccattggagttgtttgcactgataaggagaccccccacccaggccatggacgaccttggcaagcgctgcccccaatactacgaaggccggggccccctttgcccaggggcgcgcctgttctcaagaatgggcccaatgaacccttccagcttgtcctccaactggaaggcccggggtccgggtcccttataccatcn

SEQ ID NO: 68081 - DNA, 719 bp, Zea mays
  misc_feature: Ceres CLONE 1543580
  misc_feature: Encodes the peptide sequence at SEQ ID NO. 68082
ctccccgcggtggcggccgctctagaactagtggatcccccgggctgcaggaattcgtctcacccctagaaaaagatcctccgagcacaacagctctccgtcgccgtcgccatgggtaaggttcacggatcgcttgcccgcgcggggaaggtgcgtgggcagacgcccaaggtggcgaagcaggacaagaagaagaagccccgcggccgcgcgtacaagcgcatgcagtacaaccgccgcttcgtcaccgccgtcgtcggattcggcaagaaacgcggccccaactcctcggagaagtagatatagccatgtctttgtgttttgatcccccactagtttccttgtactgatggcaagttgctgaagacttatatgctattattatctgtatcgatgtgttaccgcaacactatgaaatatggtatgcatcgttgagctaaaaaataaataaaccgcgcggtcaaagacggtacgttttgtgggcgcgggtgctcttcgtcctctgtgggaacaaacacaaaaaaggcggagaccctcggggggccccaacttccccccctaagggggaggccgaattcccccgcccccccccggggccgccgttttttttacaaccggcccctgcgctggagaaaaaacccccggggggtgttacccccaacctttaaacccgcccttttggacaaaccacacccccccccttttctgcgccccgggtg

SEQ ID NO: 68082 - protein, 62 aa, Zea mays; identical to SEQ ID NO: 7091
  misc_feature: Ceres CLONE 1543580
  misc_feature (3)..(61): Pfam Name: Ribosomal_S30 Pfam Description: Ribosomal protein S30

SEQ ID NO: 68083 - DNA, 644 bp, Zea mays
  misc_feature: Ceres CLONE 1543583
  misc_feature: Encodes the peptide sequence at SEQ ID NO. 68084
tggagctccccgcggtggcggccgctctagaactagtggatcccccgggctgcaggaattcgtctcacccctagaaaaacggttccccggtctcggactctcggtctcgcacgctccctccccatccccaattcggtttcgctccgccccggctgccgcacccatggcctcctcctcctcgctcttctcgccgtgcgccctcaccgccaagctcgggatagggcacgcgtcctatggctccggacgccgcgccaacttgcgccggcgcggccgcctctcggttgtggccgtacagacgggcccgcagaagccgtctccgtcgtcgtcccaggccgccgcggcggaggatgaggcggatgcgctgcagaagcttctgaagagggagtacaagtacgggttcgtatccgacttcgagtccttctccatccccaaggggctgtcggaggccaccgtccgccgcatctcggagcttaaggcggagccggcgtggatgctggacttccgcctcgccgcctaccgccgcttcctcaccatggtcgagcccacctggagcgacaacgagtacgcgcccgtggacctgcagtccatttgctactactccgcgcccaaaaccaagcccaagctcaatagcctcgacgaggtcg

SEQ ID NO: 68084 - protein, 160 aa, Zea mays
  misc_feature: Ceres CLONE 1543583
MASSSSLFSPCALTAKLGIGHASYGSGRRANLRRRGRLSVVAVQTGPQKPSPSSSQAAAAEDEADALQKLLKREYKYGFVSDFESFSIPKGLSEATVRRISELKAEPAWMLDFRLAAYRRFLTMVEPTWSDNEYAPVDLQSICYYSAPKTKPKLNSLDEV

SEQ ID NO: 68085 - DNA, 631 bp, Zea mays
  misc_feature: Ceres CLONE 1543587
  misc_feature (557)..(557): n is a, c, t, g, unknown, or other
cggtggcggccgctctagaactagtggatcccccgggctgcaggaattcgtctcacccctagaaaaatggtaaccattactcattttaaagtttcccatggtgatctaatatcttttaaagaaaatgacgcgagaacccgcggtgaagaaataaggagatctttctatatcgacatattagttggaaaaatcataggcaaattcctaccggtcagaatctggagaagaacaaaaacagaatggtttcgcttactcacaactcagaggggatgccgcttactactaaaatccgggtttttgcaagagttgcgttcttatatgcaagaagaagacttagaaagaacaaagaagtttggatccgcaaaagtatgcttaggcagttccttcgctgagcacaacagaatgaagaggaatttgtttcatttcaaaatacttcttcttatggaaaaaaaaaaaaaaaaacgagacgctcgaggtacccaattcgccctatagtgagtcgtattacgcgcgctcactggccgtcgttttacaacgtcgtgactgggaaaacctgncgttacccaacttaatcgccctgcagcacatccccctttcgcaagctgggcgtatagcagagaagcccgcaccg

SEQ ID NO: 68086 - DNA, 705 bp, Zea mays
  misc_feature: Ceres CLONE 1543589
  misc_feature: Encodes the peptide sequence at SEQ ID NO. 68087
  misc_feature (1)..(1): n is a, c, t, g, unknown, or other
naaagctggagctcaccgtggtggcggccgctcttcatcagtggatcccccgggctgcaggattttctcctcacccctagaaaaagcgacgcgcatttgttgagaggcggcctactacgaactaccgtcgatggcgttcctcgcgcctccgcagttcaagtggcccctttccacccgtgcggcggcggtgttcagggagcccaccggcggcgcaggctcccgccccagtcggataaactgttctttctcctccacggcagtcgtcgatgcagagtgcttatccgtcgggccgccgccttctcctcaccgaacgcttccggtaacgtctgtctccaccccatccgcctcagctctgtggctgcaaatctcagtacgggttggagaggaccggcaaatttttgtaaactgttcgtctcccttcgattgcctcaaccagggctgtttcggtgaggcacttcttaacaggaggcagtggtggcgggccgcggccgcgaagccgtcgctctggctcgcgcagcggccgaggtcgccgggagagtcgcccggatggcgcagaatgatcacccggctgccttaccgcggcgatgacacggtggataccttcctgtcaagaaagtcctccgctccaaagtggggctggatgcaaggcccccggggctctcaaaatgctggagggcaaaaacccacaacattttccgcgaacaa

SEQ ID NO: 68087 - protein, 191 aa, Zea mays
  misc_feature: Ceres CLONE 1543589
MAFLAPPQFKWPLSTRAAAVFREPTGGAGSRPSRINCSFSSTAVVDAECLSVGPPPSPHRTLPVTSVSTPSASALWLQISVRVGEDRQIFVNCSSPFDCLNQGCFGEALLNRRQWWRAAAAKPSLWLAQRPRSPGESPGWRRMITRLPYRGDDTVDTFLSRKSSAPKWGWMQGPRGSQNAGGQKPTTFSAN

SEQ ID NO: 68088 - DNA, 635 bp, Zea mays
  misc_feature: Ceres CLONE 1543591
  misc_feature: Translation starting site: 259
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaatcccgcctcacaccgccgcaaggactcgcgacggacggagcaacggaggaagcaactacgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtttgttttgctgatgcaattaattcttaagcaaatccatggcaacttgtttatcgctgatgcttgagggatggaaatgacactcagaataaatcttaaaaaaaaaaaaaaaaacgagacgctcgaggtacccaattcgccctatagtgagtcgtattacgcgcgctcactggccgtcgttttacaacgtcgtgactggggaaaacctggcgttacccaacttaatcgccttgcagcacatccccctttcgccagctgcgtaatag

SEQ ID NO: 68089 - DNA, 673 bp, Zea mays
  misc_feature: Ceres CLONE 1543593
  misc_feature (202)..(202): n is a, c, t, g, unknown, or other
  misc_feature (246)..(246): n is a, c, t, g, unknown, or other
  misc_feature (253)..(253): n is a, c, t, g, unknown, or other
  misc_feature (259)..(259): n is a, c, t, g, unknown, or other
  misc_feature (286)..(286): n is a, c, t, g, unknown, or other
ggagctccccgcggtggcggccgctctagaactagtggatcccccgggctgcaggaattcgtctcacccctagaaaaaaacgcaggctacttcccaaactgttttttcgatctattttctttttttttcggactgaagaactccaaatgccgtctacttctagtgctaatgatactagaccgcttggtccaccaaaatgacngatgtcagttaccactgcccagatctctggcgctcgctaccccngctggcnggggcngtgcccgcatccctcttcccgcccaangcccaaacggccggggccgaaggggggtcccgtggccccggcccctttttttcctttaaaaccccaaaacccggggcgcaaccccccgggaaatttttaaccaaaaggggtgggccgaaaacccgcccaaattaaccgcggccctttacccgggacccccacccgggaccccctttgaaatattccccctcccccgggggaaataaaaaaatattccccccccccccccttgaaaaaaatttttttttctaaacttctttttgggggggggtaacccaaaaaaaaaacccctgggggggggggggggggaaaaaaaaaattaaaataatcccccccccgggggggtgttttttttttccccccccatataagggggggggggggggc

SEQ ID NO: 68090 - DNA, 725 bp, Zea mays
  misc_feature: Ceres CLONE 1543605
  misc_feature: Encodes the peptide sequence at SEQ ID NO. 68091
  misc_feature (311)..(311): n is a, c, t, g, unknown, or other
  misc_feature (320)..(320): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
  misc_feature (341)..(341): n is a, c, t, g, unknown, or other
  misc_feature (348)..(348): n is a, c, t, g, unknown, or other
  misc_feature (377)..(377): n is a, c, t, g, unknown, or other
  misc_feature (396)..(396): n is a, c, t, g, unknown, or other
  misc_feature (432)..(432): n is a, c, t, g, unknown, or other
  misc_feature (452)..(452): n is a, c, t, g, unknown, or other
ggagctccccgcggtggcggccgctctagaactagtggatcccccgggctgcaggaattcgtctcacccctagaaaaagcagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttgggtgggtggcagcagccgtggcgagatggacctgatgatgccggtgacggtgaaggagagtggccnccccggaangagangnnaggaagagacctngaacccnggacgcgggacgctcccgcgcccgatggnagggccttgcacgaggtcngggccaccgccggttccctgaccaagacgttcgaanccttgttggccgaacccggncaccggaaagaaggtcatctccctgggggccggcgccgggcaacaagttttcctggggctggggatcccccaacttgtttcccccccccttgcttgctcccccaagggttcctttaaagaacaaaaaactttctcccaggtttttgtgcggcccagcttaaacacccctttgtgaaatggccccccaacaaagtaccccggccttgcgtccaattgcctgtcccggggaaaattcccctttccgggggggggttttttggcccccgtccccct

SEQ ID NO: 68091 - protein, 47 aa, Zea mays
  misc_feature: Ceres CLONE 1543605
GAPRGGGRSRTSGSPGLQEFVSPLEKAAGEERRHSSFLGFPFPFPAR

SEQ ID NO: 68092 - DNA, 683 bp, Zea mays
  misc_feature: Ceres CLONE 1543606
  misc_feature: Translation starting site: 232
  misc_feature (71)..(71): n is a, c, t, g, unknown, or other
  misc_feature (414)..(414): n is a, c, t, g, unknown, or other
ctccccgcggtggcggccgctcctagaactagtggatcccccgggctgcaggaattcgtctcacccctagnaaaaaccccgtccaacgcaaacgagagggaaagccgaagcgagtgcgagtgcggccctcagctgctgcagttgctcctgctcgtttctgcctgctcgtttctgcggcggcggcggcggcggcggcctagcacctgagcggggcggcgagaggggacggagatggatatcgcgcgggcggctgctggcgtggcctgctgcaaggagcaccagaggatctacgccgagtggttcgccctggccgacccagatggcgacggccgcgtcacgggcgccgatgccaccagcttttctcgcatgtccgcgctttcacgcgccgatctcaaagcaggtgtgggcgatcgncgattccaggcggcaggggtacctcggattcgccgagttcgtcacagcaatgcagctcgtgtctctggcccaggcgggaacgagatcacccaggacagtctgaaaccgtgaggtggttgatgagctactggctagatccaaaggctgttgggaaagagggtccccccgatgaaattgccccacctcaggcccaaggaccttccataattactgggtttggttcaaaaaaccccccaaaagggggcaatacccctcgaacgggggttacc

SEQ ID NO: 68093 - DNA, 647 bp, Zea mays
  misc_feature: Ceres CLONE 1543608
  misc_feature: Encodes the peptide sequence at SEQ ID NO. 68094
ctggagctccccgcggtggcggccgctctagaactagtggatcccccgggctgcaggaattcgtctcacccctagaaaaaagtcgtcccccccggccccgacccccctccgtttgccaacgactccgggctccactgtcgctcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccaggggtggcgacgtctatgctggggtgcccaaggattaccctgggccgaaaggtcaacgtcgaacaattccttccctgttctgcttgggcaacaaaactgcttcccaggggttggaaccggccaggtttttgaaaagggggcccccaaggacccatatt

SEQ ID NO: 68094 - protein, 159 aa, Zea mays
  misc_feature: Ceres CLONE 1543608
  misc_feature (45)..(159): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADDAVGTRWAVLIAGSNGYYNYRHQADICHAYQIMKKGGLKDENIVVFMYDDIAHSPENPRPGVIINHPQGWRRLCWGAQGLPWAERSTSNNSFPVLLGQQNCFPGVGTGQVFEKGAPKDPY

SEQ ID NO: 68095 - DNA, 635 bp, Zea mays
  misc_feature: Ceres CLONE 1543609
  misc_feature: Encodes the peptide sequence at SEQ ID NO. 68096
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
ccccgcggtggcggccgctctagaactagtggatcccccgggctgcaggaattcgtctcacccctagaaaaatcacgtgctatggaagacgagtggaattgatctccaagtgatgctgatggacgaagctaaagtggatgaatcaaacaagcaccaggatgagagatgctcaccaagtggtcatcatctaaccacactaacctagtgttatcccaggttgaaattttgttctgttgtggatggtgctaagtgccggtgggctcggccttcttatataagtatatcccatctttaacttctttattgaggattgtcacttaagctagcatgtattttaaaaactataaatattttatacattttaaattataattcttttgaatcactttcttttgtaatcactccgataattgtataatgtaaacttattgtaacatgtaatcattttgcaataaagaatttatttccgctgcannnnnnnnnnnnnnnnnnnnnnnnnnnnnnnnnnnnnnnnnnnnnnnnnnnnnnnnnnnnnnnnnnnnngaaaaaaaaaaaaaaaaccgagccgctcgaggtacccaattcgccctatagtgagccgtattacgcgcgctccctggccgtcgttttacaac

SEQ ID NO: 68096 - protein, 30 aa, Zea mays
  misc_feature: Ceres CLONE 1543609
MLMDEAKVDESNKHQDERCSPSGHHLTTLT

SEQ ID NO: 68097 - DNA, 675 bp, Zea mays
  misc_feature: Ceres CLONE 1543616
  misc_feature: Encodes the peptide sequence at SEQ ID NO. 68098
  misc_feature (75)..(75): n is a, c, t, g, unknown, or other
  misc_feature (78)..(78): n is a, c, t, g, unknown, or other
  misc_feature (87)..(87): n is a, c, t, g, unknown, or other
taggctcaccgcggtggcggccgctctagagtagtggatgccccgggctgcaggaattcgtctcacccctagaanaanaagaagtgngaaaactagggaaaaaaaagaggggtggagtgcgggggggaaatcttctcagcgctatacttcttggtagacgtcgtgagcctgcgctacgccttcgcgccgctgcggtgggtcggcatgaacgcgatgctggtgtacgtgatggccgcggaaggcgtcttcgagggcttcctcaacgggtggtactacgagagcaccaacaacactctggtttactgggtgaggaagcacgtgttcgtcaaggtgtggcactccaccagggtgggcatcctcctctacgtcctcttcgggcaaatcctcttctgggtgctcgttccccccccccctccaccggggttggcctcttatggaaactctagcggagcaaacggtagcatgctttttgtcttttcaatttgcacatgatacacccggtacgacccctcaaagtaactcgaacccccagttttgtttgaagaactcatttcaaatccaaaaaacaaaaaaaaccggaggcctccgagggcccccatttcccccaaagggaggccgataacccgcgcccacgggcggtgttttaaaacccgtgcgggggaaaaccctggcttc

SEQ ID NO: 68098 - protein, 95 aa, Zea mays
  misc_feature: Ceres CLONE 1543616
MNAMLVYVMAAEGVFEGFLNGWYYESTNNTLVYWVRKHVFVKVWHSTRVGILLYVLFGQILFWVLVPPPPPPGLASYGNSSGANGSMLFVFSICT

SEQ ID NO: 68099 - DNA, 624 bp, Zea mays
  misc_feature: Ceres CLONE 1543617
  misc_feature (518)..(518): n is a, c, t, g, unknown, or other
tccccgcggtggcggccgctctagaactagtggatcccccgggctgcaggaattcgtctcacccctagaaaaaagactcgagcccgtccgccgccttcgctgcgccgcctccgcctcctccatcgcacgccggctccgctgcctccatccgcgcacgtccgcctccactgtctccatccgctcgggagccgccgccctccgcgctaggcctcgcctccgtctggtctggattcttcgacacctgggcgctccgcgtcgccgacttctcgcaggcggagagtgaatttggagatccaacaaggaggctcctgtgtttgcttcccgcgggattcatgagtttgagctggacaaagtcagtttgacgaggacagagaatggcctatacgccgatttctacttggtaatttttttgtttgaagaaaacaggaggggttctatcctctgccgtgctttattaaagatgtaaatgaaacctggtacaaaccttcaagaaaaaatagaaaatgagaaagattacncaaaaaaaaaaaaaaacgagacgctcgaggtacccaattcgccctatagtgagtcgtattacccgcgctcactgggcgtcgttttacaacggcgtgactgggaaaa

SEQ ID NO: 68100 - DNA, 619 bp, Zea mays
  misc_feature: Ceres CLONE 1543620
  misc_feature: Encodes the peptide sequence at SEQ ID NO. 68101
caccgcggtggcggccgctctagaactagtggatcccccgggctgcaggaattcgtctcacccctagaaaaagcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctg

SEQ ID NO: 68101 - protein, 157 aa, Zea mays
  misc_feature: Ceres CLONE 1543620
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVP

SEQ ID NO: 68102 - DNA, 691 bp, Zea mays
  misc_feature: Ceres CLONE 1543624
  misc_feature: SWISSPROT Homolog: EC 2.8.1.1 Thiosulfate sulfurtransferase
ggagctccccgcggtggcggccgctctagaactagtggatcccccgggctgcaggaattcgtctcacccctagaaaaaagagaatcctgagttcatacagagtgttgatacgaaggttgggaaagatgcgaagataattgtggcatgctctacaggagggacactgaagccaacgcaaaatttccctgatgggaagcaatctcggtccctgatagctgcgtacttgttggtcctgaatggctacagcaacgtgtaccatctggaaggaggactttacacatggttcaaagaaggactaccagctgttgcaggagaagagtaagagagacattacgaacatagtgttcgcatgctggagagagtggagagtggagactagagttgcgaggacttgtagtgatgcccccgcttcacagtcacagggttgtcgattgttgtgtacggattgagatgtcgaagattttctcctgcaaatgtgatgctgtcctagatttttcccaaaaaaaaaaaaaaaacgagacgctccgagtaccccattcgccctatagtgagtcctattacccgcgctcactggccgtctttttacaacctctggaattggaaaaaccctgggcgttaccccaatttaatccccctttgaagcacatcccccctttttcccaatgtgggggaaaaaaaccaaaaaggcccc

SEQ ID NO: 68103 - DNA, 632 bp, Zea mays
  misc_feature: Ceres CLONE 1543630
  misc_feature: Encodes the peptide sequence at SEQ ID NO. 68104
  misc_feature (361)..(361): n is a, c, t, g, unknown, or other
  misc_feature (452)..(452): n is a, c, t, g, unknown, or other
  misc_feature (504)..(504): n is a, c, t, g, unknown, or other
ggagctccccgcggtggcggccgctctagaactagtggatcccccgggctgcaggaattcgtctcacccctagaaaagtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattagggatgccggttgctaggccggagccgcaggagccccgggtgatcgcccatgtcgacatggactgcttctatgttcaagtcgangcagcgaagaacccggcgctcaggggacagcgaccgccgtggtgcagtacaacggctggaaaaggcggcggcttgattgccgtcagctacnaagctcgtggatttgggggtggagaggtccatgcccggagatgaggccaagnaaggtatgtccctgttattaatcctggtcaggtcccaagtgcgcctgggaaaggctaactttatctttacaaaattgctggggcctaaggtggttgaaacccttgcagccaaagggatgcgaaagggg

SEQ ID NO: 68104 - protein, 71 aa, Zea mays
  misc_feature: Ceres CLONE 1543630
  misc_feature: SWISSPROT Homolog: EC 2.7.7.7 DNA-directed DNA polymerase
  misc_feature (27)..(27): Xaa is any aa, unknown, or other
  misc_feature (58)..(58): Xaa is any aa, unknown, or other
MPVARPEPQEPRVIAHVDMDCFYVQVXAAKNPALRGQRPPWCSTTAGKGGGLIAVSYXARGFGGGEVHARR

SEQ ID NO: 68105 - DNA, 733 bp, Zea mays
  misc_feature: Ceres CLONE 1543633
ggagctccccgcggtggcggccgctctagaactagtggatcccccgggctgcaggaattcgtctcacccctagaaaaaggaacagtgctgtagatccatgcaaagcttgtgctgctgcttatttattggcttcagagaagactatgtatgctgtatgcatatcccgtgtatgcttgcatttatgggatatttggtagtagggctccttcccttttaggatgctatattttcacctccagtcacacgttgcagatagatttcttatttctgaggtttatggtgatgtgaaaagactactggcaaaaaaactgggcattgctgttcctccctgaaactgagcggatgaaatttacttgaatgatctgtaaagctcccatttttcatttctaaaaaaaaaaaaaaaaccccaaccctcccagggaccccattcccgccctattagggaggtcgtattacgccgccctcccttggccgtcgttttttcaaccttcttggctggggaaaaacccttggcggttcccccaactttaattcgcctggtgagcccctttccccctttttcgcccgctttggggtaaaaagcaaaagagggcccggcaaccaattttccccttttccacaaaattttcccccccccccccaatggggggaatggggaaatttttgtttgccccccttttaattttttttgtataaaaaattccgccccttaaaaatttttttttttgtaaca

SEQ ID NO: 68106 - DNA, 633 bp, Zea mays
  misc_feature: Ceres CLONE 1543638
  misc_feature: Translation starting site: 84
  misc_feature: SWISSPROT Homolog: EC 3.2.1.23 Beta-galactosidase
tccccgcggtggcggccgctctagaactagtggatcccccgggctgcaggaattcgtctcacccctagaaaaaacttacctggatggggttgacgggcgatcaagaagcctcgtggcctaggccagtggcccacattgcacatggtgggtgcgctggcttaccatctccccaagtgggagagtggacgtcataatttgtggtagagggggtacgcgttcgcgcggcccccgcttaaaagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagacggagatagggttgagtgtttgtccagtttggaacaagagtccactatta

SEQ ID NO: 68107 - DNA, 700 bp, Zea mays
  misc_feature: Ceres CLONE 1543640
  misc_feature: Encodes the peptide sequence at SEQ ID NO. 68108
  misc_feature (660)..(660): n is a, c, t, g, unknown, or other
ctggagctccccgcggtggcggccgctctagaactagtggatcccccgggctgcaggaattcgtctcacccctagaaaattcatcatttatacggatcagcgcagtttgtcacacttgactgagcagcggctgcatacaccttggcaacagcgagtcttcaccaaattactgggcctccaatacaagatcgtgtataaaaaaggcgtcgaaaatggggctgcagatgcattgtctcggcgccctcctgctggcttagaagtgttcagcgcctccaccgctgccccccaatggctttctgaagtcatccagagctacagcaaggatcccaaagctaccaagcttataaccgaattatcagtccagacttcttcccaaggaccatactcgctccagcaagggttgatccgttataaaggtcgggtctgggtaggtgacaatgttcctcttcagcgccagattatgtcagcactacatgacagtcctcttggaggccattccggatttccagtcacataccgtcgtatcaagcaaatcttcgcctggcctaggctcaagcaatctgtccgtgactttgttgctgcctgttctgtctgccagcaagccaaaccagatcgcgctaagtatcccggcctccttcagcccttacccattccgacagncttggcaagtggtatcgctggatttcatcgagggcttacc

SEQ ID NO: 68108 - protein, 80 aa, Zea mays
  misc_feature: Ceres CLONE 1543640
  misc_feature: SWISSPROT Homolog: EC 2.7.7.49 RNA-directed DNA polymerase
  misc_feature (67)..(67): Xaa is any aa, unknown, or other
MSALHDSPLGGHSGFPVTYRRIKQIFAWPRLKQSVRDFVAACSVCQQAKPDRAKYPGLLQPLPIPTXLASGIAGFHRGLT

SEQ ID NO: 68109 - DNA, 711 bp, Zea mays
  misc_feature: Ceres CLONE 1543642
caaagctggagctcaccgcggtggcggccgcttcagaactagtggaacccccgggctgcaggaattcgtctcacccctagaaaaaatccagcctttcacacttccagccagccagcacacgcacactgttctttcgacttccatctcggccggagcagaagatggaggtggctctgggaacggccaagtatctccttggccatgttcagaacaatatctccgacgactggatgaattcctacgtgtccagcgccgagctcggcaccaaccttaacatgatcaaagagaagaatgcggtacgctagagtgctgctggacgtggccaagaggaagggacgacgtcgtcgccggggaccccaaccggctggagcagctcgagactctcggcaagaaggccgacgaaggctgaggatgccgtggacgagcttcactacttcatgatccaggacaaacacgacgggactcgagacgccgcaccggatttggggcggtggcctcgcagcccaagctcaccatgcccgccatgctgctcgccacactgctggtaaatactgtgaaaacctcttctaatacatgagatagttgaccttcatcgattctccagccaggatgatgttttattggatgatgtgtccggtcgtggttggcacaaaattcagtaggacattttcattggtgctacacgtcattcatgaccataaatgaaaacaa

SEQ ID NO: 68110 - DNA, 810 bp, Zea mays
  misc_feature: Ceres CLONE 1543643
  misc_feature (15)..(15): n is a, c, t, g, unknown, or other
  misc_feature (32)..(32): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ttgtggtgggttttntttttatttggctcccnncccccctcnnnannnnnnnnggaggtcccgcctttagtcgtctaataatcttcataacccccgggctgcaggaattcgtctcacccctagaaaaactcctctacgtgctcgacctcccctacttcttcaagtagaaatcatcaaagatgcgtatatatatagctccggccgatcctcctctctagctgcatggtatgtaggtggtgtggtccttgtttcatttcactccagcggtgatcagcgccgtgtataaatgtaattcctctgctttgcacatggatggattgggatgtaacctgttcaaaataaataaaaaaaaaaaaacacgaaaaaaaccgacaaaaccgagacgctcgaggtacccaattccgccctatagtgagcccctattagggcgcgcggcggtgggccgtcttttttcaaacgtcgtggactgggaaaaacccctggcggttaccccaatttaaatccgccgtgtgcagcacaatcccccttttttcgctcacctcgggcgtaaaataagcgaaaaaagggccccgctacccgaattgcccccttccccaaaaaggttgccgccaacccctaaaaatgcgccaaattgggagattagtcacccccgcctcatgatttttgtgtttaaaatttcccccgtttaaaattttgtgggctaaaattatacgccccatcttttgtttatacccattgtgcggcttgataatcgtggggaaaaaatccctcttactaatatctgcaaacgaaatatcttcccgacgttcc

SEQ ID NO: 68111 - DNA, 578 bp, Zea mays
  misc_feature: Ceres CLONE 1543645
  misc_feature: Encodes the peptide sequence at SEQ ID NO. 68112
  misc_feature (67)..(67): n is a, c, t, g, unknown, or other
aactggatccccgcggtggcggccgctctagaactagtggatcccccgggctgcaggaattcgtctncacccctagaaaaaacagtcggcatcacagaccagatccctgcgggtgcggcggccatggccgagaacttccagctgcaggccggcacggcagtcccgcgtcgcgtctccgcgtctggcgcgccccggcgcgcggggggcgacgtcatcgttgaatgggacgtcgccgtcagtatcgtcttcgactgcctccccctctacaccttcagggacaactccccccttcggtccccaccgattcattcagaacccgttgtatttcaggccaaagaatgcccggaattgggtcccctggaggaattcccgggatttcttggaaggatttccccccccctttcccccctagggttacaaagggcccccgggaacttttttgggggaacccccccttggggaacctctttttttttttttcccaccgaaaaaaccccccttccccaggggggttaaaaagtgttggtgttttgaaaaaacccccccccccaggggttttttttttttaaaaaaaaaat

SEQ ID NO: 68112 - protein, 130 aa, Zea mays
  misc_feature: Ceres CLONE 1543645
  misc_feature: SWISSPROT Homolog: EC 1.7.3.3 Urate oxidase
MAENFQLQAGTAVPRRVSASGAPRRAGGDVIVEWDVAVSIVFDCLPLYTFRDNSPLRSPPIHSEPVVFQAKECPELGPLEEFPGFLGRISPPLSPLGLQRAPGNFFGGTPPWGTSFFFFPTEKTPLPQGG

SEQ ID NO: 68113 - DNA, 652 bp, Zea mays
  misc_feature: Ceres CLONE 1543651
  misc_feature: Translation starting site: 286
  misc_feature: Pfam Name: RCC1 Pfam Description: Regulator of chromosome condensation (RCC1)
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaatcgcggccgccgcgcccgccggtctccacccctccccccaccccctgcttaaaatcccgcgtcccggtcgcgcaccccactccgcctccgctccccgctcgccgccgcgattgctggattggctgccgccagcgccccggtgctagctcccgttcctcgcggtggtcactggactagcctggacgccgcggcccgccgcctggtcgaagagatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtccgtcatctgcggcgccgaccacaccaccgcctactccgaggacgagctgcaggtctacagctggggctgggaagaactttgggaggctggggcacggcaactccagcgacgtcttcacgccccagcctgtcaaggcgctgcaggggctcaagatcaaacag

SEQ ID NO: 68114 - DNA, 690 bp, Zea mays
  misc_feature: Ceres CLONE 1543652
  misc_feature: Encodes the peptide sequence at SEQ ID NO. 68115
  misc_feature (350)..(350): n is a, c, t, g, unknown, or other
tggagctccccgcggtggcggccgctctagaactagtggatcccccgggctgcaggaattcgtctcacccctagaaaaaacctgtggcagtctcacggtgttggctccttcactgtgggtcgtggtgacctctgggtacgcaacttggcctgggtcgtgagatgaccctctacctcaaggatgatatcctggagcaccttgaggagcgcctcctcaagaatctcatcaagaagcactcccagttcatcagctacccgatctctctcctggattgagaagaccgctgacaatgatatctctcgatgatcaatatgacgaggataagaaggatgacgagcgcaaggctgagngatcttttatgatcgatcggcatgggctcctcgcgcgtgtggcgaggactgcgaacttctctctgcatcagcacttcgtgcccgatcttcccccctgctgcacctttgatggtgtggctgatgcccatagctgagtcggatgcctggcgccgatagcttttccccacggatgagggggacgacccaggccttatagcacctatctatttagggggctgcttggctcgccaggtaaacttagtggaacgacaagtagcccccgtttgccctctttgacccgagggtgatgggaagcaacgttttatttccttcttgcaccttgtcaaccgaattagacaaa

SEQ ID NO: 68115 - protein, 37 aa, Zea mays
  misc_feature: Ceres CLONE 1543652
MTLYLKDDILEHLEERLLKNLIKKHSQFISYPISLLD

SEQ ID NO: 68116 - DNA, 636 bp, Zea mays
  misc_feature: Ceres CLONE 1543653
  misc_feature: Encodes the peptide sequence at SEQ ID NO. 68117
  misc_feature (46)..(46): n is a, c, t, g, unknown, or other
  misc_feature (419)..(419): n is a, c, t, g, unknown, or other
  misc_feature (494)..(494): n is a, c, t, g, unknown, or other
  misc_feature (501)..(501): n is a, c, t, g, unknown, or other
  misc_feature (510)..(510): n is a, c, t, g, unknown, or other
  misc_feature (515)..(515): n is a, c, t, g, unknown, or other
ggagctccccgcggtggcggccgctctagaactagtggatcccccngggctgcagggaattctgtctcacccctagaaaaaatctcacgccgcaacctccctcgagcccgagcaaacaagggcggacgcggagccggcggcggagcggagatggcggagaagaagcgaggcgccggcactcgcaaggatgaggtggtgacacgcgagtacactatcaacctccacaaacgcctccacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgttagaattgcccgcatcggaacgatgangaagacgccaagggagaactctactctctggtcacagttgctgagatcccacccggaggtctcaaaaggttgggnaactaangtttgtgangatgnagattagcccctgataccatgagataaatttgagaatgttgctggagcttattgtatccactgccaatgactcctgttattagagcctcaagacttgtctcctttcagtaatccaaattcc

SEQ ID NO: 68117 - protein, 123 aa, Zea mays
  misc_feature: Ceres CLONE 1543653
  misc_feature (11)..(95): Pfam Name: Ribosomal_L31e Pfam Description: Ribosomal protein L31e
  misc_feature (90)..(90): Xaa is any aa, unknown, or other
  misc_feature (115)..(115): Xaa is any aa, unknown, or other
  misc_feature (117)..(117): Xaa is any aa, unknown, or other
  misc_feature (120)..(120): Xaa is any aa, unknown, or other
  misc_feature (122)..(122): Xaa is any aa, unknown, or other
MAEKKRGAGTRKDEVVTREYTINLHKRLHGCTFKKKAPNAIKEIRKFAQKAMGTTDVRIDVKLNKHIWSSGIRSVPRRVRVRIARIGTMXKTPRENSTLWSQLLRSHPEVSKGWXTXVCXDXD

SEQ ID NO: 68118 - DNA, 641 bp, Zea mays
  misc_feature: Ceres CLONE 1543656
  misc_feature: Encodes the peptide sequence at SEQ ID NO. 68119
ctccccgcggtggcggccgctctagaactagtggatcccccgggctgcaggaattcgtctcacccctagaaaatactgtactgtacttgtgtgatgacatcatatcttcgcgtcgcgtgtactgaagaactacacattgcactaactactaaggttgctttcgtacgtgtacgtgctcatctttcttccttggaaatcactcggatgtgccgccctttgcaaaatgaagcgatcccttgtttttcttcttctcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccacagttgcgcagcctgaatggcgaatggaaattgtaagcgttaatatttttgtaaaattcgcgttaaatttttgttaaatcagctcatttttttaaccatagggccgaaatcggcaaatcccttataaatcaaaagatagaccgagatagggttgagtgtttgtccagtttgaaacaagatccactttt

SEQ ID NO: 68119 - protein, 81 aa, Zea mays
  misc_feature: Ceres CLONE 1543656
  misc_feature: SWISSPROT Homolog: EC 3.2.1.23 Beta-galactosidase
MKRSLVFLLLKKKKKNETLEVPNSPYSESYYARSLAVVLQRRDWENPGVTQLNRLAAHPPFASWRNSEEARTDRPSHSCAA

SEQ ID NO: 68120 - DNA, 767 bp, Zea mays
  misc_feature: Ceres CLONE 1543663
  misc_feature: Encodes the peptide sequence at SEQ ID NO. 68121
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (26)..(26): n is a, c, t, g, unknown, or other
  misc_feature (47)..(47): n is a, c, t, g, unknown, or other
  misc_feature (52)..(52): n is a, c, t, g, unknown, or other
  misc_feature (54)..(54): n is a, c, t, g, unknown, or other
  misc_feature (58)..(58): n is a, c, t, g, unknown, or other
  misc_feature (767)..(767): n is a, c, t, g, unknown, or other
gttggttcgtcccgggggggnncncngggtccggggcccgcgcaccnaaaantntttnttaaacttcacgcggtggcggccgctctagaatagtggatcccccgggctgcaggaattcgtctcacccctagaaaaacacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctggaagccaccaagtgttgctatgacgcttttattaacaccctggtcaacggcgatgttaaaagaaaaagtgggcactactgtggtgtaccccaagattccttgcaacattgctaggctaaggaaagaaccccttatcgttattgaaaaaaaaaataaaatactaagacgcctcgcgggtccccaaattccgcccctatagttgaggtggtatttaccgcgctgctctactggggcccttctcttttaaaaacccgtactttatacttgaagaaaaaaccccgtggagggtttaccccaatcttataatttgagcattgtggaccacaccattacccn

SEQ ID NO: 68121 - protein, 51 aa, Zea mays; identical to SEQ ID NO: 2355
  misc_feature: Ceres CLONE 1543663
  misc_feature (9)..(51): Pfam Name: Ribosomal_L39 Pfam Description: Ribosomal L39 protein

SEQ ID NO: 68122 - DNA, 723 bp, Zea mays
  misc_feature: Ceres CLONE 1543669
ggagctccccgcggtggcggccgctctagaatagtggatcccccgggctgcaggaattcgtctcacccctagaaaaaacatgcgctcgagaatttttaggaaagcgtttcatctgcgagagtttcatttgggggctctaaaatagcctcgccctcctcgtgccttatcttcatctacacctcctctttctcctccatgctgatcggcaatctctaagctttgcaacaactgatagccgaattccgcgcgccggtccctaaaaaaatgcaagtactaggtagtagataagatgcatttcccagtaatttttcgttattatatatacgcagcacgggaaggaggggagacactctgttcaaccaccaggcgagtgcgcagccggcactccaggtccaacagcctcttcggctccttcgttggtggtgcgtggacaccggaaattacctcgggagatgcgttccctgatctaagcccgggcttaaatggctgctcaaaagcgttggctgctccctgctcccgctgcctgctgggcatcgtccgtcgttacatgtcccttctgggattcccgcccaaaaaaaactgcccccacccaatttcaaaagcaaaatgcgatcggtggtgtcagccctaaataacttgggaagggggcaacattcttcccccgcgcttcgccaaaaatccaagaaaacgggggccccatgatagagataacccccaattggc

SEQ ID NO: 68123 - DNA, 623 bp, Zea mays
  misc_feature: Ceres CLONE 1543670
  misc_feature: Translation starting site: 169
  misc_feature: SWISSPROT Homolog: EC 2.4.1.242 NDP-glucose--starch glucosyltransferase
  misc_feature: SWISSPROT Homolog: EC 2.4.1.21 Starch synthase
  misc_feature (461)..(461): n is a, c, t, g, unknown, or other
  misc_feature (467)..(467): n is a, c, t, g, unknown, or other
ctccccgcggtggcggccgctctagaactagtggatcccccgggctgcaggaattcgtctcacccctagaaaaaagtcccccgacccggagccaaagccaacaaacagccgctccgccttcctccgcggctgcagccagcgcgaggtcatcattgaatggctgcaacgatgggttcaatatctgccaacggttcttaccaaacaaataggcccagtgcactaaagcaggcacctcacatgcaattccaacaatgttgcaacggtggacttaggttcttaagcaagcactcccaatccatgcgaagtaagatacaggtggctaaaagaagagctacagataatggaattcatccaaagactacgggacatcgggcacctattgtatgttctgctgggatgactattgtatttgttgcaactgaagtgcacccatggtgcaaaactggtggcctcggtgatgntgttangaagactgcccccagctttggctgctatgggacaaccgtgtcatgacaatagctcctcgttatgatcaaatacaggatgcatggggatacagtgtcctttgtgaggtaaattattggtacacggtagaaactgttccaattcttcactgctacaaa

SEQ ID NO: 68124 - DNA, 731 bp, Zea mays
  misc_feature: Ceres CLONE 1543671
  misc_feature: Encodes the peptide sequence at SEQ ID NO. 68125
  misc_feature (338)..(338): n is a, c, t, g, unknown, or other
  misc_feature (564)..(564): n is a, c, t, g, unknown, or other
  misc_feature (674)..(674): n is a, c, t, g, unknown, or other
aaaactggagctccccgcggtggcggccgctctagaactagtggatcccccgggctgcaggaattcgtctcacccctagaaaaatgccagtgctcggtgcccgtgcccgcgcgcgctagcctagctgctcctgcctggttcgccgtagcccgtagcccgtagcacaacaacaacaaaaaaatctccgcggcgcggggggaggtggtctgttcaccttggggagcagcggcgggccgtccggccgaaaaatgcccggtggcgccttcctcctcaacggcagcggcggcggcatggcggaatacggcggcggcctcaccgtccccgtcctcgtgacctgnctcatggcggcctccggcggcctcatccttcggctaccacattggcatcctcaggaggtgtgtcggaaaatggaggatttcctgaacaagttcttcccccgggttgcctcaagaggaccggcgccgccgccaaccaaggacgtgtacctgcatttacaacaaccaggcgctgacggccttcacgtcgtccgctgtacgccttcggcatgggtggggaccctgctgncgagccgcgtgacccggcggctggggcggcaggccgtcatgctgatcggcggcggcctgttcttggccggcgccctcgtcaacgccgccgcggccaacatcgccatgctncatcgtcgggaggatgctgctcggcctgggggctcgcttctcccgccagcccacgcc

SEQ ID NO: 68125 - protein, 161 aa, Zea mays
  misc_feature: Ceres CLONE 1543671
  misc_feature (30)..(30): Xaa is any aa, unknown, or other
  misc_feature (106)..(106): Xaa is any aa, unknown, or other
MPGGAFLLNGSGGGMAEYGGGLTVPVLVTXLMAASGGLILRLPHWHPQEVCRKMEDFLNKFFPRVASRGPAPPPTKDVYLHLQQPGADGLHVVRCTPSAWVGTLLXSRVTRRLGRQAVMLIGGGLFLAGALVNAAAANIAMLHRREDAARPGGSLLPPAHA

SEQ ID NO: 68126 - DNA, 735 bp, Zea mays
  misc_feature: Ceres CLONE 1543676
  misc_feature: Encodes the peptide sequence at SEQ ID NO. 68127
  misc_feature (430)..(430): n is a, c, t, g, unknown, or other
agagctggagctccccgcggtggcggccgctctagaactagtggatcccccgggctgcaggaattcgtctcacccctagaaaaaaactgaaaaacctcgtctacattcgcatctaggcgcccctccacctcgttccgatccagctcgccggcgcccggcggccatgtcgcatcccacggcggcggtggccgcggaggcgcagccgcagggtcgcggcctctcggggcgccagtgcggcggtggcggccttgggcagagcatctctggcatcgtgcggatggcggtgttctggtacttcgcggccaagttcttcgggcccaagcgcccgcccgcggaccccgggattctcatgtccaacctcttccagaacggcgagccaatggatatgtggatgtatttatcagagagtgacaagttccacgattttgcntatgaggacgcacttatttggcatgaggcaaacataccatatgcagtatggggacctaccagtactagaacacggtcatttacatactaccccttcagaggctctcaagcataatggatctttgaaaggctctggttacttttgcccgcccggggttaccctgtggacccaaccaatcccttgatttgaaccaaaaatctgttttttggagggaccacactggtttgggcattttctggccaaaattcaaaaaggggtaaaaaaaaaacccttggctgggggtttttaaaaaaaccctgaaaaac

SEQ ID NO: 68127 - protein, 126 aa, Zea mays
  misc_feature: Ceres CLONE 1543676
MSHPTAAVAAEAQPQGRGLSGRQCGGGGLGQSISGIVRMAVFWYFAAKFFGPKRPPADPGILMSNLFQNGEPMDMWMYLSESDKFHDFAYEDALIWHEANIPYAVWGPTSTRTRSFTYYPFRGSQA

SEQ ID NO: 68128 - DNA, 743 bp, Zea mays
  misc_feature: Ceres CLONE 1543685
  misc_feature (564)..(564): n is a, c, t, g, unknown, or other
tggcggccgctctagaactagtggatcccccgggctgcaggaattcgtctccccctagaaaaacgcttcttgttgccaaagaattccctcccctagccgccgccgccgctcgtctccctgagaggtgccgggaccgaggaactggccgagttctaggtagagaatcggttttgcttgtctcaccccggggtctgctgcgtctggtggtggtgaaggggagaaattcgtgagatctgttccggatcaggcgtccgatcccgggaatcaggggtttcacacgctgcttcgtcgatttgaatttgatgtactaatggagtctaagggtgcgagaaagtctattcagtcctcccttccatgggtggcggggggctgccccttggcctacgcccccccccccccccttctttttgcctttaggccgtgaagaagtttccggttcgcctgctttactccccacctgcgcgaaacaagcccatcccgcgttctcccctttttggtcctccgcccatatttatgtacgttctatgaattccctttttcggaacaccctcggtttttcaaccnaattcccctcccggcgcctgttgctttcctttattgaaccttcgcagtgtcacacttgtttgggtatcgtgggaccgcttagcttgctctctttcccattcttttggatctctgttcgccccccgctcccatggtggggtcctctcttgccgcgtgactcgcttcccggggggtaattg

SEQ ID NO: 68129 - DNA, 672 bp, Zea mays
  misc_feature: Ceres CLONE 1543687
  misc_feature: Encodes the peptide sequence at SEQ ID NO. 68130
  misc_feature (345)..(345): n is a, c, t, g, unknown, or other
  misc_feature (407)..(407): n is a, c, t, g, unknown, or other
  misc_feature (411)..(411): n is a, c, t, g, unknown, or other
  misc_feature (414)..(414): n is a, c, t, g, unknown, or other
  misc_feature (418)..(418): n is a, c, t, g, unknown, or other
  misc_feature (419)..(419): n is a, c, t, g, unknown, or other
  misc_feature (430)..(430): n is a, c, t, g, unknown, or other
  misc_feature (431)..(431): n is a, c, t, g, unknown, or other
ctggagctccccgcggtggcggccgctctagaactagtggatcccccgggctgcaggaattcgtctcacccctagaaaaagtgctccccccttcccacactcccgtcccaaaaccctaaacccagcgccgccgccgccgccgacgcggaagcggtacagccatgtacgccgtcctccgccgcgcggcgccccttcggcggcgcgccgtgtccgcgctcgcgaccgcgctgctccagcagcagccggcggcgctggatgcggtggcccggcgggccccgctccctgcggccgcatggttccactctttctccgcgtggctgggggtcccgggagacggggccgcangggcggccgcgcgcgcggaagtcgcggcggaccaccgggtcggtctacgaagaagaccaaanggcngcngccnngcgccgcccannccgcgaagggctccagatgcccagcttgggatctcgtccaagaatcgtcccaaaagctcgccaggcaaggcatcacccaagctgttccccatccagagaagatgtcctttgaagcagcaatgccagggaggggcaatgggtggggcgggcccaaaaccgggaaaggggaaaattttggccttttggaatccccccttaagggaggcaatattcccgcccaaccaaatagtacaagcctggt

SEQ ID NO: 68130 - protein, 170 aa, Zea mays
  misc_feature: Ceres CLONE 1543687
  misc_feature (62)..(62): Xaa is any aa, unknown, or other
  misc_feature (82)..(82): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (90)..(90): Xaa is any aa, unknown, or other
MYAVLRRAAPLRRRAVSALATALLQQQPAALDAVARRAPLPAAAWFHSFSAWLGVPGDGAAXAAARAEVAADHRVGLRRRPXGXXXAPPXPRRAPDAQLGISSKNRPKSSPGKASPKLFPIQRRCPLKQQCQGGAMGGAGPKPGKGKILAFWNPPLREAIFPPNQIVQAW

SEQ ID NO: 68131 - DNA, 740 bp, Zea mays
  misc_feature: Ceres CLONE 1543688
  misc_feature: Encodes the peptide sequence at SEQ ID NO. 68132
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
cgccccgcgnnnnnntnnctntcactaggaaaannnannnaacccnnnncctgcccccggcgctcaccgcggtgacggccgctccttaactagtggatcccccgggctgcaggatttcgtctcacccctagaaaaggctcggcggctccggctcacctcccacaccctttttaacatctcgcgtgccgccggcggccaccaccatcactgccatgatcagcatcctcgcgcaggagcgcctcctcgggttcgccctgggtaccgtctccatcggcggcttcgtcctccaccagcgccgggccatctaccgttcaatccctgaagccgacgggtcgccctacttttaccagcctggtgaaattgccagtcgaagaacctcaactgaactggctcatgtatggaacaaggcagtggacgagacccttgggcgacttgttgtgtaccttagatcgcgtgggtggcacaccaacctccatgttgaacatggtaaccgaggaagactctttttcaagccactgatgtgctcatacttccctgtacccggattgaacatgtttttttttttaaaaaaaaagatacttcctaaaaaaaaaaaaaaaaacccagaccccccaaggtaccccaattccccccaatagggaagtccgtaatcacgcccgcccttcaactggaccgccccgttttaaccaaccccacgtagaactggcggaaaaaaccccgtgggcccgttaacccccaat

SEQ ID NO: 68132 - protein, 141 aa, Zea mays
  misc_feature: Ceres CLONE 1543688
MISILAQERLLGFALGTVSIGGFVLHQRRAIYRSIPEADGSPYFYQPGEIASRRTSTELAHVWNKAVDETLGRLVVYLRSRGWHTNLHVEHGNRGRLFFKPLMCSYFPVPGLNMFFFLKKKILPKKKKKNPDPPRYPNSPQ

SEQ ID NO: 68133 - DNA, 515 bp, Zea mays
  misc_feature: Ceres CLONE 1543689
  misc_feature (87)..(87): n is a, c, t, g, unknown, or other
  misc_feature (245)..(245): n is a, c, t, g, unknown, or other
tcccgcggtggcggccgctctgaatagtgatccccgggctgaggaattcgtctcacccctagaaaaaaaaatttgagattttgacanttaatggacgggagctgccacccacacggccacacatgcactgctgcagtgacttgaaggttcagatatcagttatgccaaacgatccatttgtgctccccccccccccccccggcctatttggcatgatcgctatatattgttgttatgttttcagnttgggtttttcactatgggagttacacactggattaatggaaaggttttaaaaggttcccccttttttaaaaaaaaaaaaaaaaacggagccctcggaggtacccaaattcccccccaaatagggaatccttttttacccccccccctcatggggccggtctttttttaacaaccctggggtggtggggggaaaaaaccccccgggggggtttttcccccccaaatttttttattttcccccttttttgaaaaaaaaaaaaccccccccc

SEQ ID NO: 68134 - DNA, 629 bp, Zea mays
  misc_feature: Ceres CLONE 1543690
  misc_feature: Encodes the peptide sequence at SEQ ID NO. 68135
  misc_feature (502)..(502): n is a, c, t, g, unknown, or other
ctggagctccccgcggtggcggccgctctagaactagtggatcccccgggctgcaggaattcgtctcacccctagaaaaagcgcactcagagctgctccgctccctacccccctactccccttgtagagtagagtagagtagcgtagcgtagcttgcccgacgccgcgacctccgggggcttggctttgggaaatggaccagccgctcactgcccccagtcagtggccgcgcgccgcaccaagtgagctagctactctctaggcggagtgaagcgaagctagcttagctgcctcgagcttgagctgagcttgctcactcttctcccctcttcttctagtaccggcacacacaccgcagctgcgaaaaaggaagctctctctctctggtggtgccggtgcgccgtgcttgcttgcttgcttgcggctgcatccatggacgcctacgaggccaccaaggtggtgttctcgcggatccaggcgctggacccggaccacgccgccnagatcatgggcttcctgctcatccaggaccacggcgagaaggagatgatacgcctcgccttccgcccccgagcgctgctgcacaccgtcatggccaggcgcgcaaggactggggctgctcccgtcgc

SEQ ID NO: 68135 - protein, 65 aa, Zea mays
  misc_feature: Ceres CLONE 1543690
  misc_feature (24)..(24): Xaa is any aa, unknown, or other
MDAYEATKVVFSRIQALDPDHAAXIMGFLLIQDHGEKEMIRLAFRPRALLHTVMARRARTGAAPV

SEQ ID NO: 68136 - DNA, 890 bp, Zea mays
  misc_feature: Ceres CLONE 1543694
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
ttggccccttgctctcccccccccccccggtttgccggcaaaacaaannnnnnnngacaataatatctcaactatcactgaagggcccgctctccctacggatcccacaggctgcaagaattcctctcacccctaaaaaaatgaagtcccaatggtcagcatgcttatattaccagttaccatgcttaattgcatagttgcactgtagtgatcaccgcacgaagatggctctgtgtggaatacagtagtagcttaagcacatttcgtattacaggaaaagagttgtggtcagaggtcttcccacgtatatagctgtctcttgagactctgcatggactctgcaatctggatatgcatgcactataatcacaataaaaatagggccacaatatgacaaatcagcccaggaaacctatggtaatttgtgattcattctgaaaaaaaaaaaaaagaaaataaccgctactacctttcttaaggtaattttgtcccccacccgggagcttgcccccccctctctctttttcctagtcgcacatatgccgcaacatttcagaacagcaatatccgaagaggtataggcggcaacgaaaaggctgctgccgagatactccctccggataggttaacatctaaattgcacccctccataagtaggttcagactccacattaccaccctcggccccctccctatgccgccagctcgccttccttaccaccccagcggcgtctcctattatctaatcaccccgcaagaattttgccaccacacctatatatatccgcgtaggccaacgaagctacccccccctcttcaaatacactctgggagcagaacgcggatggtgagagggttgtcaggcgtagaaacggtccaattcttatatg

SEQ ID NO: 68137 - DNA, 682 bp, Zea mays
  misc_feature: Ceres CLONE 1543697
  misc_feature: SWISSPROT Homolog: EC 3.2.1.23 Beta-galactosidase
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (344)..(344): n is a, c, t, g, unknown, or other
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
ggatagagtcgtccaccaatcttccatatctagaactagtggatcccccgggctgcaggaattcgtctcacccctagaaaaacttacctggacggggttgacgggcgatcaagaagcctcgtggcctaggccagtggcccacattgcacatggtgggtgcgctggcttaccatctccccaagtgggagagtggacgtcataatttgtggtagagggggtacgcgttcgcgcggcccccgccaaatcttataaatttcatgtaagtccccttatctgaagggcttgaaatgttatctttatttcgccacattttataaattataatttaatttttcgctnnnggnggngnngngnnnnaaaaaaaaaaaaaaaaaaaatcttccctccacattattacgggaacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccttttcgccagctggcgataatagcgaagagccccgcaccgatcgcccttcccaacagttgcgcaaccctgaatggcgaatggaatttgtagccgttaatattttgtaaaaatccgcgttaaatttttgtaa

SEQ ID NO: 68138 - DNA, 622 bp, Zea mays
  misc_feature: Ceres CLONE 1543699
  misc_feature: Encodes the peptide sequence at SEQ ID NO. 68139
ccccgcggtggcggccgctctagaactagtggatcccccgggctgcaggaattcgtctcacccctagaaaaatcacggccacatcatcggcgccatagccatcggcctcactcactagctgtctagctagcttccagccgcagcagcttgtcgtgcggatagatagaagcgccaagccactcgctgggccggggtacggttgttgttctgtgactctcgcacaatgccggccatggtggaggaggaggagctcatcagaggggcggcgcccgagccggagccggagccgcacctcctggtggtgaccttcccggcgcagggccacatcaacccggtgcggcacctcgcgcgccgcctgctgcgcgccacgggggcgcgggtcaccgtctccacggccgtgtccgcgctccgcaagatgttcccgggcgagcaggcgggcgcggagggccaccgcgacgccgcgggggtgtggtacgtgccctactccgacggctacgacgacggcttcgaccgcgacgcgcacgacgccacgcactacatggagcagatcaagctcgtgggcgccgccacgctgggtgccgtcctcgacagcctccgcggcgtgtgccgccccgtcacgatc

SEQ ID NO: 68139 - protein, 133 aa, Zea mays
  misc_feature: Ceres CLONE 1543699
  misc_feature: SWISSPROT Homolog: EC 2.4.1.210 Limonoid glucosyltransferase
MPAMVEEEELIRGAAPEPEPEPHLLVVTFPAQGHINPVRHLARRLLRATGARVTVSTAVSALRKMFPGEQAGAEGHRDAAGVWYVPYSDGYDDGFDRDAHDATHYMEQIKLVGAATLGAVLDSLRGVCRPVTI

SEQ ID NO: 68140 - DNA, 682 bp, Zea mays
  misc_feature: Ceres CLONE 1543701
ccccgcggtggcggccgctctagaactagtggatcccccgggctgcaggaattcgtctcacccctagaaaaaagtacttctacctcaacaatgtctacagctaaacgacgaatagatccgtttggtgcggcgaacaggattcatgccgttttgcagtctttttccctttgttatcgttgcaatgtgctgtcttggtgcctgtactactagggctccagactgtatacaatttttgctgttcatcttgaaatacccacattacataaccagcagttaacatgaagtgttttacttaccttaaaaaaaaaaaaaaaacgagaagctccaggtccccatttccccctatagggaggcgtattaccgcgggtggggtgggcgttgtttttcaacggtcgtggacccccaaaccctgggggttacccaatttattcccctggaagaaattccccttttcccacgctgggtataaaacgaaaaggccccgcaccgttccccttttccaaaatttgcccccccccttaaggggcaaaagtgaaatttttaaccctttattttttttgttaaaactccccgccaaaattttttgttgaaaaccccgccctttttttttttaccccatagggggcgaaagactttgggaaaaatccctcttatatattacaaaagaaaactcccccggggc

SEQ ID NO: 68141 - DNA, 767 bp, Zea mays
  misc_feature: Ceres CLONE 1543703
gctctagaactagtggatcccccgggctgcaggaattcgtctcacccctagaaaaaaacacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacactaagatgaaccatgtttggtgcatagtgggtggtttttgtctaagaaaaaaaaaaaaaaacgagacgctccgaggtacctaatttcgcccttatagaggagtcggaattcccccgccgctcccttgttctgttcgtttcccccccccttcgtgacctgggaaaaaatccttgggagtttacacacagcttaatgtggcccaggggcgaacataatccccccctttttgtgccgccgtttggtcgataaataggcacaaaaaagggccgcgatcaccctattcacatccccttccccgaatcaagcttggctgcaggtcctttgaattgcgccccaatgggcaaaatttgtaaagcccgttcaaatatttgggggattagaaaagcacacgctgtttacaccatcgctgggttacacgccttctttttctttttttttaatactctcacagcgttttgtaataattctggcttattaatctccctatcgtcgcggcttattattcggctgttttt

SEQ ID NO: 68142 - DNA, 713 bp, Zea mays
  misc_feature: Ceres CLONE 1543704
  misc_feature: Encodes the peptide sequence at SEQ ID NO. 68143
  misc_feature (596)..(596): n is a, c, t, g, unknown, or other
  misc_feature (668)..(668): n is a, c, t, g, unknown, or other
  misc_feature (669)..(669): n is a, c, t, g, unknown, or other
aaactggagctccccgcggtggcggccgctctagaactagtggatcccccgggctgcaggaattcgtctcacccctagaaaaaagggagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgaacgtggtgatgagcctgctccccgcactgcccgagttcgcctcacctttcctgggcgccgccgcctgggcgccgcaccacacggncaacccgttctacacccgcacgaggtccaccgcagcggatggtgctgcgccagctcatctgacgaggctgcnncgtgagaaagtgcgggagtcccgcggaccgggcatcccctgtcc

SEQ ID NO: 68143 - protein, 145 aa, Zea mays
  misc_feature: Ceres CLONE 1543704
  misc_feature: SWISSPROT Homolog: EC 6.2.1.12 4-coumarate--CoA ligase
MGSVDAAIAVPVPAAEEKAVEEKAMVFRSKLPDIEIDSSMALHTYCFGKMGEVAERACLIDGLTGASYTYAEVESLSRRAASGLRAMGVGKGERGDEPAPRTARVRLTFPGRRRLGAAPHGQPVLHPHEVHRSGWCCASSSDEAA

SEQ ID NO: 68144 - DNA, 647 bp, Zea mays
  misc_feature: Ceres CLONE 1543709
  misc_feature: Encodes the peptide sequence at SEQ ID NO. 68145
  misc_feature (200)..(200): n is a, c, t, g, unknown, or other
caccgcggtggcggccgctctagaactagtggatcccccgggctgcaggaattcgtctcacccctagaaaaaaccctccccacatcgggaaccgccgccgacgccgcaggaggagacgcatcgaggttagcacgcgaagaagcgaccatgagggccaagtggaagaagaagcgcatgaggaggctcaagaggaagcgcangaaagatgaggcagagatccaagtaggcagatcgagatggattgtggacctgatgacatgcgtgggtacatacatttcttcggatgcgttggtgtgcctgtggagagatgtcaacctgccatggtgtcacgggtccgccatcagtttgaacgtcctggcctgccacttagttagggccacttttccaggggttccaaggttggaatttgaaacccccccgtttgcccccctaaaataaatcaaaacggtcctttttgttgaaccctttttttgaggggggccttttttttggcggaaaaaaatcccagccccccccttttttgggccgggaaaaaaaaaaaaaaaaaaaaatttttaaaaaaaaaaaaaaaaaacccgggggccgcccccgggggggtccccccatttttcccccctttatatggggggggccgcatatttcccccg

SEQ ID NO: 68145 - protein, 96 aa, Zea mays
  misc_feature: Ceres CLONE 1543709
  misc_feature (1)..(25): Pfam Name: Ribosomal_L41 Pfam Description: Ribosomal protein L41
  misc_feature (18)..(18): Xaa is any aa, unknown, or other
MRAKWKKKRMRRLKRKRXKDEAEIQVGRSRWIVDLMTCVGTYISSDALVCLWRDVNLPWCHGSAISLNVLACHLVRATFPGVPRLEFETPPFAPLK

SEQ ID NO: 68146 - DNA, 662 bp, Zea mays
  misc_feature: Ceres CLONE 1543718
  misc_feature: Encodes the peptide sequence at SEQ ID NO. 68147
ctccccgcggtggcggccgctctagaactagtggatcccccgggctgcaggaattcgtctcacccctagaaaaaagtctccttccccagatccaaatcacgcagaagctgtcgtccctgcacatggcggttctcggttgcctttggtgcaatctatgctcaggtagagaagaaggcgtcgaggcggatctccaggagttccaggactttgacgagttctaggcgtgggttagcggcaacccctagtcggttgcctgtgaaggccgcgtttatctacgtttcgttttcgcactttgattattgtaaagactatatggatgtcttagacatatgatgtaatcgactattattcccctttttaatactatttgagcactgtgtaaaaaaaaaaaaaaaaacgagacgctcgaggtaccccatttcgccctatagtgagtcgtattacgcgcgctcactgggcgtcgtttttacacgtcgtgactgggaaaaccctgggcgtaccccacttaatcgcttgcagcaatccccctttcgccagctggcgtaataccgaagaggccggccccgatcgcccttccaaaatttgccccacctgaaagggcaaaggaaaattgacccctttaatttttggttaaattcccgcttaaattttttgtaaacccc

SEQ ID NO: 68147 - protein, 32 aa, Zea mays; identical to SEQ ID NO: 63131
  misc_feature: Ceres CLONE 1543718

SEQ ID NO: 68148 - DNA, 664 bp, Zea mays
  misc_feature: Ceres CLONE 1543719
  misc_feature: SWISSPROT Homolog: EC 3.2.1.23 Beta-galactosidase
  misc_feature (432)..(432): n is a, c, t, g, unknown, or other
  misc_feature (664)..(664): n is a, c, t, g, unknown, or other
ctccccgcggtggcggccgctctagaactagtggatcccccgggctgcaggaattcgtctcacccctagaaaaaaaccattccgccgtcgccgccggccggatcatcggtcgtcgtcatgatgatatctatcaatctacgcgtgatgatcgatggctacttgtctactgctatgtactactaaataaaatctctccccgtgtgtgtacacgtacgcttgcatgtgcatggtagcatgtacgtacgacgtcgtccatgtataagtgtgtgacgtgtgagacggacagagagagagagagacaggatcgatcgagagacggtcatgtccttttggctgtttggtttattcatatcacaacttttgagtgtatacaagattatttctgtggcagaaaaaaaaaaaaaaaaacgagacgctcgaggtacccaattncgccctatagtgagtcgtattacgcgcgctcactggccgtcgttttacaacgtcgtgactgggaaaaacctggcgttacccaactaaatcgccttgcagcacatcccccttttcgcagctggcgtaataccgagaagcccgccacgatcgcctttccaacagttgcgcagcctgaatggcgaatgaaattgtaagccgtaatattttgtaaaaatcgccgtaaatttttgtn

SEQ ID NO: 68149 - DNA, 660 bp, Zea mays
  misc_feature: Ceres CLONE 1543723
  misc_feature: SWISSPROT Homolog: EC 3.2.1.23 Beta-galactosidase
cgcggtggcggccgctctagaactagtggatcccccgggctgcaggaattcgtctcacccctagaaaaagtattcttcgaggcttgtgcacttctgtaactcttttgtaccccgtgtttaatttctgggcggcatgatatcaagagtacccagatgtatccgtcgctggtctgaacactaatttaacgcactcattcgcagtatggcaaaaaaaaaaaaaaaaaagaaccaaattcgccctataaagaaacaaataaaaacaacgaaaaaaaaaaaaaaaaccgacaccctcgaggtacccaattccccctatagagagtcgtattacgcccgctcactggccgccgttttacaacgtcgtgactggaaaaaccctggcgttacccaacttaatccccttgcagcacatccccctttcgccagcgggcgtaataacaaaaaggcccgcaccaatcgcccttcccaacatttgcccaccctgaatggcaaatggaaattgtaagcgttaatattttgttaaaattcgcgttaaatttttgttaaatcagctcatttttttaaccaataggccgaaatcggaaaaatcccttataaatcaaaagaataaaccgagatagggttgagtggttgttccagtttggaacaagagtcactattaaa

SEQ ID NO: 68150 - DNA, 659 bp, Zea mays
  misc_feature: Ceres CLONE 1543729
  misc_feature: Encodes the peptide sequence at SEQ ID NO. 68151
  misc_feature (399)..(399): n is a, c, t, g, unknown, or other
  misc_feature (401)..(401): n is a, c, t, g, unknown, or other
  misc_feature (403)..(403): n is a, c, t, g, unknown, or other
gcggtggcggccgctctagaactagtggatcccccgggctgcaggaattcgtctcacccctagaaaaattcctcgactggttgagcggcggcgccaaggagaaccactacaacgtgtcgctggactacggcaccctcgtcgtgaccgactggagccacgtgggtttcaacgacgttgactacgggttcggtgagccaagctacgtgttcaccctgaacgacgacgtgaacatcgttccctccgttgtgtacctgaagcctcccaagccgaagcagggcatcaggctggtgctgcagtgcgtggaagggcggcactctgccgtgttcagcgaggagctgcagaagcacgcatagagcgagtgtattccatcccacagtggagattgttgtattttgttgngncnaattgctgcccccggaatttgcttgcaataagatggggttgggcacgtgttatactctgtactgttatcctcagcacgttacattatacattgttttgagtgagtatttgacggtggggaaaaaaatataagggttccattttgaaccaatttatttcgaaaaaaaaaaaaaaaaaaaaccgaaaccccttcaaggttaccccaatttcccccctaaaaggggaggcgtatttcaccggcggttccttgggcggtt

SEQ ID NO: 68151 - protein, 116 aa, Zea mays
  misc_feature: Ceres CLONE 1543729
  misc_feature: SWISSPROT Homolog: EC 2.3.1.162 Taxadien-5-alpha-ol O-acetyltransferase
GGGRSRTSGSPGLQEFVSPLEKFLDWLSGGAKENHYNVSLDYGTLVVTDWSHVGFNDVDYGFGEPSYVFTLNDDVNIVPSVVYLKPPKPKQGIRLVLQCVEGRHSAVFSEELQKHA

SEQ ID NO: 68152 - DNA, 650 bp, Zea mays
  misc_feature: Ceres CLONE 1543730
  misc_feature: Encodes the peptide sequence at SEQ ID NO. 68153
tccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggcgtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggatgatagggtaccaagaagatggatactaaggagaaagacaagaaaaagaaagaaggtggtgacgattcacggaaggcagaggaaagacataagggtaaagcgatggattcggagggcaagggccaagtgaagaaggaaaagaagatggtgctggggacaactgaagctaggagaaggacaaaa

SEQ ID NO: 68153 - protein, 62 aa, Zea mays
  misc_feature: Ceres CLONE 1543730
MGKDRESAKLKEEKASKDEIHMKVKSKGEPSGEEDGKEEVEVEIEAKFVEKEEVTGSGDGAG

SEQ ID NO: 68154 - DNA, 646 bp, Zea mays
  misc_feature: Ceres CLONE 1543736
ccccgcggtggcggccgctctagaactagtggatcccccgggctgcaggaattcgtctcacccctagaaaaaaggatgtagcaggtgtttttacaaactgattgttggcctgtgtgtgccgtgcggtgggttcttcattacttgctagtgcagtgaatgcaatcttgttgccataatgaggaacacgtgtgaataaaatctttctagtgcacatgactgcttcttgttaactgtggcttttctgctgtactttgtcttttacaagtgctggccgctggccccttgctagacctactcttgtttggtggcaatgggattagaggtgctaaagttttttcgctcctcaacacgctcataggaccataccgccctgttggatttgtattatctgcgtatctgcccctctctgtacttgtatgtaccgggaagccctgctctgtccctcgtaatctcattgcagcaatccccctttcacagctggtgtagtagcaagaagccctcaactatcgcctttcctctcgttgcccaccttcatcgtttaatggatatggttaacgctaatatttggctaaaatttccggaaaaatttttggctagataagccccttttgttttccccaattttgtccgaaattgggccaaattc

SEQ ID NO: 68155 - DNA, 658 bp, Zea mays
  misc_feature: Ceres CLONE 1543737
agctccccgcggtggcggccgctctagaactagtggatcccccgggctgcaggaattcgtctcacccctagaaaatttctgaatcttgtgtcctcgaacgactgcgagtggggatacagcacccgattggtcaatctgatccgccaaattaacagcaccaaatatatgaacacactgatgaaagcatgcaaagagtgatcaaagcctgctaagatagttgtgtttcttcccctgaagtgcttccgagaataaatttttcttatctgattggccataacctataactggtgtaatggaatcctactggttggttgatcataaagtgactcatattacgtcgggtctaagtgtattccacaaacttttaacggtcatctagatgcacacttctgaattctgcaaaataaaaacaaaatactagacgctgcagagccccaattcgccctatagtgagtcgtattactcacgctcactgtgcttcacttttctactccgtgactgggaaaaccctggagttctcaacgtactcgtcttgcctatatccccctttatccggctggcttaatagccaagaggcccgcaccgatcgcccttcacaacagtgcgcaacctgaatggccaatcgaaattgaaacccccatattccgtttaaatcacg

SEQ ID NO: 68156 - DNA, 519 bp, Zea mays
  misc_feature: Ceres CLONE 1543741
  misc_feature: Translation starting site: 142
  misc_feature (340)..(340): n is a, c, t, g, unknown, or other
  misc_feature (341)..(341): n is a, c, t, g, unknown, or other
  misc_feature (486)..(486): n is a, c, t, g, unknown, or other
agctccccgcggtggcggccgctctagaactagtggatcccccgggctgcaggaattcgtctcacccctagaaaaagtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggaagcacgggggctgccgctcatcggggagacgctgcggctcatcgcggcgtacaagtcgccgacccnngagcgttcatcgacgagcgcgtggcgcggcacggcagcggggtgttcacgaacgcacgtgtttccgcgaacgcaccgggtttttcgccgaaccgggcttttaaccgcctgtttttggccccggagggcccccccctgaatttaanttacccgtgttccattcgccaccttgttgtggg

SEQ ID NO: 68157 - DNA, 670 bp, Zea mays
  misc_feature: Ceres CLONE 1543742
  misc_feature: Encodes the peptide sequence at SEQ ID NO. 68158
  misc_feature (39)..(39): n is a, c, t, g, unknown, or other
  misc_feature (92)..(92): n is a, c, t, g, unknown, or other
  misc_feature (93)..(93): n is a, c, t, g, unknown, or other
  misc_feature (119)..(119): n is a, c, t, g, unknown, or other
  misc_feature (129)..(129): n is a, c, t, g, unknown, or other
  misc_feature (146)..(146): n is a, c, t, g, unknown, or other
  misc_feature (157)..(157): n is a, c, t, g, unknown, or other
  misc_feature (165)..(165): n is a, c, t, g, unknown, or other
  misc_feature (173)..(173): n is a, c, t, g, unknown, or other
  misc_feature (187)..(187): n is a, c, t, g, unknown, or other
  misc_feature (196)..(196): n is a, c, t, g, unknown, or other
  misc_feature (204)..(204): n is a, c, t, g, unknown, or other
  misc_feature (543)..(543): n is a, c, t, g, unknown, or other
  misc_feature (544)..(544): n is a, c, t, g, unknown, or other
ccgcgggtggcggccgctctagaactagtggatcccccngggctgcaggaattcgtctcacccctagaaaaaaaaaaaaaaaaaaaaacccnntctccacttccgtttccggatcccgntttccagctnccgatccaacccagcantctgtaccgcngccgcgcngagcacgntccggcgccggtgncggcaggcngaaatccngagagcactccttcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcatccagcacaacaatgtcttnncctcctcacgcggttcgcagaactgtaacgcggccagcatcctcctcttcttcaacggtgaatagatgggtttaaagcctaccttcaggaactgggaggaggagtctcccgaaataaacttccccg

SEQ ID NO: 68158 - protein, 91 aa, Zea mays
  misc_feature: Ceres CLONE 1543742
  misc_feature (70)..(70): Xaa is any aa, unknown, or other
  misc_feature (71)..(71): Xaa is any aa, unknown, or other
MAGAVSALFLLDMKGRVLVWRDYRGDVSALQAERFFTKLLDKEGDSEVHSPVVYDDAGVTYMFIQHNNVXXSSRGSQNCNAASILLFFNGE

SEQ ID NO: 68159 - DNA, 626 bp, Zea mays
  misc_feature: Ceres CLONE 1543743
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (241)..(241): n is a, c, t, g, unknown, or other
gcggtggcggccgctctagaactagtggatcccccgggctgcaggaattcgtctcacccctagaaaaacatgtttcagttatattttatttgtgttgagcatcatttgtcatgttgtgaaccatttgtgttaagaacctttattcctatcatcatgctgtgaaccatctttaagatagtttatgggcttgggcttgtgaacnnnaacctaaaaaaaaaaatacaaaatggacaaaacgcancctcacacaacaacagaaaatacaaaatcactgaccccatcctcgtctccaagggcatcgtccgcgaattccatatgcgggacgaggatgctggccggccatacaggaagttcctgtaagcgccgtcgaggggcgcaagatacgtctatccctcgaacggcgctgcgaggacgggagtttcattgcaaataagcgccatagtgaagaaatctgaatcgtatgaacctctttggagtgctgaaacaattgcgcctggatccaatggggaaaaaataaaggacacgcccttttcaatacccgcaactgaaacatgcccaaattctcctaggcccccaagaaatctcaaaaaaaaaaaaattaattgtaaaacactcccgggaacccg

SEQ ID NO: 68160 - DNA, 652 bp, Zea mays
  misc_feature: Ceres CLONE 1543748
  misc_feature: Encodes the peptide sequence at SEQ ID NO. 68161
ctggagctccccgcggtggcggccgctctagaactagtggatcccccgggctgcaggaattcgtctcacccctagaaaaatttctattccacgaccttatccacaccagcagattcgaaattcacggacaggcccatggacccggcgaaagccagcggtggttcagcccctgacgtgcgggtcccactctccagccgcaccgcctagagaggcagaggcatcccttcgcgtggaagcaaacgaggcgtgataaagtggggctcctcggtcccggcgttggccgcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatc

SEQ ID NO: 68161 - protein, 58 aa, Zea mays
  misc_feature: Ceres CLONE 1543748
MSDWSSPAAPTFFPFGPQAEGWDVTFKVKYGDTLKRFYGCANGSHFDMNLSALRARID

SEQ ID NO: 68162 - DNA, 647 bp, Zea mays
  misc_feature: Ceres CLONE 1543755
  misc_feature: SWISSPROT Homolog: EC 3.2.1.23 Beta-galactosidase
ccccgcggtggcggccgctctagaactagtggatcccccgggctgcaggaattcgtctcacccctagaaaaactctctctctctctcctggccgcgctgaagcttctgcaccgcgttggcatacgcacgctctcctctgttcgtgagagcaggctctcttcacgccatatgcagggcgtcctcccctctacctcgtccagcgctcggatccggccaacgttttctggccgtggcgagcatgtacccatcagctccgtcgagtccctggtccggctgagcaagccccgggtgtcgtctcctttagggcctgttccgttgacagggaatagaaggccggaactgttccggtccgaattgtttatctaatttgtataagttttgatccacaggaataattcttggtgcaatcctacggaaacgaacaggcccttagtcctttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagccccgcacgatcgcccttcccaacagttga

SEQ ID NO: 68163 - DNA, 706 bp, Zea mays
  misc_feature: Ceres CLONE 1543757
  misc_feature: Encodes the peptide sequence at SEQ ID NO. 68164
  misc_feature (267)..(267): n is a, c, t, g, unknown, or other
  misc_feature (455)..(455): n is a, c, t, g, unknown, or other
  misc_feature (493)..(493): n is a, c, t, g, unknown, or other
  misc_feature (500)..(500): n is a, c, t, g, unknown, or other
  misc_feature (694)..(694): n is a, c, t, g, unknown, or other
  misc_feature (706)..(706): n is a, c, t, g, unknown, or other
ctcccgcggtggcggcgctctagactagtggatcccccgggctgcaggattcgtctcaccccctagaaaaaaaccatcatttgcaaagcgaagcaaaagcaatcggaatttctctgcgatttctctagatctcgactaccccccactagttttgggtccttccttttcgtttcgagagagcgatttcttggtggccatgggcgaagagcgagggtcccggcgatcggggatcgaccctcggcacccacctactcgtgcgtcggcgtngtggcagcacgaccggggtgggagatcatcgccaacgacccagggggaaccgcacccacgcccgtcctatgtcggcttcaccgacaccgagcgggctcatcggcgacgctgcccagaaccaggtcgccatgaaccccaccaacaccgtcttcgatgccaagcggttgatcggcaggaggttctctganccgtcagtgcagagtgacatgaagctatggccgttcanggtcatnccagggcctggtgacaaacccatgattgtagtcaactacaagggcgaggagaagcagtttgctgctgaggagatctcctccatggtcctcatcaagatgaaggagattgctgaagcctaccttggttccacccatcagaacgcagtggtgacagtgccggcctattttcacgactcgcagaggcaggccaccanggacgccggtgn

SEQ ID NO: 68164 - protein, 123 aa, Zea mays
  misc_feature: Ceres CLONE 1543757
  misc_feature (40)..(40): Xaa is any aa, unknown, or other
  misc_feature (53)..(53): Xaa is any aa, unknown, or other
  misc_feature (55)..(55): Xaa is any aa, unknown, or other
  misc_feature (120)..(120): Xaa is any aa, unknown, or other
MSASPTPSGLIGDAAQNQVAMNPTNTVFDAKRLIGRRFSXPSVQSDMKLWPFXVXPGPGDKPMIVVNYKGEEKQFAAEEISSMVLIKMKEIAEAYLGSTHQNAVVTVPAYFHDSQRQATXDAG

SEQ ID NO: 68165 - DNA, 673 bp, Zea mays
  misc_feature: Ceres CLONE 1543759
  misc_feature (429)..(429): n is a, c, t, g, unknown, or other
ctccccgcggtggcggccgctctagaactagtggatcccccgggctgcaggaattcgtctcacccctagaaaattgggcgtgggtactccggcgccgacgctggcgctggccgtgtcggggctcgtcgtcggcctcgccgtcttcttcctgctgcagtcgggaggaggcacgcgagactgacgactgatggaacccatgagctgagctgagcacgcgtcgaacatcgtctccccactcgacatcagttgctgtgctgtaatggttggtgaagatgaaaacccaggatatatatcaaaaaaaaaaaaaaaacgagacgctcgaggtaccccattcgccctatagtgagtcgtattacgcgcgctcactgggcgtcggtttacacgtcgtgactgggaaaaccctgccgttacccaacttaatccctttgnagaaaatccccctttccccgggtgggttataagcaaaagcccccaccgattgcctttcccaaagttgcccacccgaaaggcaaagggaattttacccgttaatttttgtaaaattccgctaaaatttggtaaaaccccccctttttttacacaaggggcaaaatcgggaaaccccttttttattaaaaaaatcccccctagagggggggagggttttcccccctggggaaaaaaagaccccctt

SEQ ID NO: 68166 - DNA, 668 bp, Zea mays
  misc_feature: Ceres CLONE 1543764
  misc_feature: SWISSPROT Homolog: EC 3.2.1.23 Beta-galactosidase
ccccgcggtggcggccgctctagaactagtggatcccccgggctgcaggaattcgtctcacccctagaaaaagtacttacggaccgtacggcagggacgagggcaccccgttccgtgtcaaggtgatgaacaacggccacgtcgctggcttctttggccgctctggagattgcctggacgcgatcgggctctacgtcaaccccaactaataactaaaacgatggatcggatcatctgcatgcatgcatatgcagtatgctgcttgcctagctgcctgtaacgaatatgaatgcataaaataacgcccctgctgctcccatatgcatcagcagtgtgtaccactatatatgttatatactgtatttcgctaccgaataaaaacataaataaaagatccagtgtcgtctgcacctttgttatatataaaaaaaaaaaacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaat

SEQ ID NO: 68167 - DNA, 662 bp, Zea mays
  misc_feature: Ceres CLONE 1543767
  misc_feature: Encodes the peptide sequence at SEQ ID NO. 68168
ctggagctccccgcggtggcggccgctctagaactagtggatcccccgggctgcaggaattcgtctcacccctagaaaaaaccccgacacagacccgacccgttacgccgcaccactcttcttcctctgctccgcctcttcacccagcgtcttccgattgctgacggatccctcttcgccgcggccgccgccgcggaccgaccgtgggagagaaggcgaggcgggagcgatggaggccgccgactacggcaagctcttcgtcggcggcatctcatgggagacgagcgaggaccgcctccgcgagtacttcggccgctttggcgaggtcaccgaggccgtcatcatgcgggatcgcagcacggggcgtgcccgtgggtttgggttcgtggtcttcgccgacgctgcggtcgccgagcgcgtcactatggacaaacacactatcgacggacgaatggtggaagcaaagaaggctgttcccagggacgaccacagtattgtgagcaagagcaacggcagcagcacagggtcacctggaccaggacgcaccaggaagatctttgttggaggcctgccctcgagtgtcacagaggctgacttcagaaggtatttcgagcagtttggcatcatcaccgatgtggtcgtgatgtacgaccacaacacgc

SEQ ID NO: 68168 - protein, 144 aa, Zea mays
  misc_feature: Ceres CLONE 1543767
  misc_feature (9)..(78): Pfam Name: RRM_1 Pfam Description: RNA recognition motif. (a.k.a. RRM, RBD, or RNP domain)
MEAADYGKLFVGGISWETSEDRLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNT

SEQ ID NO: 68169 - DNA, 670 bp, Zea mays
  misc_feature: Ceres CLONE 1543768
  misc_feature: Encodes the peptide sequence at SEQ ID NO. 68170
  misc_feature (437)..(437): n is a, c, t, g, unknown, or other
  misc_feature (470)..(470): n is a, c, t, g, unknown, or other
  misc_feature (526)..(526): n is a, c, t, g, unknown, or other
acccgcggtggcggccgctctagaactagtggatcccccgggctgcaggaattcgtctcacccctagaaaaaacccactcagctttcccccttccgcaactcctcgccggcagccggcggcggcgagtatctctcctgccgtttccacggaattttccccattgcggccactcttccccttccctcgtcctgcttcgtcgcgccttggctgtgctcctctcttcttcctccgagtccaggtgcgcgcaggcgcagggactgggaggaggtccagatgctactatgctgctgtacttttccccaacaaatccagacctgtgctccgcgctcgtcgtttcacccaagctgcttgccgcggagcttgctcagctccggcgagcaggggaggagcaaaaagagcaagctccaccgcgtcagggcgcatgtttttcagtccnagaaccagtctttgcgctctcatccccactggntgatagccacggggccctgcgaataaatccccagaaaggattttctttgttccgancccccttccctgccggaccccgaaggcggtcccctttttgctgccttttttcccggaggggacctcaccctccggaaagggcccccggttgcccctgggttcccttcgaaccgtggggggttttctctcccaaaatttagaaaa

SEQ ID NO: 68170 - protein, 73 aa, Zea mays
  misc_feature: Ceres CLONE 1543768
  misc_feature (55)..(55): Xaa is any aa, unknown, or other
  misc_feature (66)..(66): Xaa is any aa, unknown, or other
MLLCCCTFPQQIQTCAPRSSFHPSCLPRSLLSSGEQGRSKKSKLHRVRAHVFQSXNQSLRSHPHWXIATGPCE

SEQ ID NO: 68171 - DNA, 675 bp, Zea mays
  misc_feature: Ceres CLONE 1543772
  misc_feature: Encodes the peptide sequence at SEQ ID NO. 68172
  misc_feature (436)..(436): n is a, c, t, g, unknown, or other
  misc_feature (437)..(437): n is a, c, t, g, unknown, or other
acccgcggtggcggccgctctagaactagtggatcccccgggctgcaggaattcgtctcacccctagaaaaaaaaagtccatcaggcatccaagaagctcaaagcaagcagatctaagctccaggcagcgttgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtggatccatgcccatgtatgaatctagtccttccttnntctgtatctccatgtgacgcggcgtgtgcgtcccctcatgtgtgatgatgccagatgaatactaccaataagacattggtggtgactggtgtgacaaaaaaaaaaaaaaaaacaaaacccctcgagggtacccattccgccctataggggaggcgaattacgccgcgcccccgtggccctcttttttaaacggccgggacggggaaaaaccctgggtgtacccaaactttatcgcctt

SEQ ID NO: 68172 - protein, 63 aa, Zea mays; identical to SEQ ID NO: 28299
  misc_feature: Ceres CLONE 1543772

SEQ ID NO: 68173 - DNA, 485 bp, Zea mays
  misc_feature: Ceres CLONE 1543774
  misc_feature: SWISSPROT Homolog: EC 3.6.3.14 H(+)-transporting two-sector ATPase
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
ctcaccgcggtggcggccgctctagaactagtggatcccccgggctgcaggaattcgtctcacccctagaaaaatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacagggactgtatctggtgtggccggggcctctggtttatctttggattaaggtaaaagggccccaaaggttccccaaagaaaattttgtaaaaactcccaaatttgggaaaggggccccctccccctggggcaatcctttagaagtttgtggggaaaaaaaaactttttttttggcgggttttttttttttaggggaagagaacttcctttttgggggggttnnnnnnnaccccaaaattttttttcccccaccccccgg

SEQ ID NO: 68174 - DNA, 514 bp, Zea mays
  misc_feature: Ceres CLONE 1543789
  misc_feature: Encodes the peptide sequence at SEQ ID NO. 68175
aaaaaaatggataagagccgagaagtcttatattatgaaccttcgattctaaaatgaaaattcttctacattgaatgtatagctgcagcaataaattttgatcagcctttctaccccctgcgcctacgttgaacaggtacctttaggtacccacacaatacctaaactaatttttgatattgataagagtgcttattataaagcaattcttgcaatttttttaaggattgatttttgcatttttaggtgtcaaaataaagaaaacccatcctagtggatccgtgtggtaaggaaaaatgggtaatctattccttaacaaaaaaaattttggagattatgtaatgcttactctcaaactttttgtttatacagtagtgatattctttgtttccctctttatctttggattcttatctaatgacccaggacgtaatcctgggcgtgaggaaagaaaagagaagtaaaagaaaatgaaaaaagaaaaggaaaaaaataaaaagacaaaaaaaaaaaa

SEQ ID NO: 68175 - protein, 55 aa, Zea mays
  misc_feature: Ceres CLONE 1543789
  misc_feature (16)..(51): Pfam Name: PsbI Pfam Description: Photosystem II reaction centre I protein (PSII 4.8 kDa protein)
MGNLFLNKKNFGDYVMLTLKLFVYTVVIFFVSLFIFGFLSNDPGRNPGREERKEK

SEQ ID NO: 68176 - DNA, 669 bp, Zea mays
  misc_feature: Ceres CLONE 1543790
  misc_feature: Encodes the peptide sequence at SEQ ID NO. 68177
  misc_feature (669)..(669): n is a, c, t, g, unknown, or other
ctcaccgcggtggcggccgctctagaactagtggatcccccgggctgcaggaattcgtctcacccctagaaaattttcaaagtccttcaaggaaatggttgcgatgtgcttggtgaaagatcaaacgaagaggccaacagctgaaaaattacttaagcattcttttttcaagaatgcaaaacctccggagctaactgttaagaacattttaactgatttgccccctctttgggaccgtgtaaaggcactccagctaaaggatgcagcacaactagctttgaagagaatgccttcttcagaacaagaagcactttctatgagtgagtaccaacgaggtgtcagtgcatggaacttcgatattgaggatctaaaggctcaggcatcactgatatgtgatgatgatccacctgaaataaaagaagacgatgacactggtagaataactgacattgatagggtacatcttctgacgattattttgggaagacagccccttccaatggaaatactgcagtgatccttctttcgtgccaacaaattctgggccaaaagggccccaaaataaaggaaattatgtctttcccacatggggaaatcccccaccggaaagggaagcctgaggggccctaaaaccccccaattccaaaaattgtttcttttgcccccccn

SEQ ID NO: 68177 - protein, 140 aa, Zea mays
  misc_feature: Ceres CLONE 1543790
  misc_feature: SWISSPROT Homolog: EC 2.7.11.1 Non-specific serine/threonine protein kinase
MVAMCLVKDQTKRPTAEKLLKHSFFKNAKPPELTVKNILTDLPPLWDRVKALQLKDAAQLALKRMPSSEQEALSMSEYQRGVSAWNFDIEDLKAQASLICDDDPPEIKEDDDTGRITDIDRVHLLTIILGRQPLPMEILQ

SEQ ID NO: 68178 - DNA, 666 bp, Zea mays
  misc_feature: Ceres CLONE 1543793
  misc_feature: Encodes the peptide sequence at SEQ ID NO. 68179
  misc_feature (539)..(539): n is a, c, t, g, unknown, or other
gcggtggcggccgctctagaactagtggatcccccgggctgcaggaattcgtctcacccctagaaaaagtggtggaccagtcctctttcctcagctactgctcaccgccggcaccacgagcgtcaaccgcttcgccgacgcgatctcctccagcccccgctgccgcgatgcaattcctcagcgcctccgcctcagcctcctctctggtgccgccgtccgcgcacctcctccgcctctcgcggccccagcccttcccgcagctcctccgccgccgctccccgcccagacccctcgcgctcacgccccgactgccgctccccctcgtctcgcgaccctcccttctctccaccccacgcgcgcacggcggccacggtcacgggcaccaccacggccatgaccaccatcaccaccacggccacggccacggtcacggtcaccacgaggtggacgtgcacgggggaggcgggggcgcggcggtcatgcgggtggcgcgggcgatcggctgggccaacgtcgccgacgcgctgcgggagcacctnccactctgctgcatctccctcgggctccctctcatcgccgctgcttggccgcacgtcgcgctgctcaacttagtcaggccgctgcaaggcgctttcatcggcgtcgcttttcctctcgtcgggggtt

SEQ ID NO: 68179 - protein, 166 aa, Zea mays
  misc_feature: Ceres CLONE 1543793
MQFLSASASASSLVPPSAHLLRLSRPQPFPQLLRRRSPPRPLALTPRLPLPLVSRPSLLSTPRAHGGHGHGHHHGHDHHHHHGHGHGHGHHEVDVHGGGGGAAVMRVARAIGWANVADALREHLPLCCISLGLPLIAAAWPHVALLNLVRPLQGAFIGVAFPLVGG

SEQ ID NO: 68180 - DNA, 681 bp, Zea mays
  misc_feature: Ceres CLONE 1543799
  misc_feature: Encodes the peptide sequence at SEQ ID NO. 68181
  misc_feature (445)..(445): n is a, c, t, g, unknown, or other
  misc_feature (447)..(447): n is a, c, t, g, unknown, or other
  misc_feature (451)..(451): n is a, c, t, g, unknown, or other
  misc_feature (453)..(453): n is a, c, t, g, unknown, or other
  misc_feature (496)..(496): n is a, c, t, g, unknown, or other
acccgcggtggcggccgctctagaactagtggatcccccgggctgcaggaattcgtctcacccctagaaaaagttgttgcagtatctatctatttctgcgaatcatcttctagggctccgtttgttctcgcgcactttacccttcgctgcccccatctcccagcaccgaatccgcccccttcccggccgtcgattgagggcgtgccgctgccgattgcgccgcaaaatcgcgtcttgggtttggtccatgaagaagtggggttgatttctgatttcaaggggaggtttttctcctgcgcggccgccgccagggaggctccggcctgccagccatgtctcaaatccaaagcttctcgcggaacaactgtgtgctccttgtggtgctgtgtgggaagtatgctgagaagcgagcaccagcagcgaagtctgggctggaggcgaagcngncacngncgtcttacccatttccggagctcagctcagctgggcgattggnaggtcaaaccctgtttaatcctaccccagagcagttcctcaaggcccaacggggtggggcagcccaactccttggaacttcaggggtcacacctttaggaaaaaaaaagaaaatggccccttttggggggggggaccccaatttctctaatacccggggttttaaccctttttttcgccccccct

SEQ ID NO: 68181 - protein, 116 aa, Zea mays
  misc_feature: Ceres CLONE 1543799
  misc_feature (38)..(38): Xaa is any aa, unknown, or other
  misc_feature (39)..(39): Xaa is any aa, unknown, or other
  misc_feature (40)..(40): Xaa is any aa, unknown, or other
  misc_feature (41)..(41): Xaa is any aa, unknown, or other
  misc_feature (55)..(55): Xaa is any aa, unknown, or other
MSQIQSFSRNNCVLLVVLCGKYAEKRAPAAKSGLEAKXXXXSYPFPELSSAGRLXGQTLFNPTPEQFLKAQRGGAAQLLGTSGVTPLGKKKKMAPFGGGDPNFSNTRGFNPFFRPP

SEQ ID NO: 68182 - DNA, 691 bp, Zea mays
  misc_feature: Ceres CLONE 1543807
  misc_feature (342)..(342): n is a, c, t, g, unknown, or other
  misc_feature (391)..(391): n is a, c, t, g, unknown, or other
  misc_feature (541)..(541): n is a, c, t, g, unknown, or other
agctcaccgcggtggcggccgctctagaactagtggatcccccgggctgcaggaattcgtctcacccctagaaaaagccgcaattcacgggcgcagcgacctctcgtctcctctccatctagacaccactttcttctctccgcctcaggcggcgcgcgcgcggctagcttcccggcctcccagcaacatcccgccaccacttcctcctcctcctccgctctctccggccgcgcgcgccgacgtttttttttccaacggaggccgccgcgcgctgcctttagtttcggacccatccatccatacatagccaacatcacctatagcaggcggagggacggaggnaacgtcgtctcgttcactccgcgccgcgcgtggcccgatcccagccggncctcggacgccccccgctggcacgtacagcgacgaacacagcgggcgcggggtgcgggtccatggaagtctggcccggagttcttggcctccagcggcgggccccagtttcttgccgggcgggttggccggaatggcgggccttcttggngggccacccggtttgaaagcttccggattcccctcccaaaaccgcccgcccgggggggcaaaaaggccccggaaaagggcaccctttaagccccgggccttttaagggggaattccttcgcccaaaggggcccttgggcgcctttaacgg

SEQ ID NO: 68183 - DNA, 662 bp, Zea mays
  misc_feature: Ceres CLONE 1543811
  misc_feature: Encodes the peptide sequence at SEQ ID NO. 68184
ctccccgcggtggcggccgctctagaactagtggatcccccgggctgcaggaattcgtctcacccctagaaaaagcccctctcgattcggaaaacctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggcgggtcgttcactgttactcgt

SEQ ID NO: 68184 - protein, 162 aa, Zea mays
  misc_feature: Ceres CLONE 1543811
  misc_feature (28)..(162): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTR

SEQ ID NO: 68185 - DNA, 724 bp, Zea mays
  misc_feature: Ceres CLONE 1543812
  misc_feature (116)..(116): n is a, c, t, g, unknown, or other
  misc_feature (724)..(724): n is a, c, t, g, unknown, or other
ctggagctcaccgcggtggcggccgctctagaactagtggatcccccgggctgcaggaattcgtctcacccctagaaaaaattctgtacccaaccagaagagcagcttggcagggngccaactaagatcacagctgtctccatcaaggacgatcaactggagtaccttgaggagcgtcgtctcaatgatctggtcaagaagcactctgagttcatcagctacgccatctccctgtggactgaagagacaacagagaaggaaatttctcgactacgcaatacgaggcaagagcatcacaacatgcttgtagggaaaagaaaaagggttggaaggaatgttttggattggaaaaaggggaatggaaggacatccacacagggaatttaagaacaatgaaatctattcctgtggggaaagggtttctccccccccagtggaggttggggaaccttttgggggtttaaaaaaaaagggtaaaaaaccccccccccccacccccaaaagagagagataaactcccctataaataacaaatattcgctcggaagaaaaagaaaaataaaatggctctctgggccttttttttcattataaaaaaagactttgtgaacacaaatatgtttgtgggtgggggagggggggggagacaactcccccgggtacttttttttaaaagacaaatattattttttctttgtgtggaggaagagagggccctaacacn

SEQ ID NO: 68186 - DNA, 669 bp, Zea mays
  misc_feature: Ceres CLONE 1543818
  misc_feature: Encodes the peptide sequence at SEQ ID NO. 68187
ctccccgcggtggcggccgctctagaactagtggatcccccgggctgcaggaattcgtctcacccctagaaaaaaacccacagccaaaaaaaaaaaaaggcaaaacaaaggaaaaaaaaaggagaatatgcgccaccgcggccaaccgtcgtgacctcgccgccggtcaccggtccatggactccgccgccagcgtcctcgccatcctcagcaagctgcagtccctcggcttctgcgccgatctccgggtccccgacgccgtcgcggcctccgacccctcggaggcgttcgacgccgtcctcgccacgttcctgcgcgaggcctacaccggcggccgcgaggcgcggcctatccccgtggctcttggaaatggacgatgcgttgaccttctccgcctcttcctggccgtccgcgctgcagggggctacgccggcgtgcccaacactcccggtggttgggctgccgccgccgagtctgctggcattgactccgccctcgcggcgcccgtcaagctggtctacgcccagtaccttggtgccctagaccgctggatcccgaggctcgtggaagcacatgggcccttcttggacggcgacctgaggaagagggcagagctgttcattggtcccgatggagtggaggaagaaaaagggctctcgggctccaagg

SEQ ID NO: 68187 - protein, 164 aa, Zea mays
  misc_feature: Ceres CLONE 1543818
MDSAASVLAILSKLQSLGFCADLRVPDAVAASDPSEAFDAVLATFLREAYTGGREARPIPVALGNGRCVDLLRLFLAVRAAGGYAGVPNTPGGWAAAAESAGIDSALAAPVKLVYAQYLGALDRWIPRLVEAHGPFLDGDLRKRAELFIGPDGVEEEKGLSGSK

SEQ ID NO: 68188 - DNA, 575 bp, Zea mays
  misc_feature: Ceres CLONE 1543819
  misc_feature: Encodes the peptide sequence at SEQ ID NO. 68189
  misc_feature (350)..(350): n is a, c, t, g, unknown, or other
  misc_feature (372)..(372): n is a, c, t, g, unknown, or other
  misc_feature (373)..(373): n is a, c, t, g, unknown, or other
  misc_feature (377)..(377): n is a, c, t, g, unknown, or other
  misc_feature (479)..(479): n is a, c, t, g, unknown, or other
aaagctggagctccccgcggtggcggccgctctagaactagtggatcccccgggctgcaggaattcgtctcacccctagaaaaagggattgggttctgctgttggtcgaattccatccatttcttccgttgcatcggcccctcccttccttctctagttcccttcccttatagtattaactacgacgatggtggtggatgctggtgttggtgttggcggcggcggcggcgccgggacatgtgccgtcggaggattcgtctgggacgtgctgctgtggcgccggggccgcgccgacgtgagcgcctgcctgctggcgggcaccgtctcctcctggctgctcttgtacggcngctacaccttggtgtccctcgnnctcnacgtgctgctcctgcgtctcaacgtgctcttcctgtgggccaaagcggcgcgccttcctgacaagccgcagacctcccgttccggagctgcgcgttccgcancaagccgtggaacaagggggggggctgctgcgctctggtttgggaaccccgctcggaaggccttcgggacatcccgctcggcaagggatctcctgc

SEQ ID NO: 68189 - protein, 129 aa, Zea mays
  misc_feature: Ceres CLONE 1543819
  misc_feature (55)..(55): Xaa is any aa, unknown, or other
  misc_feature (62)..(62): Xaa is any aa, unknown, or other
  misc_feature (64)..(64): Xaa is any aa, unknown, or other
  misc_feature (98)..(98): Xaa is any aa, unknown, or other
MVVDAGVGVGGGGGAGTCAVGGFVWDVLLWRRGRADVSACLLAGTVSSWLLLYGXYTLVSLXLXVLLLRLNVLFLWAKAARLPDKPQTSRSGAARSAXSRGTRGGAAALWFGNPARKAFGTSRSARDLL

SEQ ID NO: 68190 - DNA, 614 bp, Zea mays
  misc_feature: Ceres CLONE 1543821
  misc_feature: Encodes the peptide sequence at SEQ ID NO. 68191
  misc_feature (614)..(614): n is a, c, t, g, unknown, or other
ctccccgcggtggcggccgctctagaactagtggatcccccgggctgcaggaattcgtctcacccctagaaaaatatgtagatgctctatatatctaggggttaacgtccaatatgtactgaaatatctcactgcttgcctgtagtttgtgttactttaacccgtactgaaatgcccagtgacttgtggagttgtttgcagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactgggccaaactcaatcattggcagagctgttgttgttcacgctgatcctgatgaatcttggaaagggtgggcacgagctcagcn

SEQ ID NO: 68191 - protein, 133 aa, Zea mays
  misc_feature: Ceres CLONE 1543821
  misc_feature (1)..(131): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTAVTGSVSGLKPGLHGFHVHALGDTTNGCMSTGPHYNPASKEHGAPEDENRHAGDLGNVTAGADGVANINVTDSQIPLTGPNSIIGRAVVVHADPDESWKGWARAQ

SEQ ID NO: 68192 - DNA, 593 bp, Zea mays
  misc_feature: Ceres CLONE 1543822
  misc_feature: Encodes the peptide sequence at SEQ ID NO. 68193
agctccccgcggtggcggccgctctagaactagtggatcccccgggctgcaggaattcgtctcacccctagaaaaagcggagggggcaagcagccagcagccgcgcggcgccaatgccttgccctgaagccctcacccaaacgcctcgctttggccgccccccacaaggccactcacccaaaaaatctccactcctcgaccgcaccgagcagaggatcacatggcatccgccgtttcgcttctcctctcgcccacacgcctgctacaccgcgacagcacatcccgcctcactcagcatcccgcaccggcgggtcatcctcggcgcccccaacaacgcgacccctcgtcggctcctgggcccagcgccgtgcgcctgcaacaaaaacgacaacagcgtggccggggaggcgcccgaccgactcgtggccgcgggcgcctacctataccagttcctctacagcgcgcaccacgggcgcttccttctcacgcaggtccccttatacggcgatctgctccgacctctggcatccggagctcggctcttccactcatcatcgctcacacccttcctcatacttctgagactctacttg

SEQ ID NO: 68193 - protein, 160 aa, Zea mays
  misc_feature: Ceres CLONE 1543822
MPCPEALTQTPRFGRPPQGHSPKKSPLLDRTEQRITWHPPFRFSSRPHACYTATAHPASLSIPHRRVILGAPNNATPRRLLGPAPCACNKNDNSVAGEAPDRLVAAGAYLYQFLYSAHHGRFLLTQVPLYGDLLRPLASGARLFHSSSLTPFLILLRLYL

SEQ ID NO: 68194 - DNA, 847 bp, Zea mays
  misc_feature: Ceres CLONE 1543822-R
  misc_feature (16)..(16): n is a, c, t, g, unknown, or other
ccgattgggtacctcnagcgtctcgtttttttttttttttttggggggacccaattaacaaagtcgtgtttccagtttgttctcaattattcgggcccccaaagaagcaaatcacacccgggaaagtagaaccccaagttgttccaacacccaaaacagattcctggccaaaaagaattctagcgaaaaacactggggcttagataggtattttgttgcttctgaacccccccagaaaaaaacgcctttccccctgggttattagataaggggaagagaacgccaaagcctctttcctccttcgctgccgccgcaaggaaattgggggagttggggtcaaggtatagaaaaaaaatggttttgcagttccgggccggaaaaaagattttcccctgtccccgggcaccgctggtttgactactgcatcaaccccaaacggtgactttaggggaccttggcggacccctcctttgggattgaagcacacggctggggaaaagaatgtgctcctccaaagggggagaggttcttaagccgcgccccggggggggggccaaaattgtttccaaggaggggtaaattaatgggcttcccataaagaaaaaaacctttgttatcttttgtatgcgtccaaaggggcccctttgccctgggaaaccaactttccgggaatccccctgggatctccaataccttgggaatggggtgattggaaaaagcctggaacccccccccccccccgaggaaaagttgccggggaaaatccctccccccctaaaagccggcatcccccttaatagaaaaaaagggcccccttttcgttcccccgcctagaaaaagaaacatt

SEQ ID NO: 68195 - DNA, 702 bp, Zea mays
  misc_feature: Ceres CLONE 1543847
  misc_feature: Translation starting site: 161
  misc_feature (310)..(310): n is a, c, t, g, unknown, or other
aaagctggagctcaccgcggtggcggccgctctagactagtggatcccccgggctgcaggaattcgtctcacccctagaaaagtcgtcgccaccgccactttgccccgcctcgtcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcnagggcgccggcggtcaaggggtccgggcatctcgtccgcaagggcaccggagggaggtcttctgtgagtggagtgtagccccggtgtttggagctactgggtttcttgggcgctatcttgtgcaacaactttgccagatggggtctcaggtgctggtccccattcaaggttgtgagggttctcctcgcccccctgaggatttggggggacttggggcagattggggcccttgaaataccttcccaagaggtgttggtttcaattaagggctgttttgggcccagtcaaattggtgtttttaacccctccagggacaagggtttgtaaaacagggaacctcccctttcaaagaaataacccccccctttgccccggaaaaagttggcaaaaag

SEQ ID NO: 68196 - DNA, 688 bp, Zea mays
  misc_feature: Ceres CLONE 1543858
  misc_feature: Encodes the peptide sequence at SEQ ID NO. 68197
ctccccgcggtggcggccgctctagaactagtggatcccccgggctgcaggaattcgtctcacccctagaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcgggtgtgcgccccgccagcagcagcagatgggtgatatttcagcctcggactacaaagaaggccaagacatgcaggggataccctgggggaaagactcaactacccccggggaccagtttctccggatgagggctcaaaaatacaagaacctcccgaaaccccccaagggccccaagccgggcttcaacaaccgggaatgcaacccggtgggaaggaaaggaaccattcaacgaagttcctctgaaacccaaaagacccgccaatcaacaaatggtgattttccggggacgggtttcaaacggggaactttttttggccaaaccccttgaaaaaaaaagtttttccgcccagaggagtg

SEQ ID NO: 68197 - protein, 153 aa, Zea mays
  misc_feature: Ceres CLONE 1543858
MAHDLCEDLELVADDGGGFDDYYWDDDFHFHDDGFSASPTTPGSGCAPRQQQQMGDISASDYKEGQDMQGIPWGKDSTTPGDQFLRMRAQKYKNLPKPPKGPKPGFNNRECNPVGRKGTIQRSSSETQKTRQSTNGDFPGTGFKRGTFFGQTP

SEQ ID NO: 68198 - DNA, 703 bp, Zea mays
  misc_feature: Ceres CLONE 1543863
  misc_feature: Pfam Name: Lectin_C Pfam Description: Lectin C-type domain
  misc_feature (36)..(36): n is a, c, t, g, unknown, or other
  misc_feature (305)..(305): n is a, c, t, g, unknown, or other
  misc_feature (387)..(387): n is a, c, t, g, unknown, or other
tccccgcggtggcggccgctctagaactagtggatntcttgggctgcaggaattcgtctcacccctagaaaaaatcgtcagaatttcctttttttttccttccccaacttctccctgcgtcggccgatgctgcggcgactgaccacagctttcgaccctctccagtggagggaacggggttagcgagcggcctccgctgcgacggcaacgcaacggcgtgggagggccatggcggcccccgcgctcgccttccccatgttgctggctgcctcactgctctccgtcgccgctcctgcgctggctcnaagcccatcttgccctgatggttggcaaggcggccctgttcagaatttatgctcccccacatgggggggggcgggtcttggnataaatcccaggctgtctgccataactacagcgggcatctcgctgcagtatcatcaggccgggagctaaacttcgtgaagtctctccgtggatcctcctccacaggatgcctgggttggaagggcttcactaccgcccctagtaccgggaacgggtgggaaaatggtcctgaagatttcccccggtttggaaaggagactgtccttcccttgggggaaccctttgcccggcccaccggccgggggatccccgcatggtaaagaaaaccccccccgcgaacccgatttggggggaaccttggggccacccaaagggg

SEQ ID NO: 68199 - DNA, 657 bp, Zea mays
  misc_feature: Ceres CLONE 1543866
  misc_feature: Encodes the peptide sequence at SEQ ID NO. 68200
  misc_feature (33)..(33): n is a, c, t, g, unknown, or other
  misc_feature (370)..(370): n is a, c, t, g, unknown, or other
ccccgcggtggcggccgctctagactagtggtntcttggctgcaggatcgtctcatcctaggaaagctttcctttccgttcacccaagcccccacctgcgagctgcgacaagttcgtctctctcgtggcccgactggccgccgcccccgcctccgtcccctcgcagattccaggtcttcgccgctcccttcgccgccaaagagcacccactaggttaaatccgccagggggaaatctccatcaagtggctcgtgctaattatgcgatcttcatgggctgactcatttgcgaacgccgaggaatcggcgcccccaactgctgctgctaatggctctgttgcacctcatagcacctgggggggtaggcgcanctcctacttgccttcccaccccccgggccgctcagcttggtggctcctgtttgaagcccaagcaggccttaataccacccgccccaggggggaaccccggccattgggctgctgcacaacccttttgggtccaggggcctccctgtggggggcccctccctggcgcgggcttttgaaaatggcgggcggggggggcggcgcgctattgctcctcccccgccagggcgcctgggtgcgcgcaagcggggggcccttgttttctgggaaccccccctcccctggggggg

SEQ ID NO: 68200 - protein, 132 aa, Zea mays
  misc_feature: Ceres CLONE 1543866
  misc_feature (37)..(37): Xaa is any aa, unknown, or other
MRSSWADSFANAEESAPPTAAANGSVAPHSTWGGRRXSYLPSHPPGRSAWWLLFEAQAGLNTTRPRGEPRPLGCCTTLLGPGASLWGAPPWRGLLKMAGGGGGALLLLPRQGAWVRASGGPLFSGNPPSPGG

SEQ ID NO: 68201 - DNA, 674 bp, Zea mays
  misc_feature: Ceres CLONE 1543868
  misc_feature: Encodes the peptide sequence at SEQ ID NO. 68202
  misc_feature (674)..(674): n is a, c, t, g, unknown, or other
tggagctccccgcggtggcggccgctctagaactagtggatcccccgggctgcaggaattcgtctcacccctagaaaaagtgcacaagcacaacacaacggccaccaccggaccaccggccctcgcaggtcgcgcaaccatttcccttggaaaacaacgcgcccacccgagcccggccggccccaaccactccaaccaaaccaaagcccaaacccgctttcccccgaaacccaggccctcgcgtcgtttgatgcgattccggcggcgatcgtcagcgcctccaacaccacccgctcccccgtcctagcgtgcgttcgggcgatctcccctctcgcggcggtcatggctggcgttggcggcggggcgcgcagctcagacagggcgggggcggcgcgctcgcccaccaccaccaccaccaccaccacggcgatccagtccaccatccagtcgatcaaggaggtcgtcgtcggccactccgacgccgacatcttggacaccctccgcgagtctaacatggaccccaacgagacggcgcagaagctgctgaatcaagatccatttcacgaagtgaaaagaaaaagggacaagaagaaagagagtgctggccagaagagctttgctgatagtactggacaagttgaccagaaccctcaatggatgaggccacatacccn

SEQ ID NO: 68202 - protein, 110 aa, Zea mays
  misc_feature: Ceres CLONE 1543868
  misc_feature (26)..(85): Pfam Name: DUF1296 Pfam Description: Protein of unknown function (DUF1296)
MAGVGGGARSSDRAGAARSPTTTTTTTTAIQSTIQSIKEVVVGHSDADILDTLRESNMDPNETAQKLLNQDPFHEVKRKRDKKKESAGQKSFADSTGQVDQNPQWMRPHT

SEQ ID NO: 68203 - DNA, 865 bp, Zea mays
  misc_feature: Ceres CLONE 1543869-R
  misc_feature (1)..(1): n is a, c, t, g, unknown, or other
nccccaatggggacctcgagcgtctcgtttttttttttttttttgtcaaacagaatgggaattgactgatatttacaatgttccatgcaacaaatatttgcagttttgcagcctagcctggtgctagcgcaagaatgaacaacaaataactgctggtcagccaggagctgacgcagagaatgaacgacaaacaactgctggtcagccaggagctgacgcagacgtgacaaaaacctgcaccaacacacgcatttgcaggttagccaggagctaacacatgcatgacatgacgaaatcgcgcccacttccacaaaactaaagccatatggtctgctcgttagccaggagctaacacgagctgaattcactacagcgactctgtcggcctaaatgcgcacatgttacccaggagctaacctgtgcacatacttggcgactttattcttctagattttgagggagatgaggtcaattaggcattggcctggattctcccggacggatcgacagtctgatggtgttttgagttactcgcagaagttggaggacccccatatattcgggaattgttggaatcaacaaaaaggctcttctgggtttccaacgaccccccatctaagaagccctgcccaagaataaccgaggggggaggtgaaagaccataagcggaaggctttcttgagcccatggacgaaattttcctaaacaaaaaaccgggcccccgaaatccagccaatatgggaaaatgaaaaaatgagggacccccccaaaaagggcggggggaaatctttttccgggaaaaaaaaactccccccccgcgggggggggggggggggaacaaccccttccccaaagttgtggtgtg

SEQ ID NO: 68204 - DNA, 660 bp, Zea mays
  misc_feature: Ceres CLONE 1543869
  misc_feature: Encodes the peptide sequence at SEQ ID NO. 68205
tggcggccgctctagaactagtggatcccccggggctgcaggattcgtctcacccctagaaaagcctagcctagcgccctagccttgcctgctctcctcatgccctggccgccgcctataaaagagcgaggcggagaggcaggcgccggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcgggtccgcgtttggcaccgtcggcggcgtccgcggaggcgggatcttcgtgcccatgctcaacctcggcgtcggcttcgaacacaaatccccggcgcgctttccaatggatgatgttgggggctcggggtcctccggttggtacaccctccagttggccccccaacaag

SEQ ID NO: 68205 - protein, 142 aa, Zea mays
  misc_feature: Ceres CLONE 1543869
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVRGGGIFVPMLNLGVGFEHKSPARFPMDDVGGSGSSGWYTLQLAPQQ

SEQ ID NO: 68206 - DNA, 733 bp, Zea mays
  misc_feature: Ceres CLONE 1543872
ccccgcggtggcgtcgctctagactagtggattcttgggctgcaggatcgtctcacccctagaaactttttccacttccccaactttacgccgcctctcatccccatctagtgtcctaatcgaaaaccccgtttgttagcttgaacagaagcgtccccgccgccccgcccggcggcgcgggcgcgcggcaatgggcgcccagaacgctgggacctcatcgattgccgacggcgatgtccccccatcccccgccgtggagttggattcccccgggggcggggggggccggtcttcgcggcgagtcctgatacagacgacctccccccagcgcgcaaccggtttttttccccccccccgggggggaagaagggggggcccccccccaccttctccttcctcctgttatacaaacgaccaaccgtctcctcctccccggggggccccgggggggttctcccgatggaggggccggcgtacgcttagccctctgccccccccggtaggcgtggtgggggggctccccccctccgatggcggtagcggccccgcgttccctcctctcccttgcgcgcgttgcccccccgcttgcggttccgcgcccaccgggccgcggggaccggcggtccgcgctccttccggccgcggaccgccgcgctggccttccaccgccctgcgcccacccgtcccggcgctgactgtttccccgcgacttgacgggcggtggtggtcgtcg

SEQ ID NO: 68207 - DNA, 644 bp, Zea mays
  misc_feature: Ceres CLONE 1543874
  misc_feature: Encodes the peptide sequence at SEQ ID NO. 68208
  misc_feature (644)..(644): n is a, c, t, g, unknown, or other
ggagctccccgcggtggcggccgctctagaactagtggatcccccgggctgcaggaattcgtctcacccctagaaaaaaaaaggccatcttctcttcctctcgcgtagcaccgcctctcaacctccgccgccgctcgcccggggcgtcacccacccgcgcagaaggcccccgccgctcaaattaccggtgccctaaaccccgatatcttcttcgcctccctttcctcctcagcaccccaaaccctgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcgcagatgaagaagaccctgaaaatgcatgatgaatcaaataagcgacagaaggttgatgatgatgtccaagagggtgctcttcctccttatctactcgatcgtgatcagacacagcgtgccaaggtactcagcaacacaatcaagcaaaagaggaaggaaaaggctggcaaatgggatgttccgctgccaaaggtcagaccn

SEQ ID NO: 68208 - protein, 126 aa, Zea mays
  misc_feature: Ceres CLONE 1543874
  misc_feature (1)..(126): Pfam Name: Ribosomal_S8e Pfam Description: Ribosomal protein S8e
MPQGDHIELHQKRHGKRLDHDERKRKREAREVHRRSKDARNLIGAKGKRFAKKRYAEKAQMKKTLKMHDESNKRQKVDDDVQEGALPPYLLDRDQTQRAKVLSNTIKQKRKEKAGKWDVPLPKVRP

SEQ ID NO: 68209 - DNA, 678 bp, Zea mays
  misc_feature: Ceres CLONE 1543878
  misc_feature: Encodes the peptide sequence at SEQ ID NO. 68210
  misc_feature (555)..(555): n is a, c, t, g, unknown, or other
  misc_feature (556)..(556): n is a, c, t, g, unknown, or other
  misc_feature (561)..(561): n is a, c, t, g, unknown, or other
  misc_feature (563)..(563): n is a, c, t, g, unknown, or other
  misc_feature (573)..(573): n is a, c, t, g, unknown, or other
  misc_feature (574)..(574): n is a, c, t, g, unknown, or other
  misc_feature (577)..(577): n is a, c, t, g, unknown, or other
  misc_feature (581)..(581): n is a, c, t, g, unknown, or other
ctccccgcggtggcggccgctctagaactagtggatcccccgggctgcaggaattcgtctcacccctagaaaaaatcctcgcccgcaacaccatttccgaacgggtcgcgcccgagcccgatatgcccgcgaagcccaggcccagccagacccaaagcgatgcgacggagatcgtgagatcgcgcgccgcagcctcctcccccgcccccgccgccggcgatgacctccgcagtcctcgccggccggaatgaggtccaccaggcgcatcagcaccaccgccaatgggctggcgcccgcgtcccgctcatgcccaagccgtcctccaaccctaaccctaggcgccaccgcgcgggcccaaaccctatccccagtggctcgccgccggagccgcgggccgctccggccgtcgcggccgagccctcgccgtcgccttcggggcacctgaacttcaggccgtcggaaatgacccccgccgaggcccggcacctccgcgcgcggctcaccagcgagctctgccgcgtccgcgctttcctctcccgcatcgactctggagannggggnangccgcccggnnccngggncccggagccccccgcgcgcgggccggccccgcccgcggcgctggtggaggcgatgcggaagcggggcgccggaccttctgatgcggctggcggaggt

SEQ ID NO: 68210 - protein, 72 aa, Zea mays
  misc_feature: Ceres CLONE 1543878
  misc_feature (31)..(31): Xaa is any aa, unknown, or other
  misc_feature (32)..(32): Xaa is any aa, unknown, or other
  misc_feature (34)..(34): Xaa is any aa, unknown, or other
  misc_feature (38)..(38): Xaa is any aa, unknown, or other
  misc_feature (39)..(39): Xaa is any aa, unknown, or other
  misc_feature (40)..(40): Xaa is any aa, unknown, or other
MTPAEARHLRARLTSELCRVRAFLSRIDSGXXGXPPGXXXPEPPARGPAPPAALVEAMRKRGAGPSDAAGGG

SEQ ID NO: 68211 - DNA, 711 bp, Zea mays
  misc_feature: Ceres CLONE 1543881
  misc_feature (79)..(79): n is a, c, t, g, unknown, or other
  misc_feature (80)..(80): n is a, c, t, g, unknown, or other
  misc_feature (311)..(311): n is a, c, t, g, unknown, or other
  misc_feature (313)..(313): n is a, c, t, g, unknown, or other
  misc_feature (346)..(346): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
attctggagctccccgcggtggcggccgctctagaactagtggatcccccgggctgcaggaattcgtctcacccctagnnaaaagctgatccctccccttccccgacatcaaccggcgcggcgcgaccatccccagccactattattattaccatcatcatcacctacccgctgccttcatcctcctcctcgccccttcccaccgccgattcctcgcgtcttcccgtcgtctccaactcgcctccagttcccgatttgcccaacgccagcgacgccgtcgcatttttatctcctgcgagggggggggaagncnttccatcttcttttttcaaaacctcacggaccnccccccacagtttttttttccccccctccagggaaaagaaaaaggggnnnnnncccccnnnnncttataaattgttggttttaaaaaaaaaacacccccccgcggccccgtcgggggccggcctttctaaaaaggaccttcccgttcctggtcggccaggttagcctttccttttttataataaactactcgctatctgggtttggcctatcctcgccccctattcattgcgcgcgtcctcgaagcacaggtctttctcctcacgacccagtcgcccaacattcaccgtgggctatcccccattgcatcacccactctgggatttggctgtttgtctctcctccttctcgctgttatggcttcac

SEQ ID NO: 68212 - DNA, 672 bp, Zea mays
  misc_feature: Ceres CLONE 1543885
  misc_feature: Translation starting site: 389
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaaatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggccctt

SEQ ID NO: 68213 - DNA, 669 bp, Zea mays
  misc_feature: Ceres CLONE 1543888
  misc_feature: Translation starting site: 448
  misc_feature (529)..(529): n is a, c, t, g, unknown, or other
ctccccgcggtggcggccgctctagaactagtggatcccccgggctgcaggaattcgtctcacccctagaaaaacttcctcttccactccccaaccactccctccgcgccgatcgatccgtcccgtctgggaggcagctcgacgagagagagagagagagagagcgcgcgccaaggaattgacggttcgcggggaggaagcagagcagagcaggagaggagctgacgcggcggcggggccgagacggcgtggaggcatggacgggcacggcggcggggccggtaagctgacgcggacgccgtcgtcgctgctccgttcgccgaccgtccgcgcgggccccggcgccgcgtccttccacgccgtcctcgacgacccggagcccgacgacaagaaggcgcaggcgccgccccgggcgctgctccgccgggcccaccacaggctccgcccatgcccaacccagtccttgctcctcctcctcttcccccgcccctcgcgctcgccgcgctgctcctgcgcgggggcgacggcngccgccacctggccctcctggcagccgcggcggggttcgcgctcgcggccgccggccgcgccgccgccggggagctccgcagtgcccgggcgagcgggccgggcttccctggagtggtttctcggccaaggccaccgcaa

SEQ ID NO: 68214 - DNA, 805 bp, Zea mays
  misc_feature: Ceres CLONE 1543888-R
  misc_feature (103)..(103): n is a, c, t, g, unknown, or other
cggtgcaaaccggcaagatttgccatgggaacatttgaccccgagcaagaggacaccgtacatgtacaacgcacatacagtacagggcgcagcaaagaataangagaggcactgacagatcgtctccaccgacccccatcgatacgatacccatggacgatggaggcatggagctatctaccagctcacagtctgcacaaggccgaggaagaacagtctcagcgatccaaatccatcacggccggcgggcgtgaacctcttgatgatgatgaaaaccgcagcagctcaaacccttcggtggctgccatatatatactgacctctccaacacggagcacgcagttgtgctgctccggtcgcgcgaacctcagcaactaagcttgttgccacacgaatcatggacccacttaacacgtcgatgaagcagaacttgccatcgaccctattctgcactgccttgatcgcggcgacacgggcggccgtggcccctcggttggcagccatgacggccccgttcacctgctcctctactctcgggaagtggaaggcgccgtccacagccctccgagcagcctatagtaatcgcgggcacaataatgagtagtgagtgtgaaacgatttgagttcctggacagcaaggaactcatacctgtagggcgcgatggacagctgggtctgacagaggcagcgacttcttcaggactccagagtcccactcccccgcccgttcgtccccgttccggaacgcgtacgtgtccagcccccgcttcttcccttcgtgccatgagccctcgtagcctgtgct

SEQ ID NO: 68215 - DNA, 713 bp, Zea mays
  misc_feature: Ceres CLONE 1543893
  misc_feature (42)..(42): n is a, c, t, g, unknown, or other
  misc_feature (66)..(66): n is a, c, t, g, unknown, or other
  misc_feature (382)..(382): n is a, c, t, g, unknown, or other
  misc_feature (384)..(384): n is a, c, t, g, unknown, or other
  misc_feature (392)..(392): n is a, c, t, g, unknown, or other
  misc_feature (621)..(621): n is a, c, t, g, unknown, or other
ctccccgcggtggcggccgctctagactagtggattcttggnctgcaggaatcgtctcatcctagnaaaacgctcgccttattctaaccacaccggctaagcgccactgcacacgtcactcgctgtccgttctagcataccgcaccacacttcggcgccggtccgcgagcagatcaacagatggccacggcgacctacctctcctcctcctccttctcctcgccgccgccgcccccaggatcacgcgcccgcctgcggcggcagacgaccatgtcccccgcgtcggcggggaacggaccccccgcccgaggtgctttccccgaagcgcccggccccccctgcggatgtttcccccccccccacggggggggggggggggggntnttttcccnaaacaatttccccccccttctcccggggcggggcggccccaaagggttgcgggggggggcggggggggcccccacgggtcctccggggggggggtccaccggtccggccggggcccctgccgggggacccctaccccccccccaaatttgctgtctcttgaaacgccggccccggtcccggcggcgcctggcgaccgagttttgtttgatcaaagcgaagcgaagatantaacacccccccacctacccgaacctccctctggggggggcccccgcgtcgggattacttactcctcgcttggtcgtcccgggcagaccccg

SEQ ID NO: 68216 - DNA, 853 bp, Zea mays
  misc_feature: Ceres CLONE 1543906-R
  misc_feature: Pfam Name: OSCP Pfam Description: ATP synthase delta (OSCP) subunit
acgattgggtacctcgagcgtctcgtttttttttttttttttgcccccccaaaattgaacacccaatggggttcgtttctttagcaataaaaacgtctacaacctcagcaggaaggaaggggacggcaattaattttttcccctttcaatttcacacacgccttacacaggaaaactgttgttgccatggggcaccgttcggttttgtccttctgggggagaacagtaaaagctggtttgggaacctgggccacggggaccgccccccgtgctttgccccgaaacatctggggttggagcgacgggaaatggtggggggggtgtccaaggacatgggcggtctggcccatggagttgacccgcctcttgaacgccccgagaaggcccctgacccggaagtccatgacctgggagtcgaaaatgccgtacctgatgaccaaggcggagatgggggaaacctcaaccggggcctcgaccctgaggtccacaaaagcggggagcggggaaacctcgtgaacaatgccctgggtctggcgcgagaccaccccctcggcggatgtcaccaggacccggaacgtgaccatctgcggggggggagggggaatggacctccccgtcagggacgggggggccatggaaaaattccggccccaggactaccccagcaagtccatctggaaaggatggaaaagggcccccactggaacggggaccgggacttgggagaaaacccatgtacccctctattggggtgaacccaaaggaatcatacgggcccggcaaaaccctctggacttgccaaaatggggaggggcgcactgggaaccccccccaccaacgccctcttgggggg

SEQ ID NO: 68217 - DNA, 630 bp, Zea mays
  misc_feature: Ceres CLONE 1543906
tccccgcggtggcggccgctctagaactagtggatcccccgggctgcaggaattcgtctcacccctagaaaaaaactgctgcgtcgcgtagtctatctgcttctcctcctctcgagctaagcttccctgtcgttccctccgatcaccatctgctgattgctgagcctggaaccaacgcgtttcattggcagcgatgaagatattaaaccaactcatcagcccagggggccacccggtgtcgttcacgccggccgcggccaaggagagcaggcatttcttgccggcacaacctaacaccacgtgcggccgcaggacggtcccatgcgcactggcctccgtggcaagctcagactctgcgactggccaacacttacctccgggtagaacacatccaccggaccaccgcttccgtaccactaccagatccagtgccagtcagcggtcgcgttcaagacgctcaggatccacttcctgtcgtcgctcctggaacggagctgctgcatggcccccggcgtcccggacagagagggcagtgccccgccgccgccaaaaatggtcgcgctccgggtgctggtgacctcacgactggagctggacgatcgccacgtcgagtgcatcgcgcgctagatg

SEQ ID NO: 68218 - DNA, 819 bp, Zea mays
  misc_feature: Ceres CLONE 1543906-R2
  misc_feature: SWISSPROT Homolog: EC 3.6.3.14 H(+)-transporting two-sector ATPase
tagcgttcgtttctttagcgatagaaacgtctacaagctcagcaggaaggaaggtagcagcaattaagttttctcgctatcgatttacaacagcattacataggaaaactgttgttgccatggcgcgcgttcagttctgtcattctgtgcgtgtacagtataagcttgtattgtaagctgtaccacggtgaccgagcgctgtgctttgctccgatgcatctggtgttggatcgactgtcagtggtggtgtaggtgtccgaggacatgcgcggtctggtccatggagtcgacgcggctcttgagagccgcgagctggcccctgacactgaagtcgatgacctgcgagtcgtcggtgccgtaccagacgaccaagccggcgatgatggacacgtccacggcggtctcgaccttgaggtccacaaagcctgtgaggcggcacatcttgcgcgcgatgcgctcgacctggcgcgcgtccagctccacggcggatgtcaccagcacccggagcgctgactatctgcagcggcggaagggcgatgggactccccgtccaggacggctggggctatgctacaattccagcccaagaactgacacaagaagtccagcgtgagcagctggaacagggccgcagactgcactggggacggggcctgggacgaacgcggtggtaccgtcgtattggtggacgccaacgtatctagctgcccggtcccagcctctgttcctgccaccgagggcaaggacgcatgggaccacccccaaaacggcctttgtgggctgcctcccacagttcaaaaaaagcccgcccttccttgg

SEQ ID NO: 68219 - DNA, 720 bp, Zea mays
  misc_feature: Ceres CLONE 1543908
  misc_feature: Encodes the peptide sequence at SEQ ID NO. 68220
aagctggagctccccgcggtggcggccgctctagaactagtggatcccccgggctgcaggaattcgtctcacccctagaaaaaggcacgaccttctagttctagatgattctcaaacccacttccgggctgccgccgaggttatctacaacaccgagcagcgagaaggggttggtgtccagcacgaattgaatcgtcgccagaagtcatggcggattcggccacttcccgtccaaccgttctcgtcaccggcgccggcggccgcacaggccaaattgtctacaacaaactgaaagagaggtctgagcagttcgtggcaagagggctagtcaggacagaggagagcaagcagaagattggggcagccggtgatgtttacgttgctgacataagagacgcggatcgtctagcacctgctgtacaaggtgtggatgcgctcataatcctcacaagtgctggccccgaaaatgaaaccgggtttcgaccctagcaaaggtgaccggccgagttctactacgaagacggaatgtaccctgaacaggtggatttgggtggccaaaaaatcagatccatgctgctaaagctgctggatgaaagcattggggctggggggaacctttgggagaaaaaatcttaactttcccttaaaggcttgggtaatggcaatatcttggttgggaacccaaacaaaaaattttttgggaacagggaaaccctttta

SEQ ID NO: 68220 - protein, 93 aa, Zea mays
  misc_feature: Ceres CLONE 1543908
MADSATSRPTVLVTGAGGRTGQIVYNKLKERSEQFVARGLVRTEESKQKIGAAGDVYVADIRDADRLAPAVQGVDALIILTSAGPENETGFRP

SEQ ID NO: 68221 - DNA, 693 bp, Zea mays
  misc_feature: Ceres CLONE 1543914
  misc_feature (399)..(399): n is a, c, t, g, unknown, or other
ctccccgcggtggcggccgctctagaactagtggatcccccgggctgcaggaattcgtctcacccctagaaaaagacgcacggttctgccatcgcgcgattcccctcctccatccctattcctccgcccgcgattcccctccccgcgccctcgccgccgtcctcacggccagccgaggatagccgtcgcgcccgcaaatcacgcgaccatgccctttcatgcccgcaaatcacgtcgcctccttccatccatggcagtcgcgctccctctacgcccttccatccatggccgcggatccctgcgcgccacgattcttcccatacgctccctctgcgcccttccatccatggccgcgaatccttgatggtggagaggggggagctgaaccgggagatctcncggcccccgctaacagaactggagcgggagcaggggctgatgaaccaccaggggaagattcccggctgggaacggctgccgcgggtgggggcgccggcaaacacgccttggccttcctcgcgttcgctggccagggggcatcgaccgtcatcccctttgttcggggggccctgcgcgggttgaaaaaacggcgccaaaaaaaggggtgggccggaagccccccgggcccccaaccggcaaaaacccccggggcggaaagaaggtgcctcttacccttggacctgaaaccgctcg

SEQ ID NO: 68222 - DNA, 714 bp, Zea mays
  misc_feature: Ceres CLONE 1543916
  misc_feature: Encodes the peptide sequence at SEQ ID NO. 68223
  misc_feature (402)..(402): n is a, c, t, g, unknown, or other
ctccccgcggtggcggccgctctagaactagtggatcccccgggctgcaggaattcgtctcacccctagaaaaagcgaccccaggtcagtcgggactacccgctgagtttaagcatataaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctnaaaaaaaaaaaaaaaacgagacgctcgaggtacccaattcgccctatagtgagtcgtataactccccccccactgtcgggaacctcccccgaccccgacggggaaaacccttccgggttcccactcaaaaaacctaccatgaggcccccttgcaaaaaaaggcgcattagggggctcgccaggacccctcaaacttcccggcagatacccaagccggaagatcgaaagggattgggaaccgtgaaacatgcgtggagacacacatttcatcggaggcattgggggcctggtgaaagatataacccgacctgg

SEQ ID NO: 68223 - protein, 45 aa, Zea mays; identical to SEQ ID NO: 10997
  misc_feature: Ceres CLONE 1543916

SEQ ID NO: 68224 - DNA, 666 bp, Zea mays
  misc_feature: Ceres CLONE 1543921
  misc_feature: Encodes the peptide sequence at SEQ ID NO. 68225
tggagctccccgcggtggcggccgctctagactagtggatcccccgggctgcaggaattcgtctcacccctagaaaaaaccacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataaccccagtgggtctaaggaggacttcgggatcaaatacaacatgggaaatgttggggcctgctccgaatctggtacccgacagaatt

SEQ ID NO: 68225 - protein, 154 aa, Zea mays
  misc_feature: Ceres CLONE 1543921
  misc_feature (16)..(154): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTASHNPSGSKEDFGIKYNMGNVGACSESGTRQN

SEQ ID NO: 68226 - DNA, 709 bp, Zea mays
  misc_feature: Ceres CLONE 1543922
  misc_feature: Encodes the peptide sequence at SEQ ID NO. 68227
  misc_feature (477)..(477): n is a, c, t, g, unknown, or other
aaagctggagctccccgcggtggcggccgctcctagaactagtggatcccccgggctgcaggaattcgtctcacccctagaaaaacctcccagaatgccgccgccgactccaccacgccttccaagatgcgcggcgcgtccagcaccatgccgctcaccgtgaagcaggtcgtcgacgcgcagcagtctggcacgggcgacaagggcgctccgttcatcgtcaatggcgtcgagatggctaacattcgacttgtggggatggtcaatgccaaggtggagcggacgaccgatgtgaccttcacgctcgacgatggcaccggccgcctcgatttcatcagatgggtgaatgatgcttcagattcttttgaaactgctgctattcagaatggtatgtacattgcggtcattggaagcctcaagggactgcaagagaggaagcgtgctactgctttctcaatcaggcctataaccgatttncatgaggttacgctgcatttcattcagtgtgttcggatgcatatagagaacactgaattaaggctggcagtcctgcacgaatcagttctctatgggagtgtcattctcaatggattcagtgatcacccacacgacatcttgaaaatcagtcagcacggtgaccagcggcatccggaactgatctccaccgccagtcctgaattttttatgaacagcaacctcaaagtgactg

SEQ ID NO: 68227 - protein, 194 aa, Zea mays
  misc_feature: Ceres CLONE 1543922
  misc_feature (40)..(114): Pfam Name: tRNA_anti Pfam Description: OB-fold nucleic acid binding domain
  misc_feature (117)..(117): Xaa is any aa, unknown, or other
MRGASSTMPLTVKQVVDAQQSGTGDKGAPFIVNGVEMANIRLVGMVNAKVERTTDVTFTLDDGTGRLDFIRWVNDASDSFETAAIQNGMYIAVIGSLKGLQERKRATAFSIRPITDXHEVTLHFIQCVRMHIENTELRLAVLHESVLYGSVILNGFSDHPHDILKISQHGDQRHPELISTASPEFFMNSNLKVT

SEQ ID NO: 68228 - DNA, 654 bp, Zea mays
  misc_feature: Ceres CLONE 1543925
  misc_feature: Encodes the peptide sequence at SEQ ID NO. 68229
ccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtctt

SEQ ID NO: 68229 - protein, 136 aa, Zea mays
  misc_feature: Ceres CLONE 1543925
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHV

SEQ ID NO: 68230 - DNA, 723 bp, Zea mays
  misc_feature: Ceres CLONE 1543926
  misc_feature: Encodes the peptide sequence at SEQ ID NO. 68231
  misc_feature (677)..(677): n is a, c, t, g, unknown, or other
aagctggagctccccgcggtggcggccgctctagaactagtggatcccccgggctgcaggaattcgtctcacccctagaaaactactttgtacccgcgccgctcacgcccatccatcccttcgcgcacgcaacgcaaaaacaagcacaaacacgcgcgatccgatctgggccggccaagcagccacccatccatggcgactagggtttggctcaccgccctcctgcttggtttcctcgtcgccgcctcccccttcaccagccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactagcaggtgaagaaactgaattactagttggtctgcaaaatgacggtgaatcaattttgaatgttgttgctgttcattcaactctccatcttccttttgaccacaatatgtatggccagaaccttactgttcagaatttcttcaattcatcagttcctgtttctgtgcaagcaaccttcccctacaagttcgttgtgagcaagttcttgcagcctggagcatatgatctgggtggttacatagntgtatgagatcgaccagcacccttaccagaatgtattctacaatgc

SEQ ID NO: 68231 - protein, 163 aa, Zea mays
  misc_feature: Ceres CLONE 1543926
  misc_feature (162)..(162): Xaa is any aa, unknown, or other
MATRVWLTALLLGFLVAASPFTSRVARAESEEDAAAAEVVEGADLGIVGDDTQVSSDGPLSPAPGVETVVVFPKNAGKIVLAGEETELLVGLQNDGESILNVVAVHSTLHLPFDHNMYGQNLTVQNFFNSSVPVSVQATFPYKFVVSKFLQPGAYDLGGYIXV

SEQ ID NO: 68232 - DNA, 671 bp, Zea mays
  misc_feature: Ceres CLONE 1543928
  misc_feature: SWISSPROT Homolog: EC 2.7.11.22 Cyclin-dependent kinase
acccgcggtggcggccgctctagaactagtggatcccccgggctgcaggaattcgtctcacccctagaaaaatgaaggtttggtgacgtcacgcatgtcaagcagcttgtatcttgtatttgaatacatggagcatgaccttgcaggccttgcagctaccccaggcttaaaattctcagaacctcaggtcaagtgttacatgcaacagctactctctggacttgaccattgtcataaccgtggtgttttgcatcgggatataaagggtgcaaatctcctacttgacaataatggcattcttaaaatagcagattttggtctagctacattctttaatcccaaccaaaaacaacatttgaccagtcgcgtagggacgttgtggtaccggccctctgagcttttgttgggttctactaactatggtgctgctgttgatctatggagtgccggttgcatttctgctgatttgctgtcagggaagctatcctggcaggacaaactgaggtggaacagttcccaagatttttatagctttgtgggtcaccctcagaagaatttttgggctaatctgaagttttcccgagcctccctttccaagccccacattccttaccccccaattttcgaattaatttttttaagggactcccctacacacggctttaaacccg

SEQ ID NO: 68233 - DNA, 722 bp, Zea mays
  misc_feature: Ceres CLONE 1543934
  misc_feature: Encodes the peptide sequence at SEQ ID NO. 68234
  misc_feature (274)..(274): n is a, c, t, g, unknown, or other
  misc_feature (312)..(312): n is a, c, t, g, unknown, or other
  misc_feature (559)..(559): n is a, c, t, g, unknown, or other
  misc_feature (615)..(615): n is a, c, t, g, unknown, or other
  misc_feature (616)..(616): n is a, c, t, g, unknown, or other
  misc_feature (681)..(681): n is a, c, t, g, unknown, or other
aagctggagctccccgcggtggcggccgctctagaactagtggatcccccgggctgcaggaattcgtctcacccctagaaaaagacggtagacggaggagctagcttgccaattgccattgcactgcgcgcgcgcacctcacatccgccgccagcaggtgccaccgccatctctgctttctctctctctctctctctctctctctcaagcaacgcccgcctgcccgcccgccatggtgaccatagccacgatggccctgctgagccccgccagnatcgtggcgcggtctgcgccgccgtccaccaagcgcancgtctcgctgcgcgtaccggcgcgggccaagaaaggccccggtgtcctttgtccccgcccccccgccgtggggggggggggtccttcccggcgctggcttcttcccaccccacgctggcggcccaaacccttggtgaaactgggggggggggccgaccccggggacgaaaaaccgaggggaaatggcgtgcccttcgggggggcccccccccccccggggggggggttttttaaagtttttgaaatngggggtttgaaacccgtttaaccgctatgtgccccccggacctcccgccccctcgnntttgtgtcttctgggccccctcccccttagaatacggggcgctcccgctcccccccccaaccagngcgagggggaccccgtcccccgccttgttcctccccccgcc

SEQ ID NO: 68234 - protein, 115 aa, Zea mays
  misc_feature: Ceres CLONE 1543934
  misc_feature (14)..(14): Xaa is any aa, unknown, or other
  misc_feature (27)..(27): Xaa is any aa, unknown, or other
  misc_feature (109)..(109): Xaa is any aa, unknown, or other
MVTIATMALLSPAXIVARSAPPSTKRXVSLRVPARAKKGPGVLCPRPPAVGGGGPSRRWLLPTPRWRPKPLVKLGGGADPGDEKPRGNGVPFGGAPPPPGGGFFKVFEXGGLKPV

SEQ ID NO: 68235 - DNA, 669 bp, Zea mays
  misc_feature: Ceres CLONE 1543935
  misc_feature: Translation starting site: 397
  misc_feature: SWISSPROT Homolog: EC 3.2.1.14 Chitinase
  misc_feature (309)..(309): n is a, c, t, g, unknown, or other
  misc_feature (394)..(394): n is a, c, t, g, unknown, or other
  misc_feature (396)..(396): n is a, c, t, g, unknown, or other
  misc_feature (410)..(410): n is a, c, t, g, unknown, or other
  misc_feature (415)..(415): n is a, c, t, g, unknown, or other
  misc_feature (418)..(418): n is a, c, t, g, unknown, or other
gagctccccgcggtggcggccgctctagaactagtggatcccccgggctgcaggaattcgtctcacccctagaaaaaatagaactagagccagctccttgttgcccatggccatgacgagagcactggccatggtggccatgttggccactgctgccttgttcttcatgtccgctcgcgcacagcagtgcggtatgcaggccggcggcgcgctctgccccgactgcctctgctgcagccagtggggctattgcggctccactcccgactactgtaccggcggctgccagagccagtgcatcggcagccngctgcggcggctgcggcggtggtacccctgctactcccccgagcggtcctgtgtctcacatcatggggggagggggtgttcaacnanatgctgctgcaccncaacnacntggcgtgcccggccaccggcttctacacctacgacgcgttcatcgcggccgcgaacgcgttcccgggcttccggcacacgggcggcgccgacacccagaaacgcgagctggcgggcttccctgcgcagacgtcgcacgagaccacgggcgggtgggacacggcccccaacgggccctaaacttggggcctactgcttcaaggaggaagtcggccggctttggggggccgaaatactgcccgccccaacccc

SEQ ID NO: 68236 - DNA, 562 bp, Zea mays
  misc_feature: Ceres CLONE 1543938
  misc_feature: Translation starting site: 169
  misc_feature: SWISSPROT Homolog: EC 1.4.1.2 Glutamate dehydrogenase
  misc_feature (186)..(186): n is a, c, t, g, unknown, or other
  misc_feature (203)..(203): n is a, c, t, g, unknown, or other
gcgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcnatcgatctcggcaccgnacggtactcttgcgtcggcgtgtggcagcacgaccgcgtcgagatcattgccaacgaccagggtaaccgcaccacgccctcgtacgtcgccttcacgactcgagcgcctcatcggagatgcggccaagaacccaggtcggccatgaaacccccatccaaacacgggtcctttgatgccaagcgtctcatcggcaggaggttcagtgatgcgtctggtcccgagggatatcaaagttggtggcccttcaagggcatttccggggcctgggggaaaaacccaataattgtttcccccccacaggtggaggaaacccatttcccccctaaaaaaaccccccccaggggttcttttcaaaaga

SEQ ID NO: 68237 - DNA, 688 bp, Zea mays
  misc_feature: Ceres CLONE 1543940
  misc_feature: Encodes the peptide sequence at SEQ ID NO. 68238
  misc_feature (454)..(454): n is a, c, t, g, unknown, or other
  misc_feature (477)..(477): n is a, c, t, g, unknown, or other
  misc_feature (582)..(582): n is a, c, t, g, unknown, or other
  misc_feature (627)..(627): n is a, c, t, g, unknown, or other
tggagctccccgcggtggcggccgctctagaactagtggatcccccgggctgcaggaattcgtctcacccctagaaaactccattcattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctancacgagcttcgtgttgccccagnagagcaccctgtgttgctcactgaggctcctttgaacccaaaggccacagggagagatgacccagattatgtcgagactttcatgtcctgcccatgtacgtgcanttcagcagtgctgtcactctatgccatgacgtactactggaatgntctcactccggggaggggtgatccccctgggcatttttgaagaattgctttcccaggcctt

SEQ ID NO: 68238 - protein, 163 aa, Zea mays
  misc_feature: Ceres CLONE 1543940
  misc_feature (4)..(163): Pfam Name: Actin Pfam Description: Actin
  misc_feature: SWISSPROT Homolog: EC 2.7.10.2 Non-specific protein-tyrosine kinase
  misc_feature (93)..(93): Xaa is any aa, unknown, or other
  misc_feature (101)..(101): Xaa is any aa, unknown, or other
  misc_feature (136)..(136): Xaa is any aa, unknown, or other
  misc_feature (151)..(151): Xaa is any aa, unknown, or other
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFXHELRVAPXEHPVLLTEAPLNPKATGRDDPDYVETFMSCPCTCXSAVLSLYAMTYYWNXLTPGRGDPPGHF

SEQ ID NO: 68239 - DNA, 935 bp, Zea mays
  misc_feature: Ceres CLONE 1543943-R
  misc_feature: SWISSPROT Homolog: EC 3.2.1.21 Beta-glucosidase
ttgggacctcgagcgtctcgtttttttttttttttttcgtgaataatgtaactgttggtttcaaatactcctgtaacaactaccaaacaaaactggctctcaacaataagccctgaatcatggtcgcattcctacaacgggtcccgcatccctgcgacatgtcctgattcttccaaggaacatgttgtcgtccacgcgactacaaattcttactatgaaaataccttgctaatttcaccgaggaaaccctgaagatggatggaagcaaaacacccaaggagaccaaaagggagaccattaaggcaggtccgtttcaggtggctgaaaccgaaccagccgggctgcatcctgaaccactctgtggggtagcagtcttggagcccgtaccccaaagcatgtccctcaaccactatgcacagtccttgggggaccgattgagcctcgcaaagtctacgaacacaatgccgaacttggacgtgtagcccgacagccactctaagttgtccaggagagaccactctaagtaatcgatcacgttcgcgcctccggcgatccttctcttaacctccgtccggcagttcatgaacaagtcgatcctctgtgggttgtgcaagtactcctcgctcgtgaggtttccagactgatcctttccgttatccgaaattatgatgattggaccatggaaccctttgccttgaaatggttcggcgctcccctatatggcccatatggaaccattataaacccgagtgggggggaggcaaactgttgcaaatctccaaagacattccttttttaaaaggaaaattagaaacctcctcgcacctgcaaaaattaacacaggggcggacccccgacagaaagaaaatttgtttgtctcccggcccacagtttgaatctcaacaacaaaataactgtgcatggtggcgcacaaa

SEQ ID NO: 68240 - DNA, 620 bp, Zea mays
  misc_feature: Ceres CLONE 1543945
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (103)..(103): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (128)..(128): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (344)..(344): n is a, c, t, g, unknown, or other
  misc_feature (347)..(347): n is a, c, t, g, unknown, or other
  misc_feature (575)..(575): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggcccntttctttnnnnntnnnnnnnntttncnnnnnnnnnnnnnnnnnnnnnnnnnnnnnnnnnnnnnnccaaattgggactccccgcggtggcggccgctctagaactagtggatcccccgggctgcaggaattcgtctcacccctagaaaaagatctggccacccgagcacggccaaaaaggcgctcgcccagcgcttcaccagatagagcaacacagctcagctcagctcagcctcggaacancanccggcgtgcggagctgcggtgcggggtcctgcgtgcgccacaaacaagatgcttgcccgcccgggtgcggcctcccctctcgtgcctcccgcctccaacaaacaagggggaacccggggccgaaaaccaaacccccccccgttcccgggaaacaaaacccccccccccgttccccttcggggcaaaaggggcaaaccgggggtgtccttttcttgggcccccaagcgnggggnnnnctccctccccgtgggggggggcccaaaaaaaaaaaac

SEQ ID NO: 68241 - DNA, 729 bp, Zea mays
  misc_feature: Ceres CLONE 1543948
  misc_feature: Encodes the peptide sequence at SEQ ID NO. 68242
  misc_feature (460)..(460): n is a, c, t, g, unknown, or other
  misc_feature (480)..(480): n is a, c, t, g, unknown, or other
  misc_feature (546)..(546): n is a, c, t, g, unknown, or other
ctccccgcggtggcggccgctctagaactagtggatcccccgggctgcaggaattcgtctcacccctagaaaaaaaagggagacataaattggaggccattatcaagaaaccatgagttctaggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattcggtatgccaaagagcccgccggcgccggtttccgggccgccggcgtccgccgccatgcagagcgtgcgcatggcgtacacctcggacggcaccgctgtgttcgctccgatgagatcctcggccgcgacgccgtcttaccagccgcatggtgcagcccacggcgctagcatgtccgcggcgacnatcattggaggcaatggcgncgcagctgcgccgagcatggggggagccggtgcccaagaagaagcgcgggcgaccaaaggaagttngggcccgacgggtccatggcccttgcattgggtgccctgtgttggcgggcttccggggtccgccaacaacagggcaggggttcttctgggggcgtttccccccggctgggggaaaatttgaaaaaactcctttgttgggaccctcccccggaaagggttcaaaaacgggggccggcctaaagg

SEQ ID NO: 68242 - protein, 145 aa, Zea mays
  misc_feature: Ceres CLONE 1543948
  misc_feature (84)..(84): Xaa is any aa, unknown, or other
  misc_feature (106)..(106): Xaa is any aa, unknown, or other
MEVRSEQGLMAGRDLFGMPKSPPAPVSGPPASAAMQSVRMAYTSDGTAVFAPMRSSAATPSYQPHGAAHGASMSAATIIGGNGXAAAPSMGGAGAQEEARATKGSXGPTGPWPLHWVPCVGGLPGSANNRAGVLLGAFPPGWGKI

SEQ ID NO: 68243 - DNA, 665 bp, Zea mays
  misc_feature: Ceres CLONE 1543949
  misc_feature: Encodes the peptide sequence at SEQ ID NO. 68244
ctccccgcggtggcggccgctctagaactagtggatcccccgggctgcaggaattcgtctcacccctagaaaaaaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaagggatagggagcgtgacagggatcgtggccgagaaaaggggagggaccgagacagggataaggatcgtgaaaagaagtgaccgagacagaagattgcgatcgcccccccgggaacctccgagagccccccgggaaagggaacccccgggatcttcctgattatcgggaccgtcccccgggtgggccgggaccccccccggggttgttcttgtttctgaaaggaaaaaaaatccggccccaaatgggcctcccgggggtcccc

SEQ ID NO: 68244 - protein, 84 aa, Zea mays
  misc_feature: Ceres CLONE 1543949
MSEYDERYQGNADMPAAEGGYPQAEYAAAAAPAAGGSPPADSKPSGFSDHADGRSSQHQHETQSHDSGSSKSRERDRERDKGKG

SEQ ID NO: 68245 - DNA, 708 bp, Zea mays
  misc_feature: Ceres CLONE 1543950
  misc_feature: Encodes the peptide sequence at SEQ ID NO. 68246
  misc_feature (497)..(497): n is a, c, t, g, unknown, or other
tccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggcntagaacggcgtcaagttcggcgaggcggtgtggttcaaggccggcgcgcaaatcttctcggaaggcgggctggactacctgggggaacccaacctggtgcacgcgcagagcatcctggccatctgggcgtgccaaggggtgctcatgggcttcctcgagggctaccgcggtcgcggcgggccgctcggggaagggctcgaccagggtaccc

SEQ ID NO: 68246 - protein, 114 aa, Zea mays
  misc_feature: Ceres CLONE 1543950
  misc_feature (59)..(115): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILA

SEQ ID NO: 68247 - DNA, 707 bp, Zea mays
  misc_feature: Ceres CLONE 1543956
  misc_feature: Encodes the peptide sequence at SEQ ID NO. 68248
  misc_feature (36)..(36): n is a, c, t, g, unknown, or other
  misc_feature (43)..(43): n is a, c, t, g, unknown, or other
  misc_feature (49)..(49): n is a, c, t, g, unknown, or other
  misc_feature (53)..(53): n is a, c, t, g, unknown, or other
  misc_feature (632)..(632): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (674)..(674): n is a, c, t, g, unknown, or other
  misc_feature (676)..(676): n is a, c, t, g, unknown, or other
  misc_feature (678)..(678): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (692)..(692): n is a, c, t, g, unknown, or other
  misc_feature (695)..(695): n is a, c, t, g, unknown, or other
tccccgcggtggcggccgctctagaactagtggatnccccggnctgcangtantcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggaggcgtcgggcccggacgccggctcgccgggcttctcggtgcgcgtgcgccgcccctgcccggacttctgcagtccggtgacctcaaagaccgggccccccggggacattaccctcataaccaggggggggtaccgggcccccttccccggatttggggcccccccggggggccccaaatgggggaaccccccaccccaaaacaacttgggcccaagggggggggggggggccccatatgaaccctccccccgggggggccttttttcggcggccctccgccttagaaaacgccggggaaaatggggggagggcggcggggcggggggccctctcccacttccccggtttaaccgccccaaaaaagcccactttttttaaaggggggttntaacgcccccggnnnnnnnnnnnnnnnnnnnnnanaaaaaangngngnnnnnnnnnngnnggnggggggggggcg

SEQ ID NO: 68248 - protein, 144 aa, Zea mays
  misc_feature: Ceres CLONE 1543956
MAREEQALLSTEIVNRGVEASGPDAGSPGFSVRVRRPCPDFCSPVTSKTGPPGDITLITRGGYRAPFPGFGAPPGGPKWGNPPPQNNLGPRGGGGAPYEPSPRGGLFSAALRLRKRRGKWGEGGGAGGPLPLPRFNRPKKAHFF

SEQ ID NO: 68249 - DNA, 616 bp, Zea mays
  misc_feature: Ceres CLONE 1543957
  misc_feature: Encodes the peptide sequence at SEQ ID NO. 68250
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcaaactggtgctccccgcggtggcggccgctctagactagtggatcccccgggctgcaggaattcgtctcacccctagaaaaaaaaccaagcctgtgtttcagagacaactcaggcgacgcgatggcgatggcggcgctgcgacgcgaggggaggcgcctcctcctcgccccatcgtccccaaccgtcttcggctgccgcttccgctgcggtgacgcgatcctccgccatgtcgcaaccgggagatggctccacttggtgcacggtctatttcaactcaagttggtgaggaccgggatgagagtttcaaaaacctccccgagatcccaaaagcttttaaaaatgggttgcaacaccaaagctttcgggtgtgtccaaaaaggacctgaaaatcccccccggcttggggggcacccctttaaccccccctttttttggggaaccccccccattggtggtgccccccccaaaaaaaaaatttgtttttttggggcccctaatccccc

SEQ ID NO: 68250 - protein, 127 aa, Zea mays
  misc_feature: Ceres CLONE 1543957
MAMAALRREGRRLLLAPSSPTVFGCRFRCGDAILRHVATGRWLHLVHGLFQLKLVRTGMRVSKTSPRSQKLLKMGCNTKAFGCVQKGPENPPRLGGHPFNPPFFWGTPPIGGAPPKKKICFFGAPNP

SEQ ID NO: 68251 - DNA, 725 bp, Zea mays
  misc_feature: Ceres CLONE 1543960
  misc_feature: Encodes the peptide sequence at SEQ ID NO. 68252
ctggagctccccgcggtggcggccgctctagaactagtggatcccccgggctgcaggaattcgtctcacccctagaaaaaaaaaaaaaaaaaaaaaaaaaaaaaaaaaaaattcggccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacagggagatctaccctgccgatgggctgtttgaccggtcggaggtgcccgagtacctcaccggagaggtccctgaagactatggctacaaccctttttggcctgggcaagagccaagagactcccccaagtacaggccttacgagctgatccatcccaaatgggccattctcggggcccctggcccttttcttcccaaaaggctggaaaaatttcgggccaaaattgtggccccaaaggttttggggtaaaaaaaagggcccttttcccttgaaaggaaaaccccctaaaaattttggaaaaagtccccccaaaaccctggggggggggcctaattccgaggagacctcccccct

SEQ ID NO: 68252 - protein, 151 aa, Zea mays
  misc_feature: Ceres CLONE 1543960
MAALAPSKILGTQLNFAGSSRYATAAPTAGAQKIVSLFSKKPAQKPKPAAVSSSSPDISDELAKWYGPDREIYPADGLFDRSEVPEYLTGEVPEDYGYNPFWPGQEPRDSPKYRPYELIHPKWAILGAPGPFLPKRLEKFRAKIVAPKVLG

SEQ ID NO: 68253 - DNA, 628 bp, Zea mays
  misc_feature: Ceres CLONE 1543965
  misc_feature: Encodes the peptide sequence at SEQ ID NO. 68254
tccccgcggtggcggccgctctagaactagtggatcccccgggctgcaggaattcgtctcacccctagaaaaaaacacgtgacacctccgcccaccctcgccccctccctaccggcaccgcccagatggcctgctcccacatcgtcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgtttccgttggtcgcccgcgcggggccgggccgcgcggcaccggtgggccgactggacgggcgcccggccacggagaaagcagccatcatcgtcatcgacaactacgacagcttcacatacaaactctgccagtttatgggggagcttggtttgaacttccaagttcccccatgatgaactggcctttgaaaatggggaagggaaaaccccagggggaatcctttttttccccgggaccgggggaaccccaaaattcgggaaaatttttttgggagagtgttttttgattttggcgcccccccccccccccttttttttggggattttcccggggggggccccca

SEQ ID NO: 68254 - protein, 110 aa, Zea mays
  misc_feature: Ceres CLONE 1543965
  misc_feature (72)..(103): SWISSPROT Homolog: EC 4.1.3.27 Anthranilate synthase
  misc_feature (82)..(108): SWISSPROT Homolog: EC 2.6.1.85
MACSHIVAAAGVSSPAAAAARSPAHSPASAFARLRSTPRFASAGLSVKGNGAAFPLVARAGPGRAAPVGRLDGRPATEKAAIIVIDNYDSFTYKLCQFMGELGLNFQVPP

SEQ ID NO: 68255 - DNA, 681 bp, Zea mays
  misc_feature: Ceres CLONE 1543966
  misc_feature: Encodes the peptide sequence at SEQ ID NO. 68256
  misc_feature (85)..(85): n is a, c, t, g, unknown, or other
  misc_feature (86)..(86): n is a, c, t, g, unknown, or other
  misc_feature (88)..(88): n is a, c, t, g, unknown, or other
  misc_feature (91)..(91): n is a, c, t, g, unknown, or other
cagctggagctcaccgcggtggcggccgctctagactagtggatcccccgggctgcaggaattcgtctcacccctagaaaaaaannangangcaacagaaaaaaggcttccagccatcccttctacgctctccccgttcccgtgtcgtcctcccgacaaagagggagccgctagggtttagcggcttccgcgtctgggcgagggcttacccgcgagggacggcgcgacgcggcggcacttgagctagggtttaaccctccgatcccgttcctttcccggcgaggcgatggacgaggcggcgattgacgacttgatccggcggctcctcgaggcccgcggcgggcgcaccccgcgcaacgcgcaggtgactgacgccgagatccggcgcctctgcgccaccgccaaggacgttttcctctcccagcccaacctcctggagctcgagggccccattaagatatgcgggggatgtccatggccagtattcagaccctccttcgatttatttgagtatggtgggctattccaccagattgcaaattatccggttcctggggtgactatgtttgatccggggggaacccgagccttggaacccattggcccttttctttggggggtaacaaaaaaagggcccccaaaaaaatttttttttttctttcgggggaaaaccctctttat

SEQ ID NO: 68256 - protein, 131 aa, Zea mays
  misc_feature: Ceres CLONE 1543966
  misc_feature: SWISSPROT Homolog: EC 3.1.3.16 Phosphoprotein phosphatase
MDEAAIDDLIRRLLEARGGRTPRNAQVTDAEIRRLCATAKDVFLSQPNLLELEGPIKICGGCPWPVFRPSFDLFEYGGLFHQIANYPVPGVTMFDPGGTRALEPIGPFLWGVTKKGPPKKFFFFFRGKTLF

SEQ ID NO: 68257 - DNA, 702 bp, Zea mays
  misc_feature: Ceres CLONE 1543968
  misc_feature: Translation starting site: 182
  misc_feature (702)..(702): n is a, c, t, g, unknown, or other
aaagctggagctccccgcggtggcggccgctctagaactagtggatcccccgggctgcaggaattcgtctcacccctagaaaaactctctttctcaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctcccgcttctctgaaggtgtacgggcccgtaacatgtgcccttctttctcaccatatgaaatgagatttgccacgaggaactacgcgacccagagcctttggggcccttctctgtctgttagcggtggcatcaatgttccagtgatgccgactccgctcccccccaatgctccagccgagaaaggtggcaaaaacttcatgattgatttcatgatgggcggtgtttcagctgctgtttcgaagactgcagctgctcccattgaacgagtgaagctgcttattcagaatcacgatgagatgatcaagtctggtacgctatcagagccgtacaagggtattgctgattgcttcaaactaccatcaaagatgagggtttctcttccttgtggaggggtaacactgctaatgttattcgttacttccctactcaggctttgaactttgcgttaaatgactan

SEQ ID NO: 68258 - DNA, 727 bp, Zea mays
  misc_feature: Ceres CLONE 1543969
  misc_feature: Encodes the peptide sequence at SEQ ID NO. 68259
  misc_feature (472)..(472): n is a, c, t, g, unknown, or other
  misc_feature (477)..(477): n is a, c, t, g, unknown, or other
tggagctcaccgcggtggcggccgctctagaactagtggatcccccgggctgcaggaattcgtctcacccctagaaaaaaaccaaagcaactcggccagcgcgcgggccggggtcgcatgggcgacgccggcgacaagtgtgcgctgcggctggccgccaccgcgaggaagtggctggaggacgtccgcgtcgaccgcgaaggccgcgtccaccccgccgtagccagcggggggcaggcgctcacctggctcgcgactgccggcgcccgcgtctcgctggccgagcccggccgcgtcgtctgctcgctccgcgtgggcgccccgctcaccgacgcggaggggaggtggcacgccggggccatcgcggtggcggcggacaacgtgtgcgcggcggcggtcttcacggcgctgggcgcggacgtgctcaccgtgcagtacagcatgtcgtacttctcgcccgcccatctcgacnaagangtggacatcgaggggcgcagtgtggggccggtatcgctgcagcatgccgccgccacgggtgaggtcctgaagaaagattccggcagcttggtggcgatctgcttgcagtggattgcccctttctcgacaactaatgtcgccaaaagaccgtcaaggagctttttaaaaatgcaaaaggtttttctgccaacccacaaaaggttgcttgccctccttcccgcaggggcgggcactcaaccccttgtgtttt

SEQ ID NO: 68259 - protein, 203 aa, Zea mays
  misc_feature: Ceres CLONE 1543969
  misc_feature (119)..(119): Xaa is any aa, unknown, or other
  misc_feature (120)..(120): Xaa is any aa, unknown, or other
MGDAGDKCALRLAATARKWLEDVRVDREGRVHPAVASGGQALTWLATAGARVSLAEPGRVVCSLRVGAPLTDAEGRWHAGAIAVAADNVCAAAVFTALGADVLTVQYSMSYFSPAHLDXXVDIEGRSVGPVSLQHAAATGEVLKKDSGSLVAICLQWIAPFSTTNVAKRPSRSFLKMQKVFLPTHKRLLALLPAGAGTQPLVF

SEQ ID NO: 68260 - DNA, 630 bp, Zea mays
  misc_feature: Ceres CLONE 1543974
  misc_feature: Encodes the peptide sequence at SEQ ID NO. 68261
atagctggagctccccgcggtggcggccgctctagaactagtggatcccccgggctgcaggaattcgtctcacccctagaaaaagccaaaacaaaacgagaaaaaaaagtcttgctgctgctggtggtggagcgagaaaggaaaaaaaaaagaaggggtaatctcaggaaccatctagatacagcggcggtacgtggactggactggagcgagcaagcctgcgccggcgccgccgtcctcccgaaacagaagctgttggtcaagaactggggatactgagttgaatatgatctcaaatccggtggactggtatagtttcggacccggatagaattggtagggatgcaagattggagggtgcgtgagttcgaaggtaaattcactgatgagtttgcccacagcagtagcaacgaacataaaggtggagttgaggcttctggtgtcattagtagtaagaaagtgaagcatgcagttgctaatgagaaaatccaaagtgtcatccccggtacaaatagctcaagttcactgaaacgtaatccagagacatccaactgcgaacggggtatattcccagatattagcctgcctggtgactacaaaatggctccttgccctttctttaaaaaagaa

SEQ ID NO: 68261 - protein, 92 aa, Zea mays
  misc_feature: Ceres CLONE 1543974
IAGAPRGGGRSRTSGSPGLQEFVSPLEKAKTKREKKVLLLLVVERERKKKRRGNLRNHLDTAAVRGLDWSEQACAGAAVLPKQKLLVKNWGY

SEQ ID NO: 68262 - DNA, 649 bp, Zea mays
  misc_feature: Ceres CLONE 1543975
  misc_feature: Encodes the peptide sequence at SEQ ID NO. 68263
  misc_feature (270)..(270): n is a, c, t, g, unknown, or other
  misc_feature (330)..(330): n is a, c, t, g, unknown, or other
ggagctccccgcggtggcggccgctctagaactagtggatcccccgggctgcaggaattcgtctcacccctagaaaaacatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcngcggcgttaagaaggctgagcagaagccccgggaaaccaaaaggaaggtgaagagcagcnaacagggcggcgcggccaaaaagtgacgtacagtacgtgtggagtgtagtgaagcttccatgcatgagtgaatccatggcatgtaatgaaaaattgttgcgtctccttttcactactgtttgctgcgggtgtggtggtctggaatattgggcatctaaacgaaggcttgtgttcctcgctggcacaaccgagaactcatcgtcttccaatctgcagcaccaaaccttacccaggacaagaataggaaagagaaagatggaggaataaagcagggggggccacgcaccgcacgaggggagagccggaaggagatcaaaag

SEQ ID NO: 68263 - protein, 63 aa, Zea mays
  misc_feature: Ceres CLONE 1543975
  misc_feature (36)..(36): Xaa is any aa, unknown, or other
  misc_feature (56)..(56): Xaa is any aa, unknown, or other
MASLKAAKPSGVAAQGKEPAPKLSETATKPSAAKSXGVKKAEQKPRETKRKVKSSXQGGAAKK

SEQ ID NO: 68264 - DNA, 745 bp, Zea mays
  misc_feature: Ceres CLONE 1543980
  misc_feature: Encodes the peptide sequence at SEQ ID NO. 68265
  misc_feature (587)..(587): n is a, c, t, g, unknown, or other
gctggagctccccgcggtggcggccgctctagaactagtggatcccccgggctgcaggaattcgtctcacccctagaaaaaaagaatacgaggccgtcgtctcctctgtcagaattcggaaacacaccaaagctagcctccgctccctccccttccagcttcgtctagacagagtccagcagacacggccaacagttaaaaccggttgctattagtacgcgcccgccaccacgctcgcgcagacactcacacacacacacacacacacactcaacagcaacagctaagcctctcccacaagacagcaacatggctgaggaggaggccaagaaggtggaggtggaggtcaccaaggagcccgaggcggcggcgaaggaggacgtagccgatgacaaggtcgtcatcccctctaccgacccgccgccgccgccgccgtcggccgacgactccaaggccctggccctcgtcgagaaagttgcagatgaacctgctccccgagaaacctgcccctgcgaaacaaggggggctccaatggacggggatctcccttcttggcagggtggaaacccagaacaaggaaactcttngatcaaagccttggggaggagaaggaagaagaccaaaagcttgaaaacaaaaggctgcgtaagaaaagtattcccgcatatttcattccaggggggagaaaccccagaagaagggcataaacttgaaaagggcttgaaccctgaggctaagaatttgc

SEQ ID NO: 68265 - protein, 145 aa, Zea mays
  misc_feature: Ceres CLONE 1543980
  misc_feature (93)..(93): Xaa is any aa, unknown, or other
MAEEEAKKVEVEVTKEPEAAAKEDVADDKVVIPSTDPPPPPPSADDSKALALVEKVADEPAPRETCPCETRGAPMDGDLPSWQGGNPEQGNSXIKALGRRRKKTKSLKTKGCVRKVFPHISFQGGETPEEGHKLEKGLNPEAKNL

SEQ ID NO: 68266 - DNA, 719 bp, Zea mays
  misc_feature: Ceres CLONE 1543981
  misc_feature: Encodes the peptide sequence at SEQ ID NO. 68267
  misc_feature (294)..(294): n is a, c, t, g, unknown, or other
  misc_feature (465)..(465): n is a, c, t, g, unknown, or other
  misc_feature (466)..(466): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (486)..(486): n is a, c, t, g, unknown, or other
  misc_feature (578)..(578): n is a, c, t, g, unknown, or other
  misc_feature (583)..(583): n is a, c, t, g, unknown, or other
aaagctggagctcaccgcggtggcggccgctctagaactagtggatcccccgggctgcaggaattcgtctcacccctagaaaaagcctctccgcccacccacccactgacccacccacccatctcgctcgcgcgcgccgggatttctcgccttcgctcaatcgctccgcggctctcctcctgcgcgccggccggtcgatccgggcgccggggcccgaggtgcgccgcggcggaggctctgccgggccggattcgctgatcggtcggttggtaggttcggttgttaggtaggtanggtaggttggttggtcgcgggcatgtccacggcggtggcgcggccggcgcacggcggcttccggcagtcggggagcgggaagccggatccggaggacgcggacaggatgagggacgccaacgggtacttggtccagaaacgtgagaaggaagaggaagagcgtggggtacnnccnnncccccggcgggaagnaaaaaaaaaaaggcccctgtcgaaggcctcgtcgatcggcgcggcgtcgtccgacagctcctccatcggcgagaactccgcgtccgacaggnggccnaaccaacggggaggaggaggaaggtggaaagcaaggcgcaggggctcggcatgatggggctggccacgctccagtccttggacgatgccctgcccaccaagcggggcctgtccaacttctacgcgggcaagtccaa

SEQ ID NO: 68267 - protein, 106 aa, Zea mays
  misc_feature: Ceres CLONE 1543981
  misc_feature (50)..(50): Xaa is any aa, unknown, or other
  misc_feature (52)..(52): Xaa is any aa, unknown, or other
  misc_feature (57)..(57): Xaa is any aa, unknown, or other
  misc_feature (88)..(88): Xaa is any aa, unknown, or other
MSTAVARPAHGGFRQSGSGKPDPEDADRMRDANGYLVQKREKEEEERGVXPXPRREXKKKRPLSKASSIGAASSDSSSIGENSASDRXPNQRGGGGRWKARRRGSA

SEQ ID NO: 68268 - DNA, 713 bp, Zea mays
  misc_feature: Ceres CLONE 1543982
  misc_feature: Encodes the peptide sequence at SEQ ID NO. 68269
ctggagctccccgcggtggcggccgctctagaactagtggatcccccgggctgcaggaattcgtctcacccctagaaaaaaaaatatccatgccgaatgcgagataggtctgagcggggagacgactcccgctgcccgcgccatggcaggcgccagcgccaccaactgcggaggcaacggcggaagcgggaaggtggtcagcatgccgctgcagtacttctgcgtgctggcggccgtggtggtggccgtgatggtgctgtcgctgtccttcatgtctccggcggacatggtggccgtccgccagaacctcagctctgtggcggccgccccctgtggcaacagcaacagcaccggcggctgcgccagatcgggaagcgccgccggtctggccaaggcgtcaccgcccgcgggctggaacgagaacgagcacgcgcggcggccgcccgtgatgctgttcgacttcggcgactccaactccgacaccagatgcgtggcggcggccggcgggatacggatcatgccgccggagggccgcatctacttccacctccccacgggcctgttctgcgactgccgcgtcatcatcgacttcatctgtgagagtctgggcacgcgtgaactgaactcatacatctggacgattaggtcggactacaccgacggcttcagcttcgccatgggacgctcgatcgtgacccacggcgtctctgcct

SEQ ID NO: 68269 - protein, 190 aa, Zea mays
  misc_feature: Ceres CLONE 1543982
  misc_feature: SWISSPROT Homolog: EC 3.2.1.51 Alpha-L-fucosidase
MAGASATNCGGNGGSGKVVSMPLQYFCVLAAVVVAVMVLSLSFMSPADMVAVRQNLSSVAAAPCGNSNSTGGCARSGSAAGLAKASPPAGWNENEHARRPPVMLFDFGDSNSDTRCVAAAGGIRIMPPEGRIYFHLPTGLFCDCRVIIDFICESLGTRELNSYIWTIRSDYTDGFSFAMGRSIVTHGVSA

SEQ ID NO: 68270 - DNA, 648 bp, Zea mays
  misc_feature: Ceres CLONE 1543983
  misc_feature: Encodes the peptide sequence at SEQ ID NO. 68271
ctggagctccccgcggtggcggccgctctagactagtggatcccccgggctgcaggaattcgtctcacccctagaaaaactactgctactagtactctccccacaagcatgcgcccctccatgatagtgcttcctcagagctaaggctctctcacctaaacacccgctcaccccaagtccacgccggcgattgccgcaatgccagcaccggcaactggcttgtccgtcctgatgctcttcgacttcgccgccgccctgccggcactttctgccgatgacctcaacaccgacgcgcaggcgctgcatgcgctacgctcggcggtcggccgctccgcgctgccatcgtggaacagcagcacacccacatgccagtggcacggcgtcacctgcgacagcggccccatcatctagctccgcctccccagcgccaggctcatggggaacctcccctcgggcgtgctcggcaacctgtcggcgctccgcacgctctccctacggtacaacccggtagggggcccaataccggacgaccctccccgacgtgtcgggcctaaggccaatataattccagggaataaagtttctccgggcaagggccccgccaatcaatatttgaaccccaaaaccctccgaaggggtggaaatacg

SEQ ID NO: 68271 - protein, 70 aa, Zea mays
  misc_feature: Ceres CLONE 1543983
  misc_feature (28)..(65): Pfam Name: LRRNT_2 Pfam Description: Leucine rich repeat N-terminal domain
MPAPATGLSVLMLFDFAAALPALSADDLNTDAQALHALRSAVGRSALPSWNSSTPTCQWHGVTCDSGPII

SEQ ID NO: 68272 - DNA, 652 bp, Zea mays
  misc_feature: Ceres CLONE 1543987
tggagctccccgcggtggcggccgctctagaactagtggatcccccgggctgcaggaattcgtctcacccctagaatagttccgcttcgtcccagcctctagttcttcctttcctccagagtgatggccaaatgctactcagattggcccccgattccgcctttccatccatcgcgaagaacgccgccgcaatcccacgcctccccgatcacgatcatggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgatgcctctgctgtgactcgcagaccgagcagctggtccttcgagggctacaggacggcgctgctgctgcacgagtcccggctggagactaggacggcctacgcgctgaccctgcgactgatcagtggagaagcagacgggcccccctggagctgctgggtcaacgaacttctcgggcctacggcggggctcccggaacaagggggagattcgggggagtttttttcacccagcttttttccggggccggggggaggttccggccctcgccccaa

SEQ ID NO: 68273 - DNA, 905 bp, Zea mays
  misc_feature: Ceres CLONE 1543988
  misc_feature (13)..(13): n is a, c, t, g, unknown, or other
  misc_feature (14)..(14): n is a, c, t, g, unknown, or other
  misc_feature (39)..(39): n is a, c, t, g, unknown, or other
ttttggtttgtgnntgttggtgattttgggtttttattnatttaatataaataataaaaagaatcccctcggtggcggccgctctagaactagtggatcccccgggctgcaggaattcgtctcacccctagaaaaaattctagcaaagggaaggtgttttttcggaccttcagctcaaggccttcgtccatatcgcaatctcaatttattatttacacattaatattgccaggggctactgttgggggccttcgtcctcccaaggttctctaaaacatgatatgacaatgttttccgaacggattatgtgaacaggtattcgcggatcccataaacatcaatattcgatcacggcctggatcaaagccttgtatcaccgcactatttgtctagtgttgtccttattgttgaagtgtatggtcaagctttcttttacgttttctctgtaatgggctaactccttctttcaaccgagaggaataaaaccctcctcaacgccccccccacacaaacttctccatttagtacatgtttaaccaaagatgcaaaaagctaccagtggcacccttcttcactttgacagggcacggcgttgaacgtagagacgcacttattctctctacttatattaaaaaagactctctccccacccccggcttagttgtttttcaccgctctatactatttatatctcttatgtccgatacctccccttctccccccccgccggctgtcttatatctaaactctcttcaatactctctcattccatgagttatccggagcctcctattctgtggtagcccactttgtattagtttcatcccgttccattacggggcgcagcgggcgtcctggtcttgcgcacacggacgcgatcaccgactggtacgtagactgagcag

SEQ ID NO: 68274 - DNA, 646 bp, Zea mays
  misc_feature: Ceres CLONE 1543993
  misc_feature: Encodes the peptide sequence at SEQ ID NO. 68275
  misc_feature (278)..(278): n is a, c, t, g, unknown, or other
  misc_feature (312)..(312): n is a, c, t, g, unknown, or other
tcaccgcggtggcggccgctctagaactagtggatcccccgggctgcaggaattcgtctcacccctagaaaaatgtgttgggggtactaacttatccaatttactaattcttgtatatgaaccatgatacttgtgagactgcttcgaacctgtgacatggtgacttagagcaactctcgctattgtaccagccctgcttcaaacccgtgacatggtgacttgagacctctctcgctattgtaccaggccagtcctttacgaaccataatactatgttnatataatattccgatacttctaatttaatctgcngttgttgaaggtaatgagcatgctttaacttcggagattcaaccaaaaatacctcgcgctccaacactacaactttcatttaatcaagcttgtttctgctttaactcgctatgctctgaccaaagctttaattcatgcgctgctgggtttttctgagttctgcagatcattttttctcaagtacttggtagctcaattgtgataagctcgctgagcaaattggactgctagagtagtttgatttcgtttggaagtgaagagggcaacccttgaaaattggcgtgaagtcttactaacctaaattggtgagcatttttactccacgaagcccttc

SEQ ID NO: 68275 - protein, 41 aa, Zea mays
  misc_feature: Ceres CLONE 1543993
HRGGGRSRTSGSPGLQEFVSPLEKCVGGTNLSNLLILVYEP

SEQ ID NO: 68276 - DNA, 884 bp, Zea mays
  misc_feature: Ceres CLONE 1543996
  misc_feature (24)..(24): n is a, c, t, g, unknown, or other
  misc_feature (25)..(25): n is a, c, t, g, unknown, or other
tttttttttttttttttttttttnnaattttttttttaaaaacacagtttaaactttgcacctccccgcggtggcggccgctctagaactagtggatcccccgggctgcaggaattcgtctcacccctagaaaaaaaaaccaaacccagctcatgcataaccccaacgcaccgccgccgctcgcctggcctcacctccccggagaagagttataagacaggagaaccccgtccccggggcgcaagcctcggcaacttccgtgacccaacccgttcccccacatcccctggtcaccagctggcacctcccccccccccgtgtaagattccgggcagcgcagcggccgcccacatatcatcttaatttctaaatggacttcaccacacggcgatgtgagagatgtcttccgcaaacaggcggtgggcgccgacaagcggcatgaaccgagaggacgaacgactacggaagaataaaaataacatcaaacatactacgagtacataacatcgtgtgttagttcatgctcttaaacatctatcttgtatactcttatcactgcacccacaccagcacacaccccgaacacaccccctacatctctccattctcccatccactacaacccctcctatctacctcctccttcgattctcaaataataataataaaaataacccatctttatgtctttgtaggatatgctttaaggcatctttccctacttcttctacatcaacacttctgttgaggctatactatttaatagcaactaattgttaattgtaaaccatacaaaatattcaagtgaaacgagcgattactctcggagtcttaaaagaaataaaataattaaaaacaagaaaaaaagcaataaaaaccaaacg

SEQ ID NO: 68277 - DNA, 678 bp, Zea mays
  misc_feature: Ceres CLONE 1543999
  misc_feature: Encodes the peptide sequence at SEQ ID NO. 68278
  misc_feature (427)..(427): n is a, c, t, g, unknown, or other
  misc_feature (453)..(453): n is a, c, t, g, unknown, or other
  misc_feature (475)..(475): n is a, c, t, g, unknown, or other
  misc_feature (481)..(481): n is a, c, t, g, unknown, or other
  misc_feature (485)..(485): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (619)..(619): n is a, c, t, g, unknown, or other
tcaccgcggtggcggccgctctagaactagtggatcccccgggctgcaggaattcgtctcacccctaggaaaaattcgtcactcactaaacccttttgccctaaaccctaaacaagaagctacccgccttccccaccacaacccccaatactgccgccatgtcgtccacgccgcaggccgtcgcgtcccccgcctccgagcaaacaagatccgagaagaagaagcacaagtccaaggatctccgcgccactgaccgcgcgtcgctcgccgaggctgaggagaagactgatggctacctgatcaagccccagtcccctggtgcgttccctggaaacctccacctggacgctcctcctccccaaactaggacggcgtggcgggccggactggacactaaaccccccccccccccccgggcactcccccnctgaaagccccccctcggggaagatnttccgctcgggcggcaagaaancccganaaanccccccacaaccggcgctcccccaaaggagggcggcctggaactaggcaaatcgcctnnnnaccaaaaaaacggggacacaggggccccccctaggccccaggggacccgggaaaccccctcaccgtgcgggtnaaacgggccggcgtggctcgggaaaagacgaaacaaaggcgcctggtaggaagatcccg

SEQ ID NO: 68278 - protein, 89 aa, Zea mays
  misc_feature: Ceres CLONE 1543999
MSSTPQAVASPASEQTRSEKKKHKSKDLRATDRASLAEAEEKTDGYLIKPQSPGAFPGNLHLDAPPPQTRTAWRAGLDTKPPPPPRALP

SEQ ID NO: 68279 - DNA, 678 bp, Zea mays
  misc_feature: Ceres CLONE 1544002
  misc_feature: SWISSPROT Homolog: EC 3.2.1.21 Beta-glucosidase
caaagctggagctccccgcggtggcggccgctctagaactagtggatcccccgggctgcaggaattcgtctcacccctagaaaaattcactactcaagccgctcaaaactctagctagctagcagggggggaaatggctccacttctcgccgcagccatgaaccacgctgcccatccagtctttagaagccatctaggacccaacaatgagagtttctcacgacaccacctatcttcttcaccgcaaagcagtaagcgaatgtttaaccttagctttacgccacgatctgcaagagtaggcaatcaaaatggagtccaattgttgagcccttcggaaatccctcgaagggactgttccccctccaactccttctttggggcggcccctttaccgtaccaatttaaagggcctcgaaccaaaatggaaaggggaaaaccattgggaccccttctgccccattttttccgaaaggaaaatggcccgggaacaatgccaaaatttggagccaattttaaccaatttcccaaaaagggaatgcaaaattcccaaaaaaaaaggggcccgggcccccctttggggctctcccaacccccggggcgcaaaaaaccccccccaagggggcccgccccgaaggggggttattccccggggggggccttttttatcccaaaaagggg

SEQ ID NO: 68280 - DNA, 654 bp, Zea mays
  misc_feature: Ceres CLONE 1544003
  misc_feature: Encodes the peptide sequence at SEQ ID NO. 68281
  misc_feature (654)..(654): n is a, c, t, g, unknown, or other
ggagctccccgcggtggcggccgctctagaactagtggatcccccgggctgcaggaattcgtctcacccctagaaaaaaccaaaatgtaagaaaacgcagtacgcacgccccggcgctggccgctagtcaccccaaagctccgcctccgcacctcctctcactcgcccagccgcggctatggcggccaccacgtccacggcggcggcggcggcagtatccttctccctcccctcacccccgcactgccgcggggcccggcgccgccgcgcgccttccctcctccgtgccgcgtccaccgccgcgcccccctcccccgacctctccatccagctctcgccccgcgggtccctgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcgcgctacggctcccgccccttcaaggtggcactccgagcagcggaggtgctgtccaagctggcgtcgttcggggtgaaggtcctactggacgagcggagaggggagtcgtcctcggagaggaagcgcgccagggcggtggagttgcgcaccan

SEQ ID NO: 68281 - protein, 67 aa, Zea mays
  misc_feature: Ceres CLONE 1544003
MARAAGATVYSPELLAARYGSRPFKVALRAAEVLSKLASFGVKVLLDERRGESSSERKRARAVELRT

SEQ ID NO: 68282 - DNA, 678 bp, Zea mays
  misc_feature: Ceres CLONE 1544010
  misc_feature: Translation starting site: 149
ctggagctccccgcggtggcggccgctctagaactagtggatcccccgggctgcaggaattcgtctcacccctagaaaaattaatcattagtactattgattagtattattgaaacagaggcattgccgatactcacgccggcgaccgatgggatcggagggtgagatcaccggcccgctcctcgcgtcgggcgccggcgcgccggcgccggaggcggtgcccccgtggcgggagcaggtgacggctcgggggctggcggtcagcgccgtcctgggggtgctcttctgcctcattacgcacaagctcaacctcaccgtcgggatcatcccctcgctcaacgtcgccgcggggctgctcggctacttcctggtccgcacctggacggcggcgctcgagaggttcggcgtcgtctccaagcccttcacaagcaggagaacacgtcattcagacatgcgtcgtcgcctgctacgggctcgccttcagcggggggtttggaagctatatgcttgccatggaccagagaacctttgaacttatcggggcagattattctggcaaccggggccgggatgtcaagaactccttcccggggctggaaaattggatccccggttttgttgtaaccttcctgggggcggtttaagccttggtgccctaccccagggttttggtaattt

SEQ ID NO: 68283 - DNA, 672 bp, Zea mays
  misc_feature: Ceres CLONE 1544016
  misc_feature: Encodes the peptide sequence at SEQ ID NO. 68284
  misc_feature (672)..(672): n is a, c, t, g, unknown, or other
ctggagctccccgcggtggcggccgctctagaactagtggatcccccgggctgcaggaattcgtctcacccctagaaaaaagcccgaaacgcgagcgcaatcaacacccaccattacccaccgcagcaggcagcagcggcgttcgcaatggcggctcgtcttgcctgagcagagcttcaaggagcgcgcgcattggcgccgcccgcggcgtggcccatcgccgccgatcgccggcgcccccgtcaccgcgttgtgttggcggaacagcttaagccagcttgctgcgccgtcaggaagccgaaacgcggcgtccccgcggatggcggcccgccgtctggcgacgacgctgacgctgctggcggccgcgttcctggccgccgccggcgcagcagcaggcagcaagccctcggcgaagttcgagctcatccaccgggagcaggcgacctgggacgaggtggcgcgcatggaccaggagcgcacggcgttcatctcctcgcacgctcgtcgccgccgcgccacggaggcggccgccggtgccaagcccaaggcgagggcgagggcgaaggccacgccgccggcggacgaggccttcgcgatgccgctctcgtcgggcgcatacacgggcaccggccagtacttcgtgcgcttccgcgtgggcacgccagcgcggcn

SEQ ID NO: 68284 - protein, 117 aa, Zea mays
  misc_feature: Ceres CLONE 1544016
MAARRLATTLTLLAAAFLAAAGAAAGSKPSAKFELIHREQATWDEVARMDQERTAFISSHARRRRATEAAAGAKPKARARAKATPPADEAFAMPLSSGAYTGTGQYFVRFRVGTPAR

SEQ ID NO: 68285 - DNA, 658 bp, Zea mays
  misc_feature: Ceres CLONE 1544035
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (511)..(511): n is a, c, t, g, unknown, or other
  misc_feature (512)..(512): n is a, c, t, g, unknown, or other
  misc_feature (596)..(596): n is a, c, t, g, unknown, or other
  misc_feature (597)..(597): n is a, c, t, g, unknown, or other
  misc_feature (626)..(626): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctagaaaaacatcaatatcaaatttatctggtttagaaacatgttaatatatgtctagatttttgtttgaaaatacttgcaaaatctcgtgatttcgagaatttttagaatatgttctagaagaaattagtggtgaaagaaaacatcaaaaccgtgcaaagacaaatgtgacaactatttttcacgggaggggagaattccttgctttttatcactctaatcatgcagtacatttactttttcttttttttttcctgctgatgattccaatgatgtacaaaatgttcttattccccaccatacgtgcggggcgggggctgattcccaaacattcttgctatgttgtaatgagcccgcaaaaaaatttggtccccccgaggggctttctccctttttctnnnaacttcaaatttcccagttaaaatttcggttgggggggtgggggnnttttggggggtttaagtgtaaaatcccccaagcccccttaatagcccccaaggggggggaggtttgccaaaatccggcaaagtnntggggccaccacaggggaaatgggggggntcattccccgccgtgcaaagggggcaaaaang

SEQ ID NO: 68286 - DNA, 878 bp, Zea mays
  misc_feature: Ceres CLONE 1544041-R
  misc_feature: Pfam Name: DUF221 Pfam Description: Domain of unknown function DUF221
  misc_feature (878)..(878): n is a, c, t, g, unknown, or other
tggggacctcgagcgtctcgtttttttttttttttttaggaccttagatccttaaacaaaaaaatcaagaaaatgactatgtatcatttaaagtaaatttttgataggccatgttcatcaccaaaactgcatgtgcctgtgatatctgacaaaacaaatacatatctaagaagacaagagttaatctacatagctgtacaagaagaatgaatgactttgatacaccaggttcgaagtcatgaaagatgtcattgtaatgaacaaaagtgtgtattgttcttcaggattgatacagactccaatccaggtcaggttgtgaaaaaacttcataatccgtgggaccatctacaaagctattcactgtctgcatcccttctaacaaagatggctggaagcgatcgcttctagagggaagcaacttatagaacactaacatcccaagagtacatatagcctgtaacttcatcgagtcaccctgaacagcaaagaagagcagcattgcagcaaggaagaagatcacacagaattgcatgatacacagcactctgtccatcagcttcccatcattgccggcaggaaacccctctactcggtaaacgaacaagaaaagtatactgtcccacgagatacggtagccaaagtatgtcgcaccgacaggaaccacgagcgagcaaacagggagtagatcagtgtgagggcaaaatagtaatgtcaaagcatagtattgtgcaaagtcaaattctggcttgcatatggaagctcctgtttagtgggtacagggaaagacatgccccctccaaatatccaaaaagcaccgtttttctcttaagatataaagggctgtcaaaattaagtttctcccaatcggcgggggaggn

SEQ ID NO: 68287 - DNA, 695 bp, Zea mays
  misc_feature: Ceres CLONE 1544042
  misc_feature: Encodes the peptide sequence at SEQ ID NO. 68288
  misc_feature (375)..(375): n is a, c, t, g, unknown, or other
  misc_feature (481)..(481): n is a, c, t, g, unknown, or other
ctccccgcggtggcggccgctctagaactagtggatcccccgggctgcaggaattcgtctcacccctagaaaaaattggctcgcgctcggcagtcggcacgacggtacttggacttggccattcccaacgccaccccgcaaccgcaacgtctctctagcgtctagcctctgcctgcgctcccacaccagaacaccacaccgctccgcgtgcgtcgcccgcactcctcgcctctgcccgtctgcctaccgtgccgtgccgtgccgtgctccccacccgatgcagccgccgacgcgggccgtgccgagccacagccggagatgagctccaggaaccgttccgccgccgcctcgtccgctgccccggctctccggacnacgcgccgcctgaagcgggcggcagttaaggcgtcggcgccggggccggggcagcgggcggcggacgggcccgcgacgccgctgctgaaatgggacttccgttgcngccgccggccccgtgaagggaaggaaaggctgcccccacaaaaccgggggaccccccgggggcgccgggaaaccaaggccaagggcaaggaaggttccggggccgaaggcccccggcccggggtttggccgggttgccccccccggaaggccctggcccgggggcggggaaacggggccccccgtgggcgtctaaaatatttcccaaggggttt

SEQ ID NO: 68288 - protein, 125 aa, Zea mays
  misc_feature: Ceres CLONE 1544042
  misc_feature (55)..(55): Xaa is any aa, unknown, or other
MSSRNRSAAASSAAPALRTTRRLKRAAVKASAPGPGQRAADGPATPLLKWDFRCXRRPREGKERLPPQNRGTPRGRRETKAKGKEGSGAEGPRPGVWPGCPPRKALARGRGNGAPRGRLKYFPRG

SEQ ID NO: 68289 - DNA, 751 bp, Zea mays
  misc_feature: Ceres CLONE 1544048
  misc_feature: Encodes the peptide sequence at SEQ ID NO. 68290
  misc_feature (34)..(34): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tgggtttttttttcccccttgtgttgattctttncaaaanannnnccccttnnnntcaaaactggagctcaccgcggtggcggccgctctataactagtggatcccccgggctgcaggaattcgtctcacccctagaaaaaacgttggctgcgtcacattctctacgcctcgtgctccttcccttctaccgttcggctgcgtacccgcgtctccccagatccgctgccccgccctctcgacgcggcatttcctctaacgccccgcgcgagccacgccctcgccgcccatgggctcgctcccggcgccggcctcggcggaattcgccccgcggccgctggggcgcgccacggtggtggcgtctgacctggtgccgctcttctccgcgcagcgccagcacctggaccacttcttcgaccgccccaacctggcagcagctggtggcgtttacgcaagcgctgcctccaccccccggggagccgcccttcttcccggggcgtccggcaaagaccggcactcgtggtggcggaagaaccgcggaaaaagcctggacgttcccttgggcctacacggggggtccggcgtttcgtcgtccccacgttgaacgccgcttcctagggtgaactttcgtgttgcgccttcttcccccggggggaacggccctcggtggaatccttcctcccaagatcccagggggccccccctaaaagaagattgggttcgtaaggtatgagggcccccttgggcaggggg

SEQ ID NO: 68290 - protein, 104 aa, Zea mays
  misc_feature: Ceres CLONE 1544048
MGSLPAPASAEFAPRPLGRATVVASDLVPLFSAQRQHLDHFFDRPNLAAAGGVYASAASTPRGAALLPGASGKDRHSWWRKNRGKSLDVPLGLHGGSGVSSSPR

SEQ ID NO: 68291 - DNA, 671 bp, Zea mays
  misc_feature: Ceres CLONE 1544051
  misc_feature: Translation starting site: 321
  misc_feature: SWISSPROT Homolog: EC 1.2.1.70 Glutamyl-tRNA reductase
  misc_feature (404)..(404): n is a, c, t, g, unknown, or other
  misc_feature (407)..(407): n is a, c, t, g, unknown, or other
  misc_feature (420)..(420): n is a, c, t, g, unknown, or other
  misc_feature (430)..(430): n is a, c, t, g, unknown, or other
  misc_feature (435)..(435): n is a, c, t, g, unknown, or other
gcggtggcggccgctctagaactagtggatcccccgggctgcaggaattcgtctcacccctagaaaaactccgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccacaccgccaagccgcggggggtcgtcgtcggccctctgncanagggtggccggcnggcgcaggcngcgcntccgggtttgtggcggtgcgacgcccgcgggcgtggaagcccaggcgcaggccgtggcaaaaggagggcaagcgtcgccgccctcgagcagttcaggatatcggccgaccgttccttgaaggaaaggattccctttgctgggatagggccccagtgtcccccagccccagtgggagagcgtggaaaattgcttgttcaaaagaaatgggggcccctggtttttaagaacccccaac

SEQ ID NO: 68292 - DNA, 664 bp, Zea mays
  misc_feature: Ceres CLONE 1544054
  misc_feature: Encodes the peptide sequence at SEQ ID NO. 68293
gagctccccgcggtggcggccgctctagaactagtggatcccccgggctgcaggaattcgtctcacccctagaaaaaagtccccagtcccccactgggagcggcagccagcacgaggaaggagcagcgcgagggcaggcgccatgggggtccgctcggcggacacgaagctgcacatcccaccatccgccgcccgccgccccacgttcctgccattcgtggccgtcctcctcctctgctctgcctcctatctcatcggcgtctggcagcacgggggcttcgccactccatccgacaaacccgccgccgtctccaccgctacggccgtcgcctgcaccaacatcgccgccgccccgaagaggaggacccggtccggcgccagctccccgtccctcgacttctccgcgcgccacgcggccgcggcggacgacgcgctcgaggctagcaccgacaccgccgcctcctcagccgcaccgcggaggtcgtcgtaaccggcgtgccccgccaggtactcagagtacacgccgtgcgaggacgtggagcggtcgctgcggttcccgcgggagcgcctggtgtactgcgagcggcactgcccggcgtcagagcgggagcggctgatgtgccttgtgcccgcgccgcccgggtaccgcacaccgttccctggc

SEQ ID NO: 68293 - protein, 115 aa, Zea mays
  misc_feature: Ceres CLONE 1544054
MGVRSADTKLHIPPSAARRPTFLPFVAVLLLCSASYLIGVWQHGGFATPSDKPAAVSTATAVACTNIAAAPKRRTRSGASSPSLDFSARHAAAADDALEASTDTAASSAAPRRSS

SEQ ID NO: 68294 - DNA, 661 bp, Zea mays
  misc_feature: Ceres CLONE 1544055
  misc_feature: Encodes the peptide sequence at SEQ ID NO. 68295
  misc_feature (429)..(429): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (636)..(636): n is a, c, t, g, unknown, or other
  misc_feature (648)..(648): n is a, c, t, g, unknown, or other
ctggagctccccgcggtggcggccgctctagaatagtggatcccccgggctgcaggaattcgtctcacccctagaaaaacacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaggggcggcgcccactcgcccttcggcgtcggcgatctccgaggaggagcgccacacgcagcagatgcagtccatcangtgcgtcgttggcgtctctgacgcgtgaaacccggcccaaagtggtcaggggcgacccggccggcaaagggagaagccgcccgcgaagggcccgccatccaacgcccaaagggcgcacccaacaggccnnnnnnnaaaaaaaataactcccccccgggcgcccgcgccccgcgcccccgcccnnnnaccccccgnnncccgcccccntccggcgggggngcagagaccaccg

SEQ ID NO: 68295 - protein, 93 aa, Zea mays
  misc_feature: Ceres CLONE 1544055
  misc_feature: SWISSPROT Homolog: EC 4.1.1.49 Phosphoenolpyruvate carboxykinase (ATP)
  misc_feature (87)..(87): Xaa is any aa, unknown, or other
MATPNGLARIETTGKKKQDNGVWYDDSSAPVRAQTIDELHSLQRKRSAPSTPKRSAPTTPIRGGAHSPFGVGDLRGGAPHAADAVHXVRRWRL

SEQ ID NO: 68296 - DNA, 694 bp, Zea mays
  misc_feature: Ceres CLONE 1544058
  misc_feature: Pfam Name: DSS1_SEM1 Pfam Description: DSS1/SEM1 family
  misc_feature (68)..(68): n is a, c, t, g, unknown, or other
ctccccgcggtggcggccgctctagaactagtggatcccccgggctgcaggaattcgtctcacccctngaaaaaaccagaacaacctataacttgtttcaatgtaaatcaatagaaaaaaaaccgggccccagcccccaaacagcctccaggtctagctagggtttcgtctccgccgcttgctctaatcctctcccggcacgcgacacgcgagggcgcatcgtttatggcggcgacaccggcggacgcgaagaccgaggccgccaagatggacctcctcaaggacaacgacgagttctaagagttcgagatcgaccaagattgggatgagaaggaagaagcaatgaagctgtcaacaagtgggaggatgatggggatgacgatgatgtgaaatgatgattccccccgccacctagaggaagaactggaggggagcaaccccccaaaaaacctgaagtattatttttcccaggtaacaaatgatcctttctatgccagctactttttgggaaatcgaaacctttttgttaattttgggctggtggggagcaatccaaaccccggggggtaaaaaagtacccccaaaaaaaaaaaaaaaacccgaaaacccttgagggaccccaaatccccccttttaggggggggggaattacccccgccccccctgggggccgctgtttttaaacaccccggga

SEQ ID NO: 68297 - DNA, 682 bp, Zea mays
  misc_feature: Ceres CLONE 1544059
  misc_feature: Encodes the peptide sequence at SEQ ID NO. 68298
aaagctggagctccccgcggtggcggccgctctagaactagtggatcccccgggctgcaggaattcgtctcacccctagaaaaaacccatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggctactcactctctgcccaccccaatgagcttgtcgacgtcttcaccagtctgaaaaaccttgaaaagggtatgctgcagccccaccagatcattgcctagtacaaccatgcaatccatgaggctgagcgcaaaaaactcaaggatggtgcttttgaggatgtcctgagggcagctcaggaggcgattggcatccccccatgggatggaaattgccatccgccttaggcctggtggcttgggaatattgtgagggttcaccgccagtgaccctccctgttgaagaagctaaaaagttctgaggtacctgcatttcacggaaaacggttggtggataaagggcccccacaaccacctttgtttttcaagccggag

SEQ ID NO: 68298 - protein, 53 aa, Zea mays
  misc_feature: Ceres CLONE 1544059
  misc_feature: SWISSPROT Homolog: EC 2.4.1.13 Sucrose synthase
MGEGAGDRVLSRLHSVRERIGYSLSAHPNELVDVFTSLKNLEKGMLQPHQIIA

SEQ ID NO: 68299 - DNA, 627 bp, Zea mays
  misc_feature: Ceres CLONE 1544075
  misc_feature: Encodes the peptide sequence at SEQ ID NO. 68300
  misc_feature (389)..(389): n is a, c, t, g, unknown, or other
  misc_feature (517)..(517): n is a, c, t, g, unknown, or other
ctggagctccccgcggtggcggccgctctagaactagtggatcccccgggctgcaggaattcgtctcacccctagaaaaaaaggaagaagggcctcctgtctcacttccctcagtcctcgtccgtctctgctctccctcctctctctctctctacctagctagctagctagccttcctgtagcgcggcagatatggctgcctccaccacggcggcggcggcgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccngggacaacctccgctacatcgacgcgcacacgccgcgccgacgcggcgtccactccttcgcctcggcctcaacgcttcgccgactcacaacgacgagtaccgcgcccactacctcggcgcccagacangccgcagagggagagaagctcggcgccaggtaccacgcccgcgacaacgaggacctgccggagtccgtcgactgaaggggcaaagggcgccgtcgccgaggtcaaggacc

SEQ ID NO: 68300 - protein, 145 aa, Zea mays
  misc_feature: Ceres CLONE 1544075
  misc_feature: SWISSPROT Homolog: EC 3.4.22.14 Actinidain
  misc_feature (66)..(66): Xaa is any aa, unknown, or other
  misc_feature (109)..(109): Xaa is any aa, unknown, or other
MAASTTAAAALLLLLLSLAAAADMSIVSYGERSDEEARRMYAEWMAAHGRTYNAVGEEERRYQVFXGQPPLHRRAHAAPTRRPLLRLGLNASPTHNDEYRAHYLGAQTXRRGREARRQVPRPRQRGPAGVRRLKGQRAPSPRSRT

SEQ ID NO: 68301 - DNA, 672 bp, Zea mays
  misc_feature: Ceres CLONE 1544076
  misc_feature: Encodes the peptide sequence at SEQ ID NO. 68302
ctccccgcggtggcggccgctctagaactagtggatcccccgggctgcaggaattcgtctcacccctagaaaaaactcctcagctcaggcgagcagcggagccgagcagagcctcgagatcccgcccaccatttgccctccggccgacgcggagccgatcgcttcaccggcagcgaggacgatgggttccgtcgcggaggactccaccgcggcagcggcagcggcggcgtcggtagtgttccgctccaagctacccgacatcgagatcccgcggcacctctcgctgcaggcctactgcttcgagcggctccccgaggtgtcctcccgcccctgcctcatcgacgggcagacgggcgccgtgcacacctacgccgaggtggaccgcctgtcgcgctccgcggcggcggcgctgcgcgggctcggggtgggcaggggcgacctggtgatggcgcttgctccgcacctgccccgagttcgcctttggttttcctcggcgcggcgcggcttgggcccccgccccaccacgggccaaccgttttaccccccgccggaaatccccccccgggcgcccccggcgggggccaggggggccttccccaagccctgcccccccaaaaggggccccgggttccccccaaaggggggggcccgggggcaccttaaaggggcttc

SEQ ID NO: 68302 - protein, 163 aa, Zea mays
  misc_feature: Ceres CLONE 1544076
  misc_feature: SWISSPROT Homolog: EC 6.2.1.12 4-coumarate--CoA ligase
MGSVAEDSTAAAAAAASVVFRSKLPDIEIPRHLSLQAYCFERLPEVSSRPCLIDGQTGAVHTYAEVDRLSRSAAAALRGLGVGRGDLVMALAPHLPRVRLWFSSARRGLGPRPTTGQPFYPPPEIPPRAPPAGARGAFPKPCPPKRGPGFPPKGGARGHLKGA

SEQ ID NO: 68303 - DNA, 685 bp, Zea mays
  misc_feature: Ceres CLONE 1544077
tggagctccccgcggtggcggccgctctagaactagtggatcccccgggctgcaggaattcgtctcacccctaaaaaaaattcccccttcttgttgcctcggttcgtgctccgcccttcccagggtcccgtccgaaaaccctaaactcgagcgtcgccggcgacgctgccgaggcggaagcggcacaggcatgtacgcagagatcgaccgcgcggcgcctcttcggcggcgcgctgtgtccgtcttcgcgaccgcgttgctatagcagcagcacggcagcgctggatgcggtggtccggcgggtgccgctcactgacggcgcgtggttccactcctctcccgcgtggatggttttccaggacacggggcctgcacgggcggtggagcgtgcggacttacaggtacatatcaggtcgttctaagacgaggacagagggcgcccgccagctccggtgcggtgcggacgcgctcgagattgcgagcttgagatatgatctaagatcgacataagggtcagcagcaatggaatctgctatctcgttcgccagccattagagatgctccttgagcccgcaaagcaaggaatggacatggtgtgggccgtgcctactctgggactgggtgaaagattggcttgtcggaaacgcccatacgggatggacatatcacgccgcatctacgaatg

SEQ ID NO: 68304 - DNA, 649 bp, Zea mays
  misc_feature: Ceres CLONE 1544086
  misc_feature: Encodes the peptide sequence at SEQ ID NO. 68305
  misc_feature (649)..(649): n is a, c, t, g, unknown, or other
ctccccgcggtggcggccgctctagaactagtggatcccccgggctgcaggaattcgtctcacccctagaaaaagctccatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagacggagacggagaaggagcaggaggaggcggcggccgccagcgaggagctgcccgtcatgccctgggccacctccgtcgcaagcggttacacccttttgagggatccacaccacaacaagggtcttgctttcacagaggaggaaagggatggacactacttgcgtggactgctccctccggcagtactatctcagggactccaaattaagaagttcatgaacaccctgcggcagtaccagacn

SEQ ID NO: 68305 - protein, 149 aa, Zea mays
  misc_feature: Ceres CLONE 1544086
  misc_feature: SWISSPROT Homolog: EC 1.1.1.40 Malate dehydrogenase (oxaloacetate-decarboxylating) (NADP(+))
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQGLQIKKFMNTLRQYQT

SEQ ID NO: 68306 - DNA, 701 bp, Zea mays
  misc_feature: Ceres CLONE 1544088
  misc_feature: Encodes the peptide sequence at SEQ ID NO. 68307
  misc_feature (675)..(675): n is a, c, t, g, unknown, or other
caaagctggagctccccgcggtggcggccgctctagaactagtggatcccccgggctgcaggaattcgtctcacccctagaaaaaactggcaagtagcaacaggagcgcaggcagaactagagcggtcttggtatggcttcttccctcgcgcccgcgtcgtgggcactgccgctgcagatgggcggggctggggcggcagcggcgggcccttcctgccgcgcgacgctagccgtcgtcacggagccccgctgggccgcgtcgctgcgccgggcaagggttctcgtggcgccccggtgcgtggcgctcaacggggccggcgccagcggcaaggaggaggcccccaagatccaggaccagaggaaaaaacaccgctaaaacgaaggaagcgggggcccggccgagcccgttttaaaaccccaaatcctctttgggcccccagaagaaccccaaaatttctttttctttaacgccccttccgggccttttatgcaaggagaattcccgggtttggaaaaaaggggaaaacccctaaaaaaacaccggcggtgtttaaaaaggggggggggttcttgtgaaaaaacaaatccccttgtgaaccaattcgggacccctttctctcttggggaacgaaatgtttccccctcccgggaacgcgaaaccggggagacgcgggnataactccacaccccccctgcccaag

SEQ ID NO: 68307 - protein, 80 aa, Zea mays
  misc_feature: Ceres CLONE 1544088
MASSLAPASWALPLQMGGAGAAAAGPSCRATLAVVTEPRWAASLRRARVLVAPRCVALNGAGASGKEEAPKIQDQRKKHR

SEQ ID NO: 68308 - DNA, 695 bp, Zea mays
  misc_feature: Ceres CLONE 1544091
  misc_feature (170)..(170): n is a, c, t, g, unknown, or other
  misc_feature (298)..(298): n is a, c, t, g, unknown, or other
  misc_feature (300)..(300): n is a, c, t, g, unknown, or other
  misc_feature (321)..(321): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (393)..(393): n is a, c, t, g, unknown, or other
  misc_feature (394)..(394): n is a, c, t, g, unknown, or other
  misc_feature (398)..(398): n is a, c, t, g, unknown, or other
  misc_feature (401)..(401): n is a, c, t, g, unknown, or other
  misc_feature (402)..(402): n is a, c, t, g, unknown, or other
tccccgcggtggcggccgctctagaactagtggatcccccgggctgcaggaattcgtctcacccctagaaagagccaaccgcgaagcactacactacactacaccacacccacccgacgacgatcacacacgcagaagatcgagttcgttcgatcgtgaccgtgacgcangaagctataagctagccaagacaggaataataatggcggcgtcaacggtggcgagcctctctgtcccggtgacgacgacgaccttcgcggcggcggcggtagcttgcgccgccgagggggtggatcgncnccccgaggagggctgtctctnggccccccctggttccccccgggggttttttttcccccacccacgggggaaagaaaagggggttnnttnccnncttnccnncctattttttttgaaataaacaagaaacttccccaacacccccgggggggggggaatatattttccccgacacaccctataggccccacccccaggtgcctccgtgcctcggggacaactctccatcatactctttgtccccgtcccgaacatccccctccaggagctcgacgggcgcccgacgcccaccaccccttccgcgccaagtcctggcccgggtcccccccccccaccgcgaccctacgcccttgccacgatggcacctccccctcacggcgagccccggctagcgg

SEQ ID NO: 68309 - DNA, 619 bp, Zea mays
  misc_feature: Ceres CLONE 1544471
  misc_feature (133)..(133): n is a, c, t, g, unknown, or other
  misc_feature (134)..(134): n is a, c, t, g, unknown, or other
  misc_feature (216)..(216): n is a, c, t, g, unknown, or other
  misc_feature (217)..(217): n is a, c, t, g, unknown, or other
  misc_feature (247)..(247): n is a, c, t, g, unknown, or other
ccgcggtggcggccgtctctagaactagtggatcccccgggctgcaggaattcgtctcacccctagaaaaatctcgacctcgcttcctccctcccaccgtgccctgccttttcctcacgacctcgccgccacnngctcgcgtctcgccgctgattgcggtcccccatggaaccgtcgtcctctcaatccgtccgccgctccatcgtcttcctgtanntttgtgctgctgaaatatggggtaacttgnggttcctccaggttgaagcgggcccaaccacgcgggccgaaattggaggcgaaaggtgggccgtcccgggttgtcctggaaggcccaaaaaaaaaaaaaaggctttctttgttttttttttgggttttcaacccccaagggtttgggggaaaaaaccccccccccaattggaaaggaggggaccccccccggggcccaagggttttccccaaaccccccgggtttttctcaccgggggggggttttttttttttaacgggggggaaaaaaaaaaacaccccctttttttttggggggggggggggggggagaaaccccccccccggggagggggggcccccccccaccacagggaggagggagagattcccc

SEQ ID NO: 68310 - DNA, 731 bp, Zea mays
  misc_feature: Ceres CLONE 1544473
  misc_feature: Encodes the peptide sequence at SEQ ID NO. 68311
  misc_feature (43)..(43): n is a, c, t, g, unknown, or other
acccgcggtggcggccgctctagaactagtggatcccccgggnctgcagattcgtctcacccctagaaaaagcttccttttccttctctatccgcgagcctcgtaccggcgcagccatggcggaggagcccgccgttgtcgtggcctcctccagctacgaggttgacctcgggaacctcatggcgtacgatccgtcgcatcacgtcgccaccgcctccagggaggagctgagacaggagtgcctgcggaagggtacagagctggcgcaggcggtggccgacgtcctcttcgcgctgccgcccaacgaggaccgcgacggccccattatccacctcccgccgcccaccttcagactcccgcgggagaagcatctacccatgcccaagccacctaccccccgggagctgtttgcataggctaagggattacccatcgcaaaaagaacaatctgagtgtgatgagccaactcactccttggaggggactcatggctttgaccgggttatggatgaaaacacatccccatcattgaatcctattttactgatgaacctcggcgttgatccttttgcccacagaagtggttcgcaaatgaacatacggcttgataattctcgttcctaaatccactcgggttactttactcataactttgccttggttgggccctttcccctgtgtctaatcacccttggttggtaaggcggttggcccctcccctggtaacgaat

SEQ ID NO: 68311 - protein, 99 aa, Zea mays
  misc_feature: Ceres CLONE 1544473
  misc_feature (4)..(100): Pfam Name: RRS1 Pfam Description: Ribosome biogenesis regulatory protein (RRS1)
MAEEPAVVVASSSYEVDLGNLMAYDPSHHVATASREELRQECLRKGTELAQAVADVLFALPPNEDRDGPIIHLPPPTFRLPREKHLPMPKPPTPRELFA

SEQ ID NO: 68312 - DNA, 641 bp, Zea mays
  misc_feature: Ceres CLONE 1544474
  misc_feature: Encodes the peptide sequence at SEQ ID NO. 68313
  misc_feature (441)..(441): n is a, c, t, g, unknown, or other
  misc_feature (494)..(494): n is a, c, t, g, unknown, or other
  misc_feature (495)..(495): n is a, c, t, g, unknown, or other
  misc_feature (497)..(497): n is a, c, t, g, unknown, or other
gcggtggcggccgctctagaactagtggatcccccgggctgcaggaattcgtctcacccctagaaaaatttggatgggggaaaaagaatcccgctactgaccaggcagcagtgaaatcattcctggatcaagtaaaaggagcaagagaaatgaatatcgatagctggcatatcatcatgaggatgcgaattccacaggaaggcccatgtgatcctattgctcccttagatcttccacattcgttgcatgctttccaccgcgtatcagcttgtgactctctcaatttggagggataccacacattccgtggaggattctggaattattttagcttgggaatggatgcacaagtatcctatgaattccactctgaaaggaagagaaatccagagaagttcagacaccagctaagaaatcagggtacatatgctaagcttgganttaagcattcccctaaccatctttcatcgagggaacaatttctcaaactttgnnanaaggggaagaacttgaaaaaacctggttccccggggggaaaacctaaaaatccccgcaacattcaatcctttatcggccgaaacctgcaaagtttcttggggaatgaatccctgggaaaacctgggcaaggaaacccccaaaaa

SEQ ID NO: 68313 - protein, 213 aa, Zea mays
  misc_feature: Ceres CLONE 1544474
  misc_feature: SWISSPROT Homolog: EC 2.7.1.107 Diacylglycerol kinase
  misc_feature (147)..(147): Xaa is any aa, unknown, or other
  misc_feature (164)..(164): Xaa is any aa, unknown, or other
  misc_feature (165)..(165): Xaa is any aa, unknown, or other
GGGRSRTSGSPGLQEFVSPLEKFGWGKKNPATDQAAVKSFLDQVKGAREMNIDSWHIIMRMRIPQEGPCDPIAPLDLPHSLHAFHRVSACDSLNLEGYHTFRGGFWNYFSLGMDAQVSYEFHSERKRNPEKFRHQLRNQGTYAKLGXKHSPNHLSSREQFLKLXXKGKNLKKPGSPGGKPKNPRNIQSFIGRNLQSFLGNESLGKPGQGNPQK

SEQ ID NO: 68314 - DNA, 666 bp, Zea mays
  misc_feature: Ceres CLONE 1544475
  misc_feature: Translation starting site: 86
  misc_feature (469)..(469): n is a, c, t, g, unknown, or other
  misc_feature (516)..(516): n is a, c, t, g, unknown, or other
  misc_feature (532)..(532): n is a, c, t, g, unknown, or other
tggcggccgctctagaactagtggatcccccgggctgcaggaattcgtctcacccctagaaaaaagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaggaccccgccgtgagcatcgccatcgtggagcagtcggtgtccccccggcgccgcncgtggctgggcgggcagctgttctcggccatggtggtgcgcaagccngcgcacctgtttcctnaccaactggccgtggcgtacgacgaagcccaagaactactggtcctcaagcacgccccggttcttcaggtccaaggtcatgaaccctggtcctggggggcccccaagttaagttgtttaaacccccggggcggg

SEQ ID NO: 68315 - DNA, 724 bp, Zea mays
  misc_feature: Ceres CLONE 1544476
  misc_feature: Encodes the peptide sequence at SEQ ID NO. 68316
  misc_feature (572)..(572): n is a, c, t, g, unknown, or other
ggagctccccgcggtggcggccgctctagaactagtggatcccccgggctgcaggaattcgtctcacccctagaaaaaaaatggtccccatagtgatgaagaatatttagctagagtcaactggatgcataatagtgctcttgctgttcaagttctcaacaggtcacatacgaaacttaaattacttaagtttgatattagtacaggtgaaagagaagtcttactagaagagcagcatgatgtatggatcacattgcatgattgcttcactccactagacaaaggagtgaataataaacatccaggtggctttatttgggccagtgaaaaaacaggattcaggcatttatatgttcatggcaatgatggagcatgcttaggacctctcacacaaggtgattggatggttgagcacattgctggtatcaatgagagtaatggacttatatatttcactggaacattggatggaccattggagacaaatctctaccacaccaatctctttccagattggagccttcccttgcaaacccctaaaaggctgactcgtggaactggccggcattcantaattctcgaccatcagttgctgaagtttattgatgtgtatgacacagcaaaatctccacctgtgatcttgctgtgctctttgcttgatggaagtgtaattatgcccctgtttgagcagcactgactattccgcacttaaaaagttccagcg

SEQ ID NO: 68316 - protein, 190 aa, Zea mays
  misc_feature: Ceres CLONE 1544476
  misc_feature: SWISSPROT Homolog: EC 3.4.14.5 Dipeptidyl-peptidase IV
  misc_feature (150)..(150): Xaa is any aa, unknown, or other
MHNSALAVQVLNRSHTKLKLLKFDISTGEREVLLEEQHDVWITLHDCFTPLDKGVNNKHPGGFIWASEKTGFRHLYVHGNDGACLGPLTQGDWMVEHIAGINESNGLIYFTGTLDGPLETNLYHTNLFPDWSLPLQTPKRLTRGTGRHSXILDHQLLKFIDVYDTAKSPPVILLCSLLDGSVIMPLFEQH

SEQ ID NO: 68317 - DNA, 659 bp, Zea mays
  misc_feature: Ceres CLONE 1544479
  misc_feature: Translation starting site: 331
  misc_feature (397)..(397): n is a, c, t, g, unknown, or other
tggcggccgctctagaactagtggatcccccgggctgcaggaattcgtctcacccctagaaaaactccaactccaacatatgggtcgcccacaccgatctaccaccctccggctaggcatttgtttgataagaagcccttgctagatcacttccataaggaccatgactatcaccacttcttagaccacttccacaagaaacccgtgccacaaaagccaaagccagaacccaagccagaacccaagccacagcctaagcccgagtaccaccctccgacacccacatatgtttctccaactcccatctatcacccgcccgctgagacagaaatgaagtatgacaacaaccccttctttgaacactttcacaaggaccatgattacccccccccccctnaccacttccaaaaaaagtctgtgccacccaagcccaaacccaaagtccagagtccaagcccaaacgcccacacctaaggcctgaataccaacccccccccagccccaaatacgcggacgtccaaaccctaaactcaccaccccttccaacccaagaaagaagtgggactttgggacagaaagcccctttccttgtaatcacttccccaaccaacccaggcattccacccccctttctttaacctacattgacacaggaggcg

SEQ ID NO: 68318 - DNA, 919 bp, Zea mays
  misc_feature: Ceres CLONE 1544480
  misc_feature: Encodes the peptide sequence at SEQ ID NO. 68319
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (459)..(459): n is a, c, t, g, unknown, or other
aaagaagtatccttcccnnnnnnnnnnnnnnnnnaccnnncctttttcttgacctccccccggtgggggccgctctatactagtggatcccccgggctgcaggaattcttctcacccctagaaaaatatcttctcggtcgtcttttccaaactggaagatccaatcctccacaaaccctaacgcctgtggccatgctcagggagccccctctggctagcgagcctcttggttcgggggcggcatctcctcccacgacgccgcctccggtctcctctctcgtacaccaggcatttccttgaattattccaccctaggatcttcctcgttgccttcgagagccaagggtctagggacaacccttcaaatcgccccttaaaccggaggttaaagattaaaaaattatgagatcatggtttccaacacaccctcgggggggggggggggggggtgggaaatanattccacaaaaaaaccccgccccccccacaagagaggtggggcattcccactctcaaaattcaacgcctagagcaccagtgccgcactttcgaatggccttatggcggcgggtgggcgactatagagtgtgaaaacccaataacgttggtcctaggtaagatacgtgtcttctgctgtattgtgcgcattattccgcgaaggcatatttcatagactgtagctctcgtcctccgccgctcctcatggtacactctgcctcgttggtcctggctccgaatctttgctcccctgtccatgcgtccggaggtctgactctaactgacatgaggcgaagaactatgctgcacgactgtcgtcaatatatatgaggctggcgggtgtagactacaacagtagagtcttgtatcccgttctgtctacgatcaccccataaacttttcttatttctagatggcgggg

SEQ ID NO: 68319 - protein, 35 aa, Zea mays
  misc_feature: Ceres CLONE 1544480
MLREPPLASEPLGSGAASPPTTPPPVSSLVHQAFP

SEQ ID NO: 68320 - DNA, 705 bp, Zea mays
  misc_feature: Ceres CLONE 1544481
  misc_feature: Encodes the peptide sequence at SEQ ID NO. 68321
  misc_feature (680)..(680): n is a, c, t, g, unknown, or other
  misc_feature (705)..(705): n is a, c, t, g, unknown, or other
cgcggtggcggccgctctagaactagtggatcccccgggctgcaggaattcgtctcacccctagaaaaatccaaacctgcaactccgagtcgtctcccgccaacccaatttcgcttcccgccgctccccatctcatcccacaccgtcaaaccgcccgaaaggccgctagaaatccgatcccgagccgccgcgtctcgctcgcgtcttttcccctctgctcgagcacgcgcggctgctcccggcggcggcggcgatgagcgcggtgaacatcaccaacgtggcggtgctggacaaccccaccgccttcatcaacccgttccagttcgagatatcctacgagtgcctcgtgcccctcgacgacgatctggagtggaagcttatatatgttggatcagctgaagatgaaaactacgaccaacagcttgagagtgtgcttgttggccctgtcaatgttgggacctaccgttttgtcctccaggctgatccaccggatccctcaaagatccgtgaggaagacataattggtgtgactgtgctgctattgatgtgctcttacatgggccaggagttcatgagagtaggctactatgtgaacaatgattatgacgatgaacagttgagagaggagcctccagcaaaggtgctaatcgatcgggtgcagagaaatatcctgggcgacnagccccgggttaccaagtccctatn

SEQ ID NO: 68321 - protein, 150 aa, Zea mays
  misc_feature: Ceres CLONE 1544481
  misc_feature (1)..(148): Pfam Name: Anti-silence Pfam Description: Anti-silencing protein, ASF1-like
  misc_feature (143)..(143): Xaa is any aa, unknown, or other
MSAVNITNVAVLDNPTAFINPFQFEISYECLVPLDDDLEWKLIYVGSAEDENYDQQLESVLVGPVNVGTYRFVLQADPPDPSKIREEDIIGVTVLLLMCSYMGQEFMRVGYYVNNDYDDEQLREEPPAKVLIDRVQRNILGDXPRVTKSL

SEQ ID NO: 68322 - DNA, 649 bp, Zea mays
  misc_feature: Ceres CLONE 1544482
  misc_feature: Encodes the peptide sequence at SEQ ID NO. 68323
  misc_feature (265)..(265): n is a, c, t, g, unknown, or other
tccccgcggtggcggccgctctagaactagtggatcccccgggctgcaggaattcgtctcacccctagaaaaaactaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgncagggcacctccgtacctacatgaaacgcgggattccccaagcggtttcaagaggatgagggaagaaagaaccagcttggcaaaaaaatcttcccaaaaattgaatggcttgggttaaaaggaacatcaaaacattggttttgaatagaaagcccccgggtttaagccaactccccagaacttcttttgaaaaaaaggcccaattaaacattcctttttaaaagggggcccctaaacccccccctttcgggggggaaacccctctcccaaaatttttataatactggggaaaaaacccccttcttttttttttaaaaatttggaaaaaattttttcccccccccccggggcgtttttttttttgtgggggtgaaaaaaacaaga

SEQ ID NO: 68323 - protein, 47 aa, Zea mays
  misc_feature: Ceres CLONE 1544482
  misc_feature (29)..(29): Xaa is any aa, unknown, or other
MASLLARQAAQALRARQTAQLGPAASAMXGHLRTYMKRGIPQAVSRG

SEQ ID NO: 68324 - DNA, 706 bp, Zea mays
  misc_feature: Ceres CLONE 1544486
  misc_feature: Encodes the peptide sequence at SEQ ID NO. 68325
gctctagaactagtggatcccccgggctgcaggaattcgtctcacccctagaaaaaaattccaacactcaggcaacccagctttggctgcccttgcttgctgctcagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaagtgcgtcgccccagtgaagggggacaaaggaactgctgtgcctccggtggctacgaatgggaggaaggaggcgccgcgtgaacgagcaacagaagtggaagccccaagggaactgtggacaagcacctctacaagatatcccccgccgcttctcttgcagggggaagaaggcaaaggaccctcgtaatcctcaatttggcaccccgccgtggtacccgaaaggggggcctaactccttaaatctagaattcccgcccctggcgaataggaccatagggccttttaacctaaccctaagggcctgaaccctttatgaattaaatgcctttatgg

SEQ ID NO: 68325 - protein, 126 aa, Zea mays
  misc_feature: Ceres CLONE 1544486
MEAQDDCKWRQVPAFGDWNLWDDMPVTQYFQAGTFFFAAPTTEKDDDEDLFKVPQFPATPYSYKKCVAPVKGDKGTAVPPVATNGRKEAPRERATEVEAPRELWTSTSTRYPPPLLLQGEEGKGPS

SEQ ID NO: 68326 - DNA, 677 bp, Zea mays
  misc_feature: Ceres CLONE 1544488
  misc_feature: Encodes the peptide sequence at SEQ ID NO. 68327
  misc_feature (677)..(677): n is a, c, t, g, unknown, or other
acccgcggtggcggccgctctagaactagtggatcccccgggctgcaggaattcgtctcacccctagaaaaaagtcaccaaaccaaaaccgctctcgagtctccatccattctctccgctcatccgcagctctcgagtctccagctctagctagccttagcctcgtccaagggacgaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttctgcctcctcgacggcggggggggcgggtccgcccagccggggccgcttccccgccaaggtcgccgcgctctaagacgccgtcttcgagcagttcgacgcccaccccagcggcccccgtcaaccgcgccaaattccacgacaaaaagcccccgcatcagggctcgccgtcccccaaaggcttcggttcccaaccggttccggggtgccccggaaacaaaagggcgggaactttccggcctcaagcaccccaaacccggaggccctgggaatccccccccaaaaccaaacccaccccaaggggggaaggcggaagcccaaagggggccaaaggccn

SEQ ID NO: 68327 - protein, 163 aa, Zea mays
  misc_feature: Ceres CLONE 1544488
  misc_feature (24)..(52): Pfam Name: efhand Pfam Description: EF hand
MSVVILDGSTVRGFVADEAAFARSLDARFAALDANGDGVLSRAELRRALESFCLLDGGGGGSAQPGPLPRQGRRALRRRLRAVRRPPQRPPSTAPNSTTKSPRIRARRPPKASVPNRFRGAPETKGRELSGLKHPKPGGPGNPPPKPNPPQGGKAEAQRGPKA

SEQ ID NO: 68328 - DNA, 743 bp, Zea mays
  misc_feature: Ceres CLONE 1544490
  misc_feature: Encodes the peptide sequence at SEQ ID NO. 68329
  misc_feature (743)..(743): n is a, c, t, g, unknown, or other
agtggatcccccgggctgcaggaattcgtctcacccctagaaaaaagaccgggagtagccgacgcgccgtcactgaatcctcagatcacggctagccgtaatcacgacactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaaacggtcattcaagtatgcctgcccgcttgacaagctcaaggccgatcgtgatagaggtatccccacccgatatttgctcttgtggaagttctaagaccaccaagttactaactgctctgtcgtttgatgcccctttggacacccgtgactttcacccatgaaaattaattactggctacttcccatagctggaactgcccctggctcctaatccagagactgcccccactgtgcccgattttaaaggctcgtatcctccccacggacgagaaatgtacccgctgcaccatatggtcctcccttgacttttcacctgattgggaatcagaagtccaaaattaatttgtcttattcgcactactaagattgttcgtccctccttattcctaatctcgtcacacaaggcaccccctttttaacatgaaacatgattaaaccn

SEQ ID NO: 68329 - protein, 81 aa, Zea mays
  misc_feature: Ceres CLONE 1544490
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYACPLDKLKADRDRGIPTRYLLLWKF

SEQ ID NO: 68330 - DNA, 770 bp, Zea mays
  misc_feature: Ceres CLONE 1544494
  misc_feature: Encodes the peptide sequence at SEQ ID NO. 68331
acccgcggtggcggccgctctagaactagtggatcccccgggctgcaggaattcgtctcacccctagaaaaaaccatagaccatccatgccttgtaacacttatcccgtctcccccttcctcgccgcctccactagaggggttagctcctcccaactctcaaaaccctacccacgcgatgagacatcgatcggtcgagcgcgaattccccaaccgcgagcggggggatcggccgccgcccggggtgctgggacacccgcgccgcgggccggcttacacgacgaagttgtgcgcgctgtggcagctcggcagctgttcccgcgacacatgaagcttcgcgcacggagacgcgtaggattgccggttccccggatcgtgcacaacgtccccgccccacaccccccgttggtaatatagaggtggtgacattagaaacaggtttgatatgaggcgcctcacctcataagaggcagtccccgggatggagatcccaggggccatccctcccttacgagacctaacgagcaattccccaagaaagggaatcaaactattttcaccgccaccctctaatcaaacagtgaaaatgaggtctggacccaaagggcctcggggacgggagaaactctagatcctcctaggaactcccagaggactccttgacacctcaaggaggatagcaaccaacggactacttctggtctcttggcggaggcggtaacaggtgggaccacaatcaagcccggcctcgagaatcacgcgtagacgcgg

SEQ ID NO: 68331 - protein, 50 aa, Zea mays
  misc_feature: Ceres CLONE 1544494
MRHRSVEREFPNRERGDRPPPGVLGHPRRGPAYTTKLCALWQLGSCSRDT

SEQ ID NO: 68332 - DNA, 640 bp, Zea mays
  misc_feature: Ceres CLONE 1544495
  misc_feature: Encodes the peptide sequence at SEQ ID NO. 68333
  misc_feature (283)..(283): n is a, c, t, g, unknown, or other
  misc_feature (284)..(284): n is a, c, t, g, unknown, or other
  misc_feature (450)..(450): n is a, c, t, g, unknown, or other
gcggtggcggccgctctagaactagtggatcccccgggctgcaggaattcgtctcacccctagaaaaatcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctnngtaagtgcccatatccctcgtcccagatgaagtgtgcatgcttggtgatgcccaacatgttaaggaggcccagaagagggacctgactacctgaatgttgagctctcagaaaatgaccagaaccagaacttgttaaaagcttgccaaaaatacctgctttcttggntccaaggcctctttcaggcaaatcccccccccttggcccgggccccaaaaggagggaaattccccaacccgggttccccccccgaaaccccccggccccaggggaaaaaaaaaaaggaaccccccaattccccccctaaaaaaggtttttttcgggggggtttccccctgcccacttgcgaagaaaaaaa

SEQ ID NO: 68333 - protein, 51 aa, Zea mays
  misc_feature: Ceres CLONE 1544495
MSKLQSESVKDAISQIVGDAKEKNRKFTETVELQIGLKNYDPQKDKRFSGS

SEQ ID NO: 68334 - DNA, 920 bp, Zea mays
  misc_feature: Ceres CLONE 1544498
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (264)..(264): n is a, c, t, g, unknown, or other
  misc_feature (309)..(309): n is a, c, t, g, unknown, or other
  misc_feature (313)..(313): n is a, c, t, g, unknown, or other
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (353)..(353): n is a, c, t, g, unknown, or other
  misc_feature (362)..(362): n is a, c, t, g, unknown, or other
  misc_feature (363)..(363): n is a, c, t, g, unknown, or other
  misc_feature (452)..(452): n is a, c, t, g, unknown, or other
  misc_feature (455)..(455): n is a, c, t, g, unknown, or other
  misc_feature (456)..(456): n is a, c, t, g, unknown, or other
ttatatagagggaagtttgggatttngnnnggggggnnnnnnaaaaagtggagctcaccgcggtggcggccgctctaaactagtggatcccccgggctgcaggaattcgtctcacccctagaaaaaaccgccatcacacgcacgcatacccagcagccgagtgaggtaagcatcctaaaaaagctgtgatctgatcgacatggccgccgccaccatgggatctcacctcccacgcgctcatccgtaagccggcgaccaagaccngggacgtcttgggctaggggcgcatcaccatgcgccagactgctngaanggcccacccagcggngnnngagggggccctggtacggggncgaccgacnnccagtaccttgggccggagaacagagaataccccccaaccctacttgaccccacaaatccccccggccaatacaggaaaaaaaaaaccnaanncccctgcaacctctagtggtgtttagtttttgggggatgtggccgcgaaccacgcaagcgaaacccccctacctacttggggccatgccctgggaccagacatcgggattctatttatcaaccaaaaccctgcatcccctcgaagaaagtctaacaaaaacatcctaaaaaaacacctcggaacagggttcctagccccacgggaaaatcaaaaataattccaggctaaggtccggcgtaaatagagctgcgatacgagagagcgccggaacgaagacacacatcgttaatacaagcgttcctatgtctcaacttatggaaaaattcatttagttggggtgtctctctgggcgccgaccgcccgaaagaggaaacgccgaagacatcctcgtgcgtccgtatatctgggaagagggtgtattatacactgtttttgtaacccgcgcaggacataattactgtac

SEQ ID NO: 68335 - DNA, 713 bp, Zea mays
  misc_feature: Ceres CLONE 1544499
  misc_feature: Translation starting site: 380
  misc_feature: SWISSPROT Homolog: EC 5.3.4.1 Protein disulfide-isomerase
ccgcggtggcggccgctctagaactagtggatcccccgggctgcaggaattcgtctcacccctagaaaaagaagacttcccttcgtctgcttcccagagacccagccatggcgatctcccagatctacacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcaccacaccatggagtttccgggtatccaacaatccaatggttcccgaaaggatccttggagcccaaaaagtatgaaggacaacgcactgcagaagcccttgctgaatttctcaatactgatggaggcacaaatgtaaagctggcaaccattccttcaagtgttgtggttctcaccccagagacctttgactcaattgtccttgatgaacccaacatgtccctgttgaattctatgccccgtggtgtggtcactgccgagccttgccacgaccgatgaaatagtggcttctgttctcagcttggcgaaggagttg

SEQ ID NO: 68336 - DNA, 763 bp, Zea mays
  misc_feature: Ceres CLONE 1544500
  misc_feature: Encodes the peptide sequence at SEQ ID NO. 68337
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (402)..(402): n is a, c, t, g, unknown, or other
  misc_feature (403)..(403): n is a, c, t, g, unknown, or other
  misc_feature (422)..(422): n is a, c, t, g, unknown, or other
acccgctgggctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaaccggtagtccccccgccactaggggggggggaccncnnncctctcnncccaccccccccccttttntgtggaactgggagctggaagtgaatcccctcccgggggggcgatgcctgggcgccgctggggttccggggttccccgaaaatcccggcccaaaaacgggcttcaagttccggcgaaggcgttgttgtttccaagggccgcctcgcaaatcttccgtggagggccgggctgaacataaccgggggaacccccacttgggggtgccctaaaaaagatccggggcacactggaggtaggtcaaagagtgtccaagggtcttacattaaagggtcatcctggatgtggcgggcgcttcacttcccagtaacgactcaaccaagatatcctctcgggcggtcccg

SEQ ID NO: 68337 - protein, 66 aa, Zea mays
  misc_feature: Ceres CLONE 1544500
MAASALHQTTSFLGQALVSRAAGVDAGGRITMRRTVKSVPQSIWYGPDRPKYLGPFSEQTPSYLNR

SEQ ID NO: 68338 - DNA, 796 bp, Zea mays
  misc_feature: Ceres CLONE 1544504
  misc_feature: Encodes the peptide sequence at SEQ ID NO. 68339
  misc_feature (286)..(286): n is a, c, t, g, unknown, or other
  misc_feature (366)..(366): n is a, c, t, g, unknown, or other
  misc_feature (370)..(370): n is a, c, t, g, unknown, or other
  misc_feature (373)..(373): n is a, c, t, g, unknown, or other
  misc_feature (375)..(375): n is a, c, t, g, unknown, or other
  misc_feature (796)..(796): n is a, c, t, g, unknown, or other
ggcgggcgctctagactagtggatcccccgggctgcaggaattcgtctcacccctagaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtccgccgttgtgacctgcggagaggtgacgtcctcngtggccccgtgcctcgggtaccctatgggaagcgaggagttttttttttcccccccccccggggtaaagaaacggggtcnaaanccncncctcccccccccccgtacccggcaagacacatagaaaccgcctccaaaagcggggggggggcccggctacttttggcttagctttacactgggccctacgccctcccaactctcaccgggtaaatggtgtgcgtcccaccgtcccgctggggttcaaccacccccacccgcgttccgactgcaacaaaacaaattatcctacagctcactcgaatgctctcaatgcccacggtcaccagcctactttattcttttctctactctacctcactgacaaatcatacattcttacaccagctgccgatcgtgccccttcaacatcactaaatacatcacactcgttccacagatccccactatgaacgcatccacaccttcaccacacatatacacatcgcatagaccccacgcacaattatcn

SEQ ID NO: 68339 - protein, 82 aa, Zea mays
  misc_feature: Ceres CLONE 1544504
  misc_feature (69)..(69): Xaa is any aa, unknown, or other
  misc_feature (70)..(70): Xaa is any aa, unknown, or other
  misc_feature (72)..(72): Xaa is any aa, unknown, or other
MAARSSSQQLVAAAVLAAALLLLAAGAGTASAVVTCGEVTSSVAPCLGYPMGSEEFFFSPPPGVKKRGXXPXLPPPRTRQDT

SEQ ID NO: 68340 - DNA, 725 bp, Zea mays
  misc_feature: Ceres CLONE 1544505
  misc_feature: Encodes the peptide sequence at SEQ ID NO. 68341
  misc_feature (1)..(1): n is a, c, t, g, unknown, or other
nccaggctggagctcaccgcggtggcggccgctctagaactagtggatcccccgggctgcaggaattcgtctcacccctagaaaaaaagccacatgaatgtattagatcaggtgaaagggcaagagtttcgatcagtgggcaggccgcaggcgcaaacaaacagttgacagggtagactcaaggcaatagtgaggaagtggccgatctgttgaggccgatggaggcagataacatggtggccatgggctgcggaggtttctactggcagtcgcctccgcgcttcctccttgaacccctcgacctagccgacatcgtcgacagcagcatgtacgtgccgacgaacgaggctgatgagcccgtatccgggctctgctcatcgaaccggccggcggaggattactccagttcggccgacggcgccaactcctgctccgcggcggtggttccgtcgccgccgccgcctccgggcgtgacgacgacgacgacgaggaacatggacatggagaggacccgccgcaggaagctcaacgagaggctctacgcgctccggagcgtcgtgcccaacatcaccaaggtcgtcagagcactgcatctatctgtgcgtgcatggtcatggagacagcttggtaattaatcgacttctttggtgtacgcactacgcagatggacaaggcgtccatagtcagggacgccatcgcccacatcgagcatctgcaggagcagg

SEQ ID NO: 68341 - protein, 138 aa, Zea mays
  misc_feature: Ceres CLONE 1544505
MEADNMVAMGCGGFYWQSPPRFLLEPLDLADIVDSSMYVPTNEADEPVSGLCSSNRPAEDYSSSADGANSCSAAVVPSPPPPPGVTTTTTRNMDMERTRRRKLNERLYALRSVVPNITKVVRALHLSVRAWSWRQLGN

SEQ ID NO: 68342 - DNA, 727 bp, Zea mays
  misc_feature: Ceres CLONE 1544507
  misc_feature: Encodes the peptide sequence at SEQ ID NO. 68343
  misc_feature (454)..(454): n is a, c, t, g, unknown, or other
  misc_feature (623)..(623): n is a, c, t, g, unknown, or other
  misc_feature (693)..(693): n is a, c, t, g, unknown, or other
  misc_feature (695)..(695): n is a, c, t, g, unknown, or other
  misc_feature (696)..(696): n is a, c, t, g, unknown, or other
  misc_feature (722)..(722): n is a, c, t, g, unknown, or other
  misc_feature (727)..(727): n is a, c, t, g, unknown, or other
aagctggagctccccgcggtggcggccgctctagaactagtggatcccccgggctgcaggaattcgtctcacccctagaaaaagaagggtcgaactaggcccgtcagagaatcagaagctctgaggctgctcacatcaggccaccaccaacccctcacgtcggcggtggcgtcgtcggcgaaggcagagatggcgtccgtggccgcggcggaggtcgcggcggcggcgctccggtcggtgctgtcgcgcgcgcagcaggcggcggcgcgggcggggcgcgcgccggggtccgtgcgcgtggtggcggtgagcaagaccaagccggtgcctgtcatccggggcgtctacgacgcgggccaccgctgcttcggggagaactacgtccaggagctcatcgacaatgcggctcagctttcctgaagatattgagtggcactttattgggaatcctgcnaagaacaaaaccagagccctacttggctggggtgccaaaccttgaaatggttgagacgggcaatgaagaaaaaattgccaaccccccttgaccaagggtaacctaacctgcgggaaaaaactccttaaggttttggaaccaaaccaaccccaattggaaaaaaaatcgnaaaattggaagaagagacccttcgggaatccctcgaaccctccccaaacccgtgccacaatgaacagagncnnaaaccctgaggcttcccccgcccctnaaacn

SEQ ID NO: 68343 - protein, 76 aa, Zea mays
  misc_feature: Ceres CLONE 1544507
MASVAAAEVAAAALRSVLSRAQQAAARAGRAPGSVRVVAVSKTKPVPVIRGVYDAGHRCFGENYVQELIDNAAQLS

SEQ ID NO: 68344 - DNA, 745 bp, Zea mays
  misc_feature: Ceres CLONE 1544509
  misc_feature: Encodes the peptide sequence at SEQ ID NO. 68345
  misc_feature (187)..(187): n is a, c, t, g, unknown, or other
  misc_feature (339)..(339): n is a, c, t, g, unknown, or other
  misc_feature (342)..(342): n is a, c, t, g, unknown, or other
  misc_feature (745)..(745): n is a, c, t, g, unknown, or other
atctctggagctccccgcggtggcggccgctctagaactagtggatcccccgggctgcaggaattcgtctcacccctagaaaaacctcctccgctgccctcctcgcctccctcgattcagggttcagcgaattcggacagaacccggcgtgtccgtgtcgaccgacccgtccccctgcaagtctgcnacgagtctcctgccgctcttcccggccgggcgaaatggacggtgtcgttgtcaggagggtcatcccttcggataacagttgcctcttcaacgctgtgggctacgtgatggagcacaaccgaaataaggcttctgagctcagacaggtcatancancaacagtcgctggtgatcctgagaaattccatgaagtggggcgtggggaaccaaatgaaccgtattgtccttggattttggatcctgaaaagtggggaggagcctttgagctctcttttctatctgaatactacgggcgtgaaatcccaccatatgactttcagaccccccgctgtgatccccatggggcaggaaaaaaatttaccgggaaggggccaggctcctttttgaagggtttgcattatgaagccctcccgcaggctcccgggtgaaaggggcccctgaaaaattttgaccaaacaattcttccccgtttaatcaggacccgttcccttggggccgagaaaaggcctctgccctccacttaagggggggggggcgccaagagaaaaagactttcccn

SEQ ID NO: 68345 - protein, 130 aa, Zea mays
  misc_feature: Ceres CLONE 1544509
  misc_feature (11)..(122): Pfam Name: OTU Pfam Description: OTU-like cysteine protease
  misc_feature (40)..(40): Xaa is any aa, unknown, or other
  misc_feature (41)..(41): Xaa is any aa, unknown, or other
MDGVVVRRVIPSDNSCLFNAVGYVMEHNRNKASELRQVIXXTVAGDPEKFHEVGRGEPNEPYCPWILDPEKWGGAFELSFLSEYYGREIPPYDFQTPRCDPHGAGKKFTGKGPGSFLKGLHYEALPQAPG

SEQ ID NO: 68346 - DNA, 738 bp, Zea mays
  misc_feature: Ceres CLONE 1544514
  misc_feature: Encodes the peptide sequence at SEQ ID NO. 68347
ggagctccccgcggtggcggccgctctagaactagtggatcccccgggctgcaggaattcgtctcacccctagaaaaaagagcgaacagagcaagcagagcgagcgagctgtccggccaaaccctcacggccgcctccacaatgccgcgccatctcgcgctgctcctgcccctgctcctgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggaggccggccggtggttggcgtggggcctgaacccgacgggcgagggcatggccggctcgcaagcgctggtggcgctggcggaggccggggccgcggcgcccgccttgcggacatacaaaatcacgtggtacttcccgctgggaaaagcctccacaccgctggacttcccggggaccgacctcgccgcggacgcctccgtgaagcattatccgtggagtactggaaaacttttaacttgcaaaaaagggaataaaagccctagatatcatttgttggcaagttcgacacgtaccttcaaggggcgtgctcctcccaaacaatcaacccgtttccaaagctgaaccaacctccattcgccaaaaagctaatcatccttaccccgc

SEQ ID NO: 68347 - protein, 184 aa, Zea mays
  misc_feature: Ceres CLONE 1544514
MPRHLALLLPLLLLASPAATRLASAACAGEKFPAGRAYASCEDLPKLGASLHWTYDASKSSLSVAFVAAPAEAGRWLAWGLNPTGEGMAGSQALVALAEAGAAAPALRTYKITWYFPLGKASTPLDFPGTDLAADASVKHYPWSTGKLLTCKKGNKSPRYHLLASSTRTFKGRAPPKQSTRFQS

SEQ ID NO: 68348 - DNA, 738 bp, Zea mays
  misc_feature: Ceres CLONE 1544516
  misc_feature: Encodes the peptide sequence at SEQ ID NO. 68349
  misc_feature (393)..(393): n is a, c, t, g, unknown, or other
  misc_feature (400)..(400): n is a, c, t, g, unknown, or other
  misc_feature (405)..(405): n is a, c, t, g, unknown, or other
  misc_feature (406)..(406): n is a, c, t, g, unknown, or other
accgctggagctccccgcggtggcggccgctctagaactagtggatcccccgggctgcaggaattcgtctcacccctagaaaaaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttggatggagagggatttcctggccgcgatcggcaaggagcaccacccccccgccaaggaggaggcaggcgcggaggaatctgcttacttccccccacaggaggggggggggagccccngcaatgnactgnnccctccctaacaagcccggcgccacaccggcgttgatggcgttccgggcggctttcttccccccggtctcctccttccagggggcgccagacccgggcccctcggatccccgggccccgaagggcggtcggcccccaaaggcacggacgtacgccgccgcggcccggaaggaggatgggcctgaacggggcctaaaatccctccgggcctcggcgccctttcacccgaaacagtccgaaggttcaggggttccagatctccctctaacccttcgaaagaggaactgcggtttcaacaacgccccccttttcccgccaaaaataaacgctgcc

SEQ ID NO: 68349 - protein, 99 aa, Zea mays
  misc_feature: Ceres CLONE 1544516
MAFRAAFFPPVSSFQGAPDPGPSDPRAPKGGRPPKARTYAAAARKEDGPERGLKSLRASAPFHPKQSEGSGVPDLPLTLRKRNCGFNNAPLFPPKINAA

SEQ ID NO: 68350 - DNA, 709 bp, Zea mays
  misc_feature: Ceres CLONE 1544518
  misc_feature: Encodes the peptide sequence at SEQ ID NO. 68351
  misc_feature (381)..(381): n is a, c, t, g, unknown, or other
tccccgcggtggcggccgctctagaactagtggatcccccgggctgcaggaattcgtctcacccctagaaaaaaaggagacggtactagtaaactgactaactgctgcccactcgccggagaaccatggccacggcggcggcgtgtgtgcgggtggcgtctccgttcacgggcccacctatctggcatcccagacacgtcatctcaacgaggcggggacccaggagggccgggctggccgtcacggcggcggctgccgccggtggatcgccgcgcactgtgctcgtcaccggcgcgggcggccgaacaggctcaattgtgtacaagaagtttgaaggagaaggaaggacattttgcgggacgtggccgagggcgggacggnaaaaaaccaaaggcaaatttggaggcggggacaaactgttttttcgccaacttccaaaaaccccaaaaacctttctctcctgcaattcaagggcttttaacccgctttattaatccttaacaaaggggggttccaaaaaaaaaaaccgcgggtttttaaccccaacaaaaggggggcgcccctttaatttttatcttttaaaaaaggggggtttctccctgagcagggggggtttgaatttgccccaaaaaaaccaatttgtgctctcccaaaaaacattttgtacaaaaactaaattttttgggggggacccctggggagaaaacag

SEQ ID NO: 68351 - protein, 122 aa, Zea mays
  misc_feature: Ceres CLONE 1544518
  misc_feature (86)..(86): Xaa is any aa, unknown, or other
MATAAACVRVASPFTGPPIWHPRHVISTRRGPRRAGLAVTAAAAAGGSPRTVLVTGAGGRTGSIVYKKFEGEGRTFCGTWPRAGRXKTKGKFGGGDKLFFRQLPKTPKTFLSCNSRAFNPLY

SEQ ID NO: 68352 - DNA, 703 bp, Zea mays
  misc_feature: Ceres CLONE 1544522
  misc_feature: Encodes the peptide sequence at SEQ ID NO. 68353
  misc_feature (703)..(703): n is a, c, t, g, unknown, or other
ccccgcggtggcggccgctctagaactagtggatcccccgggctgcaggaattcgtctcacccctagaaaaactttcctacggtttcgtcgcttccagccgccgccgggtccgcctcgccaagtgcagcagccgccgcagcacatcgctctcttgatctcagccatggaggatgtggatcatctacatgacacgccgaagctcttctgccgctggaccttccatgatgtccaggtgaacgacatctctctgaacgactacctcgctgtgaacgctactaaacacgcgatgtacctgccgcacaccgcggggcgctactcctagaagcggttccacaaggcgcactgcccgatcgctgagcgccttacaaactccctcatgatgcacgggcgcgacaacggcaataatgtcatggctgtccacatcatccagaataccctggagatcattcacctgctcaccgatgacaaccccatccatgtcgtcgtccacgcgatcatcaactgtggcccccgtgaggatgccacccgtattggttccgctggagttgtgagaaggcaggccatggatatctcacccctgatgagggtgaaccatgccatctacctcctcaccactggtgccgaggagagtgctttccggatcatcaaaaccattgccgagtgccatgcagatgagatgatccacgctgctcagggctcatn

SEQ ID NO: 68353 - protein, 108 aa, Zea mays
  misc_feature: Ceres CLONE 1544522
  misc_feature (1)..(106): Pfam Name: Ribosomal_S7 Pfam Description: Ribosomal protein S7p/S5e
MMHGRDNGNNVMAVHIIQNTLEIIHLLTDDNPIHVVVHAIINCGPREDATRIGSAGVVRRQAMDISPLMRVNHAIYLLTTGAEESAFRIIKTIAECHADEMIHAAQGS

SEQ ID NO: 68354 - DNA, 749 bp, Zea mays
  misc_feature: Ceres CLONE 1544533
  misc_feature (51)..(51): n is a, c, t, g, unknown, or other
  misc_feature (749)..(749): n is a, c, t, g, unknown, or other
tttctggagctccccgcggtggcggccgctctagaactagtggatcccccngggcttgcaggaattcgtctcacccctagaaaaagtctccgttccttggtcttccgctctctcactctttctgcccgcgacgaaggtcggatagccgtcgcccagcgctggacttggcgccttgcgtgcgcccatctgccgccgatggtgcgcactcacctgctacccgaggcttggcggcggccactgcccccggagggtggagcgtgacactcgtgtccgcgcattttccttcaccgagacgggctgggatccgggatcccggtggcctgtttccgttcggctgccctgagcttacagggttgtttttcccccccacccgggggggggggggggggcccagaaacaaaaaaccccttcccccccccccttttagcactcccggcttgttttctggggggggcgccgaaagcaccccccggctgtatgccttatggcccctcttgttaacctggggggtggtacgttccgggccccacctgggaaagtaactcccgtttcgaaacccctgccgcaccttcgctctttgttctccaccgtcctctttgcggttttcctgcggccgcgtggcgccctctctcctctgatctcctcccgtggttataacctttcctccctctttgttggcgccccgggcggattctctttattgtgtgctgctgattctgctccccttctctggtgccgttttgccattn

SEQ ID NO: 68355 - DNA, 713 bp, Zea mays
  misc_feature: Ceres CLONE 1544538
  misc_feature: Encodes the peptide sequence at SEQ ID NO. 68356
  misc_feature (640)..(640): n is a, c, t, g, unknown, or other
ggagctccccgcggtggcggccgctctagaactagtggatcccccgggctgcaggaattcgtctcacccctagaaaaagcgggccagagtcgcgcgactggagtaccgcggcggcgaaccaaagcgaaggcggcgaacggaaagccgcctggcgactccagatctctccggcctgctcctcggctcctcgctcctcctgcgccgccgcggaggcagatacacactctggatcaagccccgctgcatctcagctgtggcttcctgcaggctggggactttggctgcttcctgcaggctggaggagtttctgaatggccaatcccaggcatgcggtggacgtcagctcctccatgtcggagctgaccgtagaagcagcgccttcatcgattgaggcccaagtcccccagcaggctaatggcggcgttgttgctgctgccgaactcgatgatgtatgggaggatgtttcaggttctcctcatcacgcggataccttatacagagaatggatccacatgcagagtcagtttcagaagatgggatatcgtgatggtgtaacagaagggcagaaggactctgcccaggaaggcttcaatgtagggttcacgcaatctgtaaacgttggctacaaatggggccttgntcgtgaggttggcagtgcgctagctagtcttcctgacggcttgaaatgaaaactggtgccggatgttcagcat

SEQ ID NO: 68356 - protein, 125 aa, Zea mays
  misc_feature: Ceres CLONE 1544538
  misc_feature (110)..(110): Xaa is any aa, unknown, or other
MANPRHAVDVSSSMSELTVEAAPSSIEAQVPQQANGGVVAAAELDDVWEDVSGSPHHADTLYREWIHMQSQFQKMGYRDGVTEGQKDSAQEGFNVGFTQSVNVGYKWGLXREVGSALASLPDGLK

SEQ ID NO: 68357 - DNA, 697 bp, Zea mays
  misc_feature: Ceres CLONE 1544541
  misc_feature: Encodes the peptide sequence at SEQ ID NO. 68358
ggagctccccgcggtggcggccgctctagaactagtggatcccccgggctgcaggaattcgtctcacccctagaaaaaatcggcctctcgattccatcgcccctgttccctctcccttccgtcggacttcaaaccctagcggcgatggcgtccgcggcggcgggcacaccgaagcgctgctactacgaggtcctgggcctatctcgcgactgctccccgacggacatcaagcttgctttccgccgcctcgcgctctcgctccaccccgacaagcagccccccggctccgacctcgccgccgccaccgccgccttccaggagctccagcatgcccactctgtcctctctgacccgcaggagcgtgcctactacgactcccaccgctcccagatcctcttctctgacccagcctccgccggcgccaaatccgcttccatcgtccccgatcttttcgccttcttctcttcgaccgctttctccggcttctccgacacgggccgcggcttctacaaggtctacggggacgtcttcgacaaggtattcgcgcaggagcttgcctatgctcgccggatgggggttcccgaccccgctgcgccaccggtcattgggaacctcgattccccctatgcgcaggtcactgctttctacagttattggcttgggtttggctcggtcatggatttcggatgggcggctg

SEQ ID NO: 68358 - protein, 184 aa, Zea mays
  misc_feature: Ceres CLONE 1544541
  misc_feature (12)..(77): Pfam Name: DnaJ Pfam Description: DnaJ domain
MASAAAGTPKRCYYEVLGLSRDCSPTDIKLAFRRLALSLHPDKQPPGSDLAAATAAFQELQHAHSVLSDPQERAYYDSHRSQILFSDPASAGAKSASIVPDLFAFFSSTAFSGFSDTGRGFYKVYGDVFDKVFAQELAYARRMGVPDPAAPPVIGNLDSPYAQVTAFYSYWLGFGSVMDFGWAA

SEQ ID NO: 68359 - DNA, 694 bp, Zea mays
  misc_feature: Ceres CLONE 1544544
ggagctccccgcggtggcggccgctctagaactagtggatcccccgggctgcaggaattcgtctcacccctagaaaaaagtccatcgccattacatcctcgactacctgtacatcagctgctcctgcgattgcgcactgacggaaaaaggataccgtggccgacctaagaacacgacgtgtctcatctccccgactcaaccatactcattgggcgtgcctggcatgcgcgccgtgccggagggcgagcggcatcctcctcctccgtcgaccttgcacatccagccgagacccctaccttttcgttcgcatctccgacgagcagaaactggacacgccaatggtcaccaagagcctccctgcgcagtggaaccaagaactccactctcatctattgaacaccctggacttcctattagactgcaactcttcgactaggtacactttcattgatgactggtgggtaacgcggaggtggacatcctcccgttcgtcgatactgtgtgcatcacgctcccatgagtcgctgacacatcgctggcacacaatctggtgcccaccacagataactgcctagccgaggagagcttcatatacgtatcgatacgcgaacgtgaaacacgacttaagctcaccgctaaggacactatagtcgcggtaaatccagctccgaattcactgtgtcacccatcctgg

SEQ ID NO: 68360 - DNA, 741 bp, Zea mays
  misc_feature: Ceres CLONE 1544547
  misc_feature: Encodes the peptide sequence at SEQ ID NO. 68361
  misc_feature (29)..(29): n is a, c, t, g, unknown, or other
  misc_feature (53)..(53): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (71)..(71): n is a, c, t, g, unknown, or other
  misc_feature (93)..(93): n is a, c, t, g, unknown, or other
  misc_feature (311)..(311): n is a, c, t, g, unknown, or other
  misc_feature (314)..(314): n is a, c, t, g, unknown, or other
  misc_feature (741)..(741): n is a, c, t, g, unknown, or other
gtgaaaagtgattgggttttaagctctanatattttttaaatattagattatntttttttnnnnnntntcncaaaattggaactccccgcggntggcggccgctctagaactagtggatcccccgggctgcaggaattcgtctcacccctagaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggncgncacgcggaacacaccggcgtccctcgtgttgggcaacggcccctcgggggggccggcgcgggggcccaattgcgcggccaatgtccatggcctcccttcaaacccgcccttaaaaactggagtcccttcccgggttcacccccttaaaaggaagccccttctgggccccccgcgaaaaaacccccccccccccctttggggcggaaatttgttaccctttgccccaaaaacccaaaattgtttatttttgggggggccccgcccccccccggggggttttctcgggggggaataaaaaattcccccaagagaccccccccggggggaccccccccccctctggaaaaaaaaaatgtttttccccccgccgggggggcccttgatttttgaggggaaaaatttttcttcctcccccgggggggggcan

SEQ ID NO: 68361 - protein, 119 aa, Zea mays
  misc_feature: Ceres CLONE 1544547
  misc_feature (21)..(21): Xaa is any aa, unknown, or other
  misc_feature (22)..(22): Xaa is any aa, unknown, or other
MATAAASSLLKSSFAGSRLPXXTRNTPASLVLGNGPSGGPARGPNCAANVHGLPSNPPLKTGVPSRVHPLKRKPLLGPPRKNPPPPLWGGNLLPFAPKTQNCLFLGGPRPPPGGFLGGE

SEQ ID NO: 68362 - DNA, 697 bp, Zea mays
  misc_feature: Ceres CLONE 1544550
  misc_feature: Encodes the peptide sequence at SEQ ID NO. 68363
  misc_feature (396)..(396): n is a, c, t, g, unknown, or other
  misc_feature (660)..(660): n is a, c, t, g, unknown, or other
  misc_feature (665)..(665): n is a, c, t, g, unknown, or other
tccccgcggtggcggccgctctagaactagtggatcccccgggctgcaggaattcgtctcacccctagaaaaagtgctatccccgcccattcgtcaccagccaggtcccggaaccttatcaccaagtcctcgcgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcttcggagtacgggaccgatggcgcggagcagcaagaccgggagttctccgaggaccacacgctgttcctcagtaacctgccgttcancgaccacagtgcgcagctggccgggctcttcgagcacgcggactccgtcgagatggtcgaggttgtatacgatagaatgactggtcggagccgtggatttggattcgtgactatgtcttcagctgacgaagccggggctgctgtcgagcattacacggctatacatttctaggaagacctctgagggtgaactgcgggccacccgctactagagatggatccgcaccaagagcacctacggctggtggtggtgggcgtgctggnctcanctttgtctaatcagggatcaagtatacgtggg

SEQ ID NO: 68363 - protein, 143 aa, Zea mays
  misc_feature: Ceres CLONE 1544550
  misc_feature (79)..(143): Pfam Name: RRM_1 Pfam Description: RNA recognition motif. (a.k.a. RRM, RBD, or RNP domain)
  misc_feature (87)..(87): Xaa is any aa, unknown, or other
MAAALFSTSLSPRFLALSSPKPAAPAASAFLPFTLPLRSVSAPAPARRVFEPVAVAVSSEYGTDGAEQQDREFSEDHTLFLSNLPFXDHSAQLAGLFEHADSVEMVEVVYDRMTGRSRGFGFVTMSSADEAGAAVEHYTAIHF

SEQ ID NO: 68364 - DNA, 706 bp, Zea mays
  misc_feature: Ceres CLONE 1544551
  misc_feature: Encodes the peptide sequence at SEQ ID NO. 68365
  misc_feature (706)..(706): n is a, c, t, g, unknown, or other
gcggtggcggccgctctagaactagtggatcccccgggctgcaggaattcgtctcacccctagaaaaaacctccaccacctgccgcgccggccggcgagcctcttcctcttcctccggtcgctccccttcccatctccatcttgatttcgattctctggtggctgggaaagcctgcgagagcgcgataaccggaaagatctgagctgctgcaaccgatctccggcgccatggggttcctcgaggacttccaagccagtgttgaagcattgccatctatgctgcatcggaactattcattaatgcgagagttggataaaagtttgcatggtgtgcaactagaaaatgagcagcgctgtcaacaagaaatagaggacattaagcatggacttgaatctggaagtattacatatgacccagcaaaattgaaattttccgaagaagcaatggaggagcagaaacattgtgttagaattgctgacgagaaggtggctttagccactcagacttatgacttagttctgctgcataatcatggctcatgacgcctctgcactgttgctaaattgtgaatgtgcgggattttgattatgctgatctataggttgatgctcacatccaacagctagatcagtttatgaggaagcttgaagacatccggcaaggaaaagaggcagctgctgctgttactgcagggactgctgttgn

SEQ ID NO: 68365 - protein, 104 aa, Zea mays
  misc_feature: Ceres CLONE 1544551
MGFLEDFQASVEALPSMLHRNYSLMRELDKSLHGVQLENEQRCQQEIEDIKHGLESGSITYDPAKLKFSEEAMEEQKHCVRIADEKVALATQTYDLVLLHNHGS

SEQ ID NO: 68366 - DNA, 728 bp, Zea mays
  misc_feature: Ceres CLONE 1544561
  misc_feature: Encodes the peptide sequence at SEQ ID NO. 68367
acagctggagctccccgcggtggcggccgctctagaactagtggatcccccgggctgcaggaattcgtctcacccctagaaaaaaccatcgccattcacctccagccaggctccggaaacttatcgccaaatcctcgtcccctactccccgccaacgttccatatggcttcctgcaggatggcactcccccttggcttgttgttgctataacaaccttcacccgcgatgcgtgatgagaactccggtatctcctaccaggtggctcttatggggccagaaccatactggcgacagaccacttctgggtgctgcaagccgaccactggtgtcactccgagacgcgatttctacataacgagtttcaccatccttaagaggacctccgagactagctgagacggatcgcccaccaaatttccttaccacccaaacctgattaccggcatccaaggcctaaatcagcactgcagcaccatagggcgccccagcaaaagagggaataactgctggaagaccaccagtaaaaatgccgacccttgcttcggcctaagaaaaagagactacttctaaactgccctctccttctgtaaccggatcaacacactcgttcgcctcaaggccaaagggttccaaccggaatttaatgcctctccggactcacggggattcccagggtggttcaagaaggggattccttcgacccccggggatccaaggggcaaagggg

SEQ ID NO: 68367 - protein, 56 aa, Zea mays
  misc_feature: Ceres CLONE 1544561
MRDENSGISYQVALMGPEPYWRQTTSGCCKPTTGVTPRRDFYITSFTILKRTSETS

SEQ ID NO: 68368 - DNA, 727 bp, Zea mays
  misc_feature: Ceres CLONE 1544565
  misc_feature: Encodes the peptide sequence at SEQ ID NO. 68369
cagagctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcatcagagtacgggaccgagggcgcggagcaccacgacggggagttctccgaggacctcaagctgttcgtcggtaacctgccgatcaccgcccacagtgcgcagctggccgggctcttcgagcaagcgggctccgtcgagatggtcgaggttgtatactatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggctgctggtggtggcggcggctgcagcatctttgtcgattcagggaacaaggtatacgtggggaatcttgcatgggg

SEQ ID NO: 68369 - protein, 193 aa, Zea mays
  misc_feature: Ceres CLONE 1544565
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAALFSTSLSPRFLALSSPKPAAPAASAFLPFTLPLRSVSAPAPARRVFEPVAVAVSSEYGTEGAEHHDGEFSEDLKLFVGNLPITAHSAQLAGLFEQAGSVEMVEVVYYRMTGRSRGFGFVTMSSAEEAGAAVEQFNGYTFQGRPLRVNCGPPPPRDGSAPRAPRGCWWWRRLQHLCRFREQGIRGESCMG

SEQ ID NO: 68370 - DNA, 679 bp, Zea mays
  misc_feature: Ceres CLONE 1544568
  misc_feature (328)..(328): n is a, c, t, g, unknown, or other
  misc_feature (407)..(407): n is a, c, t, g, unknown, or other
cgcggtggcggccgctctagaatagtggatcccccgggctgcaggaattcgtctcacccctagaaaaaaccccggctttgccttggtgaagaaaagtcgctgcgttcctcttgcctgatgaaatcctcttcccgtctagatctgagcctccgcgtggcttccggatcagatggttggtccgatcgaacaacggtgagtcttgctctgttacttgattgttcgaaacgcatggttttgttttgtgatgatgtgcaggttccgatctgtttcgtttgattgatgagttgacgacgcatcggctcgaagcgagacgaggctgcatggtttnttgtgcctggaggttttcctgatcccgccgggggtttaaaggaaaacttgggggtctcccaaccaatttttgggggggnccacggggccccacccctccaaattttttttcccccccccctaggttgggggcctccccggggttcttttttttttgcactataaaaattttgagccgcccccccccccctcccccccccgtatcccctctctttttcttttccttcttccccgtcatctcgaccagaccactcgggggcacgggccacaccgtcaggaactgatcgtgtccaaccatggacgaatttcttcggacactcttatacctggagctggagcactctgcctcatg

SEQ ID NO: 68371 - DNA, 692 bp, Zea mays
  misc_feature: Ceres CLONE 1544569
  misc_feature: Encodes the peptide sequence at SEQ ID NO. 68372
tggagctccccgcggtggcggccgctctagaactagtggatcccccgggctgcaggaattcgtctcacccctagaaaaaaccaccaccgctgcacacacaaaccaaccacaggcaataaacactagacagctcccactcccagtaaatttctcgtctcccaatctccgattcgaggaagccggaggaggggatttcgagccgcggcatcgggacattagagtggccctcacccggcgctggaattgccgagagggactgggttggagtggagttcgggaggtgtgagagaaggcggcgatggggcggttgttcctgatgcacctggacggcaacgtctacagctgcaagcactgcaggacccagctcggcgttgccagcgacatcatctccaaggccttccactgcaggcacgggaaggcgtacctcttccataaggttgccaatgtgacttctggagtaaaagaagatcgcatgatgatgacaggaatgcatactgtttctgatatcttctgtgttggctgtggatccatcgttggatggaaatatgatgctgctcatgataagagccagagatacacggtatgaaagcttattctggagaggtacaaggtggtcgggccctgacctgaacccaaacctgaatcccccgaatcctccccttgggtgaaaccgaccccaaaaaaaattaaaa

SEQ ID NO: 68372 - protein, 95 aa, Zea mays
  misc_feature: Ceres CLONE 1544569
  misc_feature (1)..(96): Pfam Name: Yippee Pfam Description: Yippee putative zinc-binding protein
MGRLFLMHLDGNVYSCKHCRTQLGVASDIISKAFHCRHGKAYLFHKVANVTSGVKEDRMMMTGMHTVSDIFCVGCGSIVGWKYDAAHDKSQRYTV

SEQ ID NO: 68373 - DNA, 713 bp, Zea mays
  misc_feature: Ceres CLONE 1544570
  misc_feature: Encodes the peptide sequence at SEQ ID NO. 68374
aagctggagctccccgcggtggcggccgctctacaactagtggatcccccgggctgcaggaattcgtctcacccctagaaaaaacgactgcctttctctccccagctgagccataccttgctttgagttagctacctgctactagtgttggcctcttcctattccattatgcgtcgtcgcggagatccgcactaatgtgcactcacgcctctcctcttctgaggtctcctcctcctgctcttcctccttcctcgtcggcaatacgctgatgagaaatgccaatgcaccccggcctcctttcgtcccgggagtcccggcccattccgaccgacccatgtgggtcgccggcaccaccactccgacgtggctcgacagcactcttcccggtaacttcggctttgatccctggggccgcggatctgacccggtacaccagcggtggaacgtgcaagaccacctggtgcactgccggaggaccatgctccgcccgcctagtatcttcatcccggagttcctgaccaagatcggcgtcctcaacacgcccttctggtacaccgcctgtgaggagcagtacttcagcaacattaccacccgtctcatcatcaagatcatactcatccgctggtccgagggccgccgttgggctgacatcatcaagcccgaaaagctcgacaacgatcccatcttccccagaaagagctcaccggaacgga

SEQ ID NO: 68374 - protein, 126 aa, Zea mays
  misc_feature: Ceres CLONE 1544570
  misc_feature (7)..(122): Pfam Name: Chloroa_b-bind Pfam Description: Chlorophyll A-B binding protein
MWVAGTTTPTWLDSTLPGNFGFDPWGRGSDPVHQRWNVQDHLVHCRRTMLRPPSIFIPEFLTKIGVLNTPFWYTACEEQYFSNITTRLIIKIILIRWSEGRRWADIIKPEKLDNDPIFPRKSSPER

SEQ ID NO: 68375 - DNA, 778 bp, Zea mays
  misc_feature: Ceres CLONE 1544571
  misc_feature: Encodes the peptide sequence at SEQ ID NO. 68376
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ttgcgcttggggtgggccgtagatgtgcnnnnnccnnnnnnnncaaagctggagctccccgcggtggcggccgctctataataaaggatagcatgccccgggcggcatgaattcgtctcacccctagaaaaaacggaggtacaggagcgagggggaaagtgggatggtagtgggggcatcatcggtgtccggcgccgcggcttccggaggtacctctggtacggctccgccgcggagaggggagagtcgtgcaagggctgccttcactactcgtcagtgctcagagtcccgcggctacaacccaatctgcgttgggatcccccgttccatcccccaagttcctaactacctggtggatgagcctaaagaggacgcgacagcgcaggggcatgatctcaggcggttcaggtacgggtgcgcgggttactccatattcgtgagacgggacggccaacgtggtgagggcgagggcaagacgttgttgccgtattgcaggggcctcgagttattggtggacagcacagtggtcgagaggaaaccatccgcggctgagcaaggctccagcccatgttaaagaaggaagcagcttaacacccgcttctccccaagaaggaaaaacgaaaacccggcgagaaatttgttaagaggaggaaatttctttggggggaggttttaaaaaaaaaagaggccgaagacagggttcccccatttgcggggggcccgctggaataaaaatttcggtggaagagagcccgctcggttatttttttattgggag

SEQ ID NO: 68376 - protein, 136 aa, Zea mays
  misc_feature: Ceres CLONE 1544571
MVVGASSVSGAAASGGTSGTAPPRRGESRARAAFTTRQCSESRGYNPICVGIPRSIPQVPNYLVDEPKEDATAQGHDLRRFRYGCAGYSIFVRRDGQRGEGEGKTLLPYCRGLELLVDSTVVERKPSAAEQGSSPC

SEQ ID NO: 68377 - DNA, 739 bp, Zea mays
  misc_feature: Ceres CLONE 1544580
  misc_feature: SWISSPROT Homolog: EC 1.1.1.37 Malate dehydrogenase
aaagctggagctccccgcggtggcggccgctctagaactagtggatccccccgggctgcaggaattcgtctcacccctagaaaaaattttctagcactacacggcaccttccttgctcacctacacctacgtactgacgacatccccatggcctccctctcctctgacctgctccatccctcttcctctcaccctccaatgccagatcgctccccgtcttcagagagatactacttgtcaccgcagcacgcctctctccacaacttcacagtgccaccatccttcgtgccactggctgccattgcccatgcctcttccgctattgcattgaacacaaaacctcctgcttcgctgctccaactatacgatctcctccacagcccctgctgttccaccccacatccgccaactcaatcctgttgctgagctacgtcggcttcttgcaccacccccacttcgacaatgaccaggctgcaatggatctcgacacaactcctacctctgtccatcagaaacccgacgatgacaagggataacttctccaacatccacgctgtaacagtcaccaacctgtgctaatgaaatgcacaatgctgacccagagcgattgtgaatatcatcagcaatcctgtcaactctacctcccccaatgccgcttcatgtatcaacagatccttcacttattaccctccgccgatctgaccagcaccactcttgacgtcgtcaagcaaatagttta

SEQ ID NO: 68378 - DNA, 715 bp, Zea mays
  misc_feature: Ceres CLONE 1544588
  misc_feature: Encodes the peptide sequence at SEQ ID NO. 68379
  misc_feature (659)..(659): n is a, c, t, g, unknown, or other
cgcggtggcggccgctctagaactagtggatcccccgggctgcaggaattcgtctcacccctagaaaaagcgttggtttgactgagtacacaacgatggcggtccatcctccattccgcttaagcacaaaacctcagaggccgagagacgtgcatttcaggacgctcaccgtgctgctaaagcggccacaaaggaggctgataaatcaggaaaatctgctggtgctgctatctcctagcatgccaagcccgtaaatactgttcagaataaagatgtgccccaagctgctagtacggttgtttctgagaagaagctactgaacgtcctccaaaaagagaaagaaagttagatgctcctcatccccgcatgcactttgatgatgtgcataaggtggagaaagcgcacaacacgtgcggtagtcaaccaatcataagctcgaaatagagttgaactgttcaggcatcttcctcagtaatcgcatggcactcagcttcctgacctcgaatcagaattctttcaactagaaccgatgcatccttctgtatacgaggaaactgttgtgtttttcactgaccctgacatttatgtactatctgggatctcgatcagcattgctgagtgatccattcttcaccacataagatcttccttgccttggnagtatgcctaaaatgttaggcaagtttgccacattgcagcacgtgggggtaatcct

SEQ ID NO: 68379 - protein, 52 aa, Zea mays
  misc_feature: Ceres CLONE 1544588
MAVHPPFRLSTKPQRPRDVHFRTLTVLLKRPQRRLINQENLLVLLSPSMPSP

SEQ ID NO: 68380 - DNA, 638 bp, Zea mays
  misc_feature: Ceres CLONE 1544592
  misc_feature: Translation starting site: 127
tccccgcggtggcggccgctctagaactagtggatcccccgggctgcaggaattcgtctcacccctagaaaaagaagtggtctatataaaaggtcagaaccgaaaccttaaccttattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccagttgcaaacctccttcagtgagccacgcccttcttatcctgactgacccgaggactgatcatcagcccattaaggagtctgcgcttggaaacaatcccaacatcgccttctgtgaaaccgattcccccaggccctaggttgaaatcgggattcccggccataaca

SEQ ID NO: 68381 - DNA, 694 bp, Zea mays
  misc_feature: Ceres CLONE 1544595
cgcggtggcggccgctctagaactagtggatcccccgggctgcaggaattcgtctcacccctagaaaaacccccgtcccgacccaccatactgatctatcaccactagtttccccatgcccgcccttcatctccagccctcaaatgtcgacgatgctccctacgtcaccacccccggcatccgtgagaacaatccatatctgatcgatttgtctgtcctctcagccaactccccacgcgattaccctcacacctctcgcgattgctgcagaatctctcacgaacacaatttcagaatcctgagcaagagtttctgtatattaaagcagctagattcctgccagaaaccctcatatggagctagcccctgtatgactggcttaaaaatgctaagggaacgtatcatgttagctacagaaaaagctgtgcaattcaagtatccgctgacaaggggctctttgccttggctaaaaatctgcaagttcatggcactaccaactacaggacggtgtttctactttgttacgaagaagctgataccaaactccttattgcaacgctttgtggatggtgatgaccaatttcggactatatgttccagttgataccgtcgattcctaaagtctcatggattgttcgacaaagtgttgacagcactccttgtctattacgataagctgttgacattacctatc

SEQ ID NO: 68382 - DNA, 572 bp, Zea mays
  misc_feature: Ceres CLONE 1544600
  misc_feature: Encodes the peptide sequence at SEQ ID NO. 68383
gcggtggcggccgctctagaactagtggatcccccgggctgcaggaattcgtctcacccctagaaaaaaccatagaccatcaatcacttctaacacttttcccgtctcccccttcctcgccgcctccactacagggctttgctcctcccaactctcgaaaccctacccacgcgatgagagatcgatcggtcgagcgcgaattccccagccgcgagcggggggatcggccgccgcccggggtgctgggtcccccgcgccgcgggccggcttacaagacgaagttgtgcgcgctgtggcagcgcggcgggctgttcccgcgacacatgcagcttcgcgcacggaacacccgaagtcccgccgggtccccgggaatccggaacctcggttccccccccccgggcccggggaaaaaaaaataagggggggacttttaaaaagttaaaaagggggccccccccaaaaagggtttccccgggggaaacccggggggcactcccccttttggggaaaaaaaaatttttccaaaaggggggattttttttttgcgggcccccccaaaaaaaaaaagaaag

SEQ ID NO: 68383 - protein, 81 aa, Zea mays
  misc_feature: Ceres CLONE 1544600
MRDRSVEREFPSRERGDRPPPGVLGPPRRGPAYKTKLCALWQRGGLFPRHMQLRARNTRSPAGSPGIRNLGSPPPGPGKKK

SEQ ID NO: 68384 - DNA, 678 bp, Zea mays
  misc_feature: Ceres CLONE 1544602
  misc_feature: Encodes the peptide sequence at SEQ ID NO. 68385
gcggtggcggccgctctagaactagtggatcccccgggctgcaggaattcgtctcacccctagaaaaaatttgctctggatccccgctgttggagtttcctcagcgcttctctaccgcgaggcctcgccgcgagcacgactggcacgagcgctgatgcccgcctcccccggtctacggcgggtgcggccagccaccgccgcccgagccgtacggtcgcacggccgtctacccggattcgtgaggacgacctccgccacactgagcgtatggcggggacggggacccctactgccatagagctctcgtctgacgacagccgccggcctactgctccgggggctggtgctgcagcgtcagccacgtcgttctctaggtctgcaactagaggtcttaatctggcgtcgagctgcatcggcactgctggcacctaacgcaggctccgcgtccgactgcaggcgcgaggagccgaccgacccaggagtggtggcggagcctgatacggccacaacacacgcccgcacatctgaggtggtggccggtgcccgcttgtgtcgtatcagacgtacaagatctactggaccgcctgtgcagcacctggtaaccctctcctcccgagtcggaccaggtttttcccgggggggcccggacccttgggaaaggcacccccttggcctccc

SEQ ID NO: 68385 - protein, 54 aa, Zea mays
  misc_feature: Ceres CLONE 1544602
MAGTGTPTAIELSSDDSRRPTAPGAGAAASATSFSRSATRGLNLASSCIGTAGT

SEQ ID NO: 68386 - DNA, 726 bp, Zea mays
  misc_feature: Ceres CLONE 1544605
  misc_feature: Translation starting site: 155
  misc_feature: SWISSPROT Homolog: EC 2.7.1.19 Phosphoribulokinase
  misc_feature (15)..(15): n is a, c, t, g, unknown, or other
ggcggccgctctagnctagtggatcccccgggctgcaggaattcgtctcacccctagaaaaaaaggcttggcttgctgggtgcaaacaaagggcggccccctaactagcataccttgagaaacagagactcatcatacatactcctacactgagatgaccatgcactgccgtactcaaactcaggtctgcaaacaaaaccgagtcttcattactctgcgcccccattcattactcgtgctgcggtcaggcaagctcggcattgtcaaggagcttccaggtctcgtgctccgtgcgaccactccccgtccgattgcccgtgaccccgacctgctccgcgacatcagcatcttcaagctcccgttcaccatcatcgtcaacggctacgcctacccggccgaggccgcgaacacggactccgacttctactcagcgacactacgacggtgatatgactcgaccactaccattcactgctccggaacgacaggaacgaaaaaggagagagcgccctcgatcataaggccgacaactttgatctcatgcatgaactagtgaccgcgatcaaggaatgacacgcacgctacaagcccatctaccaccatgacgctgttctcctcgaccctccggatcttatcgcgcttcaaagattttcgtcattgaaggtctgcgcccaatgttcgatgagcgagtgacggacctcttacatttcagtatctacttggata

SEQ ID NO: 68387 - DNA, 729 bp, Zea mays
  misc_feature: Ceres CLONE 1544609
  misc_feature: Encodes the peptide sequence at SEQ ID NO. 68388
ggcggccgctctagaactagtggatcccccgggctgcaggaattcgtctcacccctagaaaaaaaaaaacaacgtgctcgatctccctccgcgagtccatccatctcctcgctaccggtcgccgggaagatacgacgcatggtgtccgtcaccgcccgcgactcggtcgaggaccttcgcgcggcgtcggtatcgctcaattacacggcagtcttccttggccactctaagcacgtcgtccgcaccccgtaggccacgatgcacagcctcgaggcggaggccaagggctagtggctccgcgggcttccctccccctcctacctcgacggcagcctggcaggtgacaatggcttcgacccgttgggcctagggtaggaccccgagaacctgccgcggttcgtgcaggcggagctggtgaacggacggggcgccatagcttgatgtggccgggatgactcatccccgagtgcgcttgaccaaaggcgggctgatcaaacttgccgcaggggtacgacgccggatagtcagagtacttcgcggtctcgtccccgcatgggcgtgatacaattgatcctgttccacaacgtagaagaccccgacgctggttggacattcacaaacccctgcttcgttttcctgcgaaccccaactatcaaaaatttgaagacatgccggcggcactgagtggagcgcttacccggggagaacgttctatacatcccgggcccg

SEQ ID NO: 68388 - protein, 37 aa, Zea mays
  misc_feature: Ceres CLONE 1544609
MVSVTARDSVEDLRAASVSLNYTAVFLGHSKHVVRTP

SEQ ID NO: 68389 - DNA, 665 bp, Zea mays
  misc_feature: Ceres CLONE 1544610
  misc_feature (331)..(331): n is a, c, t, g, unknown, or other
  misc_feature (334)..(334): n is a, c, t, g, unknown, or other
  misc_feature (608)..(608): n is a, c, t, g, unknown, or other
  misc_feature (665)..(665): n is a, c, t, g, unknown, or other
gctctgaactgtggatcccccgggctgcaggaattcgtctcacccctagaaaaaactaccaccaggtaccacaccactccgcgctagctgaggacggtacagcggcacagaggtgcgacgtacgacgacgacgacgcaggcgccacacatggcatcccggttttccgccgccgtgccccggtttccaaggccttccgggggttaccccgggcccaaggtccccgggggggcaacccctttcccttcccttaagagggtgggggcaaggaaaaaaagattcttccccccccccaagggggggttatcctcccccttttggtgggtgtaaaanagngaattatgggtccccccccccccccccttgtttttttggggggtacaaaaaaaaaacaactcttttttttttttttttctttgggggggggtggtttttatgggttttttggttttttttttgatatattaaaaccccccctttttgaggggggcgataaaaagaagaggggggcccccccccccccccccccacacaaaaaaaaagagaaacccccccggcttttttttttttctcccacacacaaaaaaagagtgaggtgggtgggtggtgnttctacacaatataatataaaaataattcattattcttttgggcaggatgagttgtn

SEQ ID NO: 68390 - DNA, 740 bp, Zea mays
  misc_feature: Ceres CLONE 1544611
  misc_feature: Encodes the peptide sequence at SEQ ID NO. 68391
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (81)..(81): n is a, c, t, g, unknown, or other
  misc_feature (243)..(243): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
nnnttatcnnnnataattatagagctcaccgcggtggcggccgctctagaactagtggatcccccgggctgcaggaattcntctcacccctagaaaaattcagcatactcaaaatcccaattagcaacccttctgacgaacttgccaatggggctaagcttccttttgaggttatttttgtgtcgcataaggattctgcaagtaatccaacaatcgttgttcttcatggtggaccacactcantttatccactcagttattccaaatccttggcttttcttttttcgcaaggatataatcttcctggagagaactacaagggttcattaaggcttttttttaaaaacactgcaatccctccccggcatattttttttccccccccccgggggaagaaaggggggnnnnnnnnnnnnnnnnnnanannnnactaataaaaaaaaaaaaaaacccctactcggggggggggggggatttttcccgcccgccccttccattgggccggtctcccaaagatctgttgcaacaaaaacatctaaaacttattattgaacttctcctcgaatgcggacgacccccacaccctccgatttggtgtcctatcaccacattctatgcacaccacgaaacgtaatggtgttttctttcttttttcccgtcatattaccaaattagcatatatatttcaccctcacacagccaaagcttgacttgaagttagactagtcaaccacttaacg

SEQ ID NO: 68391 - protein, 133 aa, Zea mays
  misc_feature: Ceres CLONE 1544611
  misc_feature: SWISSPROT Homolog: EC 3.4.19.1 Acylaminoacyl-peptidase
  misc_feature (2)..(2): Xaa is any aa, unknown, or other
  misc_feature (3)..(3): Xaa is any aa, unknown, or other
  misc_feature (26)..(26): Xaa is any aa, unknown, or other
  misc_feature (80)..(80): Xaa is any aa, unknown, or other
IXXNYRAHRGGGRSRTSGSPGLQEFXSPLEKFSILKIPISNPSDELANGAKLPFEVIFVSHKDSASNPTIVVLHGGPHSXYPLSYSKSLAFLFSQGYNLPGENYKGSLRLFFKNTAIPPRHIFFPPPRGKKGG

SEQ ID NO: 68392 - DNA, 596 bp, Zea mays
  misc_feature: Ceres CLONE 1544612
  misc_feature: Translation starting site: 135
  misc_feature (275)..(275): n is a, c, t, g, unknown, or other
ggagctccccgcggtggcggccgctctagaactagtgggatcccccgggctgcaggaattcgtctcacccctagaaaaactcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatncttcgccccgcgccaagcagttacgcgaagagtaccacgccccaggagaaaggagcttgggccagcttcaggcctgaaggcccccggttgaagggtgtttcttgtgaccccaagccaaacttcggtttggggtccacccggggttaaggccggcccccaaaacccaaaaattggacccccgggttggggaaaatttccgggggttcccccgggggaaaaggggcccctttttttgtcccccggggggaccacttttgttgggggggacccccccccccaaaaaaatttgggggttttttccccaaaaaggggttggcgggg

SEQ ID NO: 68393 - DNA, 646 bp, Zea mays
  misc_feature: Ceres CLONE 1544613
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
ggagctccccgcggtggcggccgctctagaactagtggatcccccgggctgcaggaattcgntctcanncccctagaaaaagatcctaaggaaaagctcggccggtcgggcggtcggtcctcgggtggagccggtggaattcgactactaaactccgtcgcgtcattcctatgcgcctcccgtctggccgtcttccagacgtctccaatcggagctcccagcgtctcggggaagatgagcagcacggcacggcagctgtggcgaggaaggctcttgtcctgtcccatcccaacccagcagccgtccaaggaggaggagatcccatcgggcgtgcagggcggtcacccgtccattccattggatccaattttcaattcttggaggggccttttgggctccccgggttttttttttttttgggggaagagaggtttgggggaacccccccccatattcccctgcccccccccccggggagggggcccgccccaagggttttttttggggggggccccttctcctataaaaacccccccggcccaaaaaaagggggccttccctccaccaaaaaggggggggttttttttgggggggggggtaaaaaaaaagggggggtggggggggcctcttttaacaaaaaaaaaaa

SEQ ID NO: 68394 - DNA, 802 bp, Zea mays
  misc_feature: Ceres CLONE 1544619
  misc_feature: Encodes the peptide sequence at SEQ ID NO. 68395
  misc_feature (18)..(18): n is a, c, t, g, unknown, or other
  misc_feature (38)..(38): n is a, c, t, g, unknown, or other
gaggtgtgactgttaatngggttgtaggccattcaacnatgtcaaactggaactcaccgcggtggcggccgctcttttctagtggatcccccgggctgcaggaattcgtctcacccctagaaaaccttcatctgaaagatgaacacagcaagccattgtcttggaacaaccgtgtcaagattgcgcttggatctgcaagagcattagagtacctacatgagacttgttcaccctctgtggtccacaagaatttcaagtcatccacaattttattggatggtgagctgaccccccacctctctgattctgggtttgcaggccttcatgcaaatcaggaattacaggaatcagatgagaactcacgatacagggcacctgaggtgatcttggctggtcaatactccctgaagagcgacgtgtacagcttctgagtcgtaatgctagagcttccccaccccctgaaaccgattgacaggacccgaacgcggcctgaacaagtccctggtcccaagggctattcagcatctgcaccaaatttaacgcgctggaaccagatggactacctcgccgctgcaaaggctgtacccgtgacaaatccgtctcccgctttcgacgatgccttcgcctttttttgtttcactctgatccatgagtattccccagcctgttggacggaagctcgtagcagcccatcttggggcggtcccgagccatatgggtaaacctgtaacgaggtacatcccaaaagccctattcgtttgacctcatgagggcaatcccaatggggggacataattgtctt

SEQ ID NO: 68395 - protein, 142 aa, Zea mays
  misc_feature: Ceres CLONE 1544619
  misc_feature: SWISSPROT Homolog: EC 2.7.11.1 Non-specific serine/threonine protein kinase
  misc_feature (6)..(6): Xaa is any aa, unknown, or other
GVTVNXVVGHSTMSNWNSPRWRPLFSSGSPGLQEFVSPLENLHLKDEHSKPLSWNNRVKIALGSARALEYLHETCSPSVVHKNFKSSTILLDGELTPHLSDSGFAGLHANQELQESDENSRYRAPEVILAGQYSLKSDVYSF

SEQ ID NO: 68396 - DNA, 817 bp, Zea mays
  misc_feature: Ceres CLONE 1544621
  misc_feature: Encodes the peptide sequence at SEQ ID NO. 68397
  misc_feature (34)..(34): n is a, c, t, g, unknown, or other
  misc_feature (35)..(35): n is a, c, t, g, unknown, or other
gtggcattggtggttgggtggagagactataatnnccttgcatagctggactccccgcggtggcggccgctctagaactagtggatcccccgggctgcaggaattcgtctcacccctagaaaaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagtttagcggaggccgtctgggttcaaggccgggctcccagatcttcagcaagggcgggctggactacactcggcaaaccccagcctgatccacggcgcagagcaatcctcgcccatctggggccttggccaggccgtagctcaatgggtggcccgtccaaaggggcttacccgcattggcccggggggggccggcttcggggcaaaggccagttccaaacccgccttgtacacccttgggcgggaggaagtctatcctgaacaccccccttccgag

SEQ ID NO: 68397 - protein, 149 aa, Zea mays
  misc_feature: Ceres CLONE 1544621
  misc_feature (61)..(146): Pfam Name: Chloroa_b-bind Pfam Description: Chlorophyll A-B binding protein
  misc_feature: SWISSPROT Homolog: EC 2.7.11.1 Non-specific serine/threonine protein kinase
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFSGGRLGSRPGSQIFSKGGLDYTRQTPA

SEQ ID NO: 68398 - DNA, 708 bp, Zea mays
  misc_feature: Ceres CLONE 1544633
  misc_feature: Encodes the peptide sequence at SEQ ID NO. 68399
  misc_feature (653)..(653): n is a, c, t, g, unknown, or other
tccccgcggtggcggccgctctagaactagtggatcccccgggctgcaggaattcgtctcacccctagaaaaactgcccctccccctccgcctttcctctctctcgctctcctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaagtcacgttctccaagcgccgccgcggcctcttcaagaaggctgaggagctctccgtgctgtgcgatgccgacgtcacgctcatcgtcttctcctccacgggaaagctctcccagttcgccagctccagtatgaatgagatcattgacaagtacagcacacattctaaaaacctggggaaagcagaacagccttcacttgacttgaacttagaacatagcacatatgcaaatttgaatgagcaacttgtggaagcacgccttcgactcatgcagatgagacgtgaagaaactgagcgattgagtgttgaagaactccgccacggnagaagaatctggcatctggtctgcatacggtgcttcaaacaaagatcagcaatct

SEQ ID NO: 68399 - protein, 144 aa, Zea mays
  misc_feature: Ceres CLONE 1544633
  misc_feature (9)..(59): Pfam Name: SRF-TF Pfam Description: SRF-type transcription factor (DNA-binding and dimerisation domain)
MARERREIKRIESAAARQVTFSKRRRGLFKKAEELSVLCDADVTLIVFSSTGKLSQFASSSMNEIIDKYSTHSKNLGKAEQPSLDLNLEHSTYANLNEQLVEARLRLMQMRREETERLSVEELRHGRRIWHLVCIRCFKQRSAI

SEQ ID NO: 68400 - DNA, 878 bp, Zea mays
  misc_feature: Ceres CLONE 1544634
  misc_feature: Encodes the peptide sequence at SEQ ID NO. 68401
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
gagacgaggcgggggcagagttgagggcnnncgggannnnnataatactggagctcaccgcggtggcggccgctctataactagtggatcccccgggctgcaggaattcgtctcacccctagaaaaaaccacgcaaaaaacaaacacactcgaaggcagcgaagcccgagccttcccttccctccaatcgatcacccgctccgatccgctagctagctagcagcgcgatggcttccctcaccgtgtccacgaagaccgcggcggccggcggcaacaagcagcgcgagggcgcggaggtcatcacgggcgcggaggcctgcttcgcgcactccaagcagatgctccaggcgctgggcttcccgggcggcgtgatgccgctgcgggggctggaggagtgcggctgggtgcgcgagaccgggttcgtgtggatgcggcagaaggccccctacgaacactacttccgcgggcacgggcacgcggggtgccgctacaacccccgagagtcacccgcgtacgtggaaaggacgggccgggatagaagcggcatgaacccgggggtggcgcaaacaaagccaggggcggtgccctctggggtggccccattcggtactaagatgaagtccttcagacgtggggaacaaaggtccgaccggagagtcctagttaccaaagtccaaaatgatcagggaatcgaggccaggtgtgaaatccccgggccttccgggcgattcgtctggatagaggtaacgaagcccaaccccgcatgtaagggagggagtaagaaatcaacagatagaacggagtaaccaacggtagggagggagaaacgtgccggaaaaagccatagcctacgcactggcacttctgaaagaccgtcc

SEQ ID NO: 68401 - protein, 192 aa, Zea mays
  misc_feature: Ceres CLONE 1544634
MASLTVSTKTAAAGGNKQREGAEVITGAEACFAHSKQMLQALGFPGGVMPLRGLEECGWVRETGFVWMRQKAPYEHYFRGHGHAGCRYNPRESPAYVERTGRDRSGMNPGVAQTKPGAVPSGVAPFGTKMKSFRRGEQRSDRRVLVTKVQNDQGIEARCEIPGPSGRFVWIEVTKPNPACKGGSKKSTDRTE

SEQ ID NO: 68402 - DNA, 823 bp, Zea mays
  misc_feature: Ceres CLONE 1544636
  misc_feature (613)..(613): n is a, c, t, g, unknown, or other
  misc_feature (823)..(823): n is a, c, t, g, unknown, or other
aaagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtagcggcgagcgaaccgggagcagcccagcttgagaatcgggcggcctccccgcccgaattgtagtctggagaggcgtcctcagcgacggaccgggcccaagttctctggaaagggacgcctggaagggtgagagcccccgcccggcccggaccctgtcgcaccacgaagccccctccaacgagtcgggtttgtttttccaccccccccgcgggggggggggggggcctccttcccaagcttaaaaatttccccacaaaccgagtaggtgacggtgttcgcgcgcgggaacagatgaggggggtcgtttgaaaaaggggagggcagagagagtggctcaacaattgccctgctagagtgaagcgggagtggtgcgcctgagacgaggtcgcagacggcgcgggatgccgggagcgggacacgcgggctgggtcgggtaagatggncgtgtggggcgagagccccggcgcaatctccgcgcgtcggcgcgcgctcgagcgcccggacgggtgtcgataagtgaagcccgctggccggtgcgcgctcttcacctgctgtcgcgatctagggcgggcacgcccgtcgggtgctccctgcatcggcgatcacacagtggtcgaggcgtcgcggagcggtgtgagctgaacaaataggtn

SEQ ID NO: 68403 - DNA, 717 bp, Zea mays
  misc_feature: Ceres CLONE 1544638
  misc_feature: Encodes the peptide sequence at SEQ ID NO. 68404
ctccccgcggtggcggccgctctagaactagtggatcccccgggctgcaggaattcgtctcacccctagaaaaatggttgccgccactcgctccctgatggtctgatgagggccactgacgttatgatcgccggaaaggttgccgtggactgcggatactgtgatgtcggccagggttgtgctgctgccctcaagcaggctggtgcccgtgtcattgtgaccgagatcgaccccatctgtgccctccaggctctgatggaggatcttcaggtccttcccttggaggacgttgtctctgaagctgacatcttcgtgaccaccactggcaacaaggatatcatcattgttgaccacctgaggaagatgaagaacaatgccattgtctgcaacattggccactttgacaatgaaattgatatgctcggccttgagacctaccctggcgtcaagcgcatcaccatcaagccccagactgaccgctgggtgttcctcgagaccaacactggcatcattgtccttgctgacggtcgcctgatgaaccttgagtgtgctactgaccatcctagctctgtcatgtcgtgctcattcactaaccaagtcattgctcatcttgaactgtggaaggagaagagctctggcaagtatgagacgaaagtgtatgtgctccccaagcaccttgatgagaaagttgctgctctccacttgcgcaagcttgag

SEQ ID NO: 68404 - protein, 204 aa, Zea mays
  misc_feature: Ceres CLONE 1544638
  misc_feature (1)..(151): Pfam Name: AdoHcyase_NAD Pfam Description: S-adenosyl-L-homocysteine hydrolase, NAD binding domain
  misc_feature: SWISSPROT Homolog: EC 3.3.1.1 Adenosylhomocysteinase
MRATDVMIAGKVAVDCGYCDVGQGCAAALKQAGARVIVTEIDPICALQALMEDLQVLPLEDVVSEADIFVTTTGNKDIIIVDHLRKMKNNAIVCNIGHFDNEIDMLGLETYPGVKRITIKPQTDRWVFLETNTGIIVLADGRLMNLECATDHPSSVMSCSFTNQVIAHLELWKEKSSGKYETKVYVLPKHLDEKVAALHLRKLE

SEQ ID NO: 68405 - DNA, 719 bp, Zea mays
  misc_feature: Ceres CLONE 1544645
  misc_feature: Encodes the peptide sequence at SEQ ID NO. 68406
acccgcggtggcggccgctctataactagtggatcccccgggctgcaggaattcgtctcacccctagaaaaaagagagtcagccggcaggtgagacatcgcaggggaaccagctctcaagacggccgacggccggcttgcctacctgctcccatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcctggtgctgatgtttttctgctcgccttttctcttagccccaaagcaagctatgagaatgtctctaagaagtgggttcttgaattaaggcactatgctcctggcgtgcccagaatccttgctgggacaaaacttgatctgcgtgatgatgagcaattttttgtcgatcaccctggagctgttccaatttcccctgacccgggcaaagagctgatgaatctag

SEQ ID NO: 68406 - protein, 149 aa, Zea mays
  misc_feature: Ceres CLONE 1544645
  misc_feature (8)..(148): Pfam Name: Ras Pfam Description: Ras family
  misc_feature (8)..(121): Pfam Name: Miro Pfam Description: Miro-like protein
  misc_feature: SWISSPROT Homolog: EC 2.7.11.1 Non-specific serine/threonine protein kinase
MSASRFIKCVTVGDGAVGKTCMLISYTSNTFPTDYVPTVFDNFSANVVVDGSTVNLGLWDTAGQEDYNRLRPLSYPGADVFLLAFSLSPKASYENVSKKWVLELRHYAPGVPRILAGTKLDLRDDEQFFVDHPGAVPISPDPGKELMNL

SEQ ID NO: 68407 - DNA, 804 bp, Zea mays
  misc_feature: Ceres CLONE 1544653
  misc_feature: Encodes the peptide sequence at SEQ ID NO. 68408
  misc_feature (42)..(42): n is a, c, t, g, unknown, or other
  misc_feature (804)..(804): n is a, c, t, g, unknown, or other
tttgttttacgggacagactggtgtgttttttatgccttccnttcatagctggagctccccgcggtggcggccgctctttcatagtggatcccccgggctgcaggatttcctctcacccctagaaaaagatccatcggagtgacagcgagcgagcgagagcgagagcgagagagacagagagattatccgcgcgtcaccgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtgagtgtttccgctcctccagacccgtttctctatggattcgtgtgagaaaggggatccgtgatcccacttttgggcggggtctttgatcttatgattcgcgaatcgtttattggcaatttgccacatccgaaggagataaagttcgcgtcttaaacgaacgctctttatgggggagaatccagaactaaatggggacaacaggggggatgataccggggtacctggaggcacctaacctttctgggtccaaggtaccctggcaaaccggaactgggcttcctggaaaccggggggtggaaccctgggaatctggagagacgggggagccttttaaaaaggtaacccccgaaagaaccgggaaatgtgcaaaggtggcgtn

SEQ ID NO: 68408 - protein, 69 aa, Zea mays
  misc_feature: Ceres CLONE 1544653
MGKGFASYLAMKTGPEGGDAAAAQQALIDADLRELGVAARKLANHAFVLGGGLGFGTSFLKWLAFLAAV

SEQ ID NO: 68409 - DNA, 781 bp, Zea mays
  misc_feature: Ceres CLONE 1544659
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (37)..(37): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
nnnnnnnnnnnnnnnnnnnnnnnnnnntttttttttnttttttttgcctcnnnnnnncatatctggggctccccgcggtggcggccgctctagaactagtggatcccccgggctgcaggaattcgtctcacccctagaaaaagcacccccgctgtggctcatcactgcacaggcagctcgagtgagacagagaaagatgtcttggttcgggcaccatccaggcaatctgccggctcccccggcgtcgggccccaaccaggtgttcaagatcttctgacgcgccaacgagaactactgcctggccgtccgcgacggcggcgtcgggctggccccggtcaaccccaaggacgaccaccgacactgttacaaggacctgcgcttctgcaccccgctcaaggaccaggaatgcatgccggggttcgcgctcgtcaacaaggctacggggctcgccatctagcactccctcggccaggtcccacccagtcaagctcgcgcctttcagcccggaccatgacgacgcgtcagggctgtggacggagagcacggacgtgggccagggcttccgctgcctccgcatggtcaacaactacccgcctcaacttcgacgccttccacggggacgaggaccactgcgtgcgtgacacgatggcaccgccgttcgtgctctggggaatgccgccaggggccagaaccagtacgtgggaaaatcccgcccggggcggtccccgagggcaaagttccggccgacggggccaaggggtgggagggccggtactcctgt

SEQ ID NO: 68410 - DNA, 826 bp, Zea mays
  misc_feature: Ceres CLONE 1544661
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
nnnnnnnnnnnnnnnnnnnnnnnnnnnnngggggggaatttggtgtgtgaaagctggtgctccccgcggtggcggccgctctataactagtggatcccccgggctgcaggaattcgtctcacccctagaaaaaaatccaaatccggctcctcctcctccttctcctggcactggcagcgaagatccaaagatagcacaatcgcatctcacacgccgagctatttctactttgagagaatccccttctcccacaaggagcgagtaatttgaggcagagaccgacacagatggcagcggttatggtgtctcgccaaagccgggagctgcagcggtcagcgcgagcacgggcgggcgcgtggtggtgggctgcgtcccgtaccgcgtgcgcggggggcgacggcgaggtggaggtcctggagaatcagctccgcagaaaaaagggcccccgccggggggggctggcttaatccccccaaggccccggtgggagaacttggaacaaaagcccattggaaccaaaggggggctcccggcccccaaagggccccccgaaaaagaagaggccaggccgtgtgctccgtaaaaaaaaaacggggcccccccccccacttggggccccccctggggggctaacccgcccgccccccacaccttccccagaccccccccgcgaaataaagaggttttccggtgggcgtccccccgtggggcgggggaaacccggggaaaaaaacgaggaaccgcggggggcccccaaaataagccccccccccccccaccagagagaagagggaggtcacccacaagaaccaaaaaggaataatcg

SEQ ID NO: 68411 - DNA, 678 bp, Zea mays
  misc_feature: Ceres CLONE 1544664
  misc_feature: Encodes the peptide sequence at SEQ ID NO. 68412
  misc_feature (678)..(678): n is a, c, t, g, unknown, or other
tgtggatcccccgggctgcaggaattcgtctcacccctagaaaaactccgcttaccttagatgtctccgagatccataaactagaacaagagcgagcagagcgtggcgacaaatcacccgctgccttttatcccgcaaccagcacctccgaaggccgcgagaggcaggtagtacccgcacgccacatcaacccaccacggatggccggcggacgcgaccgagacgcatcccacgcggaactccgcgcggggttcgagaccctggccatgacgcggtctgacccttccgcgggggtctacgaggtccgactcaaccgaccggcgaatcgcaacgcgatgagccctgccacgttcgcggagatcccgcgcaccatgactctgctggaccgagccccctcggcgagcgccttggtgctgtctgccgcgggcccgcacttctgcgcgggcatctagctcaggtgccccggggacccgctgtccgccgcctcagcccatcccgtggccgccgcggacggactactccgcgcggtcctcgacttgcaagctgcgctcacggacatcgatccgggccggaagcactgctgtactgctggaccaagcagcctgcgtttagtgggggccttcaccttgttgtccctcctgccaaattcagtgcttggtacaagggacccctcccttn

SEQ ID NO: 68412 - protein, 83 aa, Zea mays
  misc_feature: Ceres CLONE 1544664
MAGGRDRDASHAELRAGFETLAMTRSDPSAGVYEVRLNRPANRNAMSPATFAEIPRTMTLLDRAPSASALVLSAAGPHFCAGI

SEQ ID NO: 68413 - DNA, 776 bp, Zea mays
  misc_feature: Ceres CLONE 1544673
  misc_feature: Encodes the peptide sequence at SEQ ID NO. 68414
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
nnnnnnccttttnnnnnnnntttttttctcgttttcccgtcttgtctctttagggtttgaggtccccgcggtggcggccgctctattttagtggatcccccgggctgcaggaattcgtctcacccctagaaaaaagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaacggcgccgccaaggccgatgcctagctggcggtgaagagaaagggggcggagaatcccgccaagggcaggaaagggaaggccggctaggaccccaacaagcctaagagggctcccagcgctttcttcgagtacatggaaaaatttcccaaggacccccaggacaagaaccctaagaacaagtctgtccctgcggcgtggaaagctgctggcgaccggtggaaatccctgagcgagccggaccatgctctctacgtttacaaggctaacaatctcaagctcgatataccacaaggtcatcacttgcctccaactaacggtgagagaccctggctctaaataaagttccctgcccaaggagccaagaagtacaaaaaatgcaagaacaaccccccgaccaagtcccaattcaggaaggtcgaacggaacgtatggacggaccaccacacacggcacccgg

SEQ ID NO: 68414 - protein, 67 aa, Zea mays
  misc_feature: Ceres CLONE 1544673
MEKFPKDPQDKNPKNKSVPAAWKAAGDRWKSLSEPDHALYVYKANNLKLDIPQGHHLPPTNGERPWL

SEQ ID NO: 68415 - DNA, 807 bp, Zea mays
  misc_feature: Ceres CLONE 1544676
  misc_feature: Encodes the peptide sequence at SEQ ID NO. 68416
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (32)..(32): n is a, c, t, g, unknown, or other
  misc_feature (34)..(34): n is a, c, t, g, unknown, or other
  misc_feature (38)..(38): n is a, c, t, g, unknown, or other
  misc_feature (42)..(42): n is a, c, t, g, unknown, or other
cggggccgcgcgggggggggnnnnnnnccccncncccncccnccccacatacctggactccccccccagggggccgctcaccaatactggatccctcgggctgcaagaattcctctcacccctagataaagcgccacgcgcctgactcggtgcactgcactggaggtgtgcacgcccctcgtcagtcgtcactcactcgctaccccatatcccattccccccgacggcgcctctggcagctatgaacaatatgtcaaatagggccacccattggtgttatgcctgtcagagcccaattcgtcttggcgggcaggatatcatatgtcccatacagcagcgatggctcaatccaacaaaccagtgagatgggaggcgtactgaacattaatgggctaactgcaccggactttgaagagcgccatgccagaagatttgaaaaagatggatgccaaatcttccctcatgcggcaacaaatgtcaaaaataggaagggacagattgtttgatattcaccttactacaacgtaatatgtactgattatagaaataggttaaattgacaaaataaaacgtttagatataaagtaaataaatctgatcctgcaatatggtaaaaaaagatgatcaatggaagtcataaagagaaagacgccacaagaaagccacctgcccgttccccaattccccactaccctttacatgattcctcaacaaaaacaggaaaaactttttatttatatatttatttatctaaatataaaaaaaaaaatttaaaaaatgaacaacacaacgaaatgctacaacaca

SEQ ID NO: 68416 - protein, 40 aa, Zea mays
  misc_feature: Ceres CLONE 1544676
MNNMSNRATHWCYACQSPIRLGGQDIICPIQQRWLNPTNQ

SEQ ID NO: 68417 - DNA, 876 bp, Zea mays
  misc_feature: Ceres CLONE 1544688
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (806)..(806): n is a, c, t, g, unknown, or other
  misc_feature (876)..(876): n is a, c, t, g, unknown, or other
nnnnnnnnnnnnnnnnnggggnnnnnnnnnnnnnngggcgggggannnaaaaaaagctgggaagcaagccggatccccgcggtggcggccgcttctgatctagtggatcccccgggctgcaagaattcgtctcacccctagaaaaaagtgcgcgcttgaaaataggttaacaccgcttcttatcctcggtgtccaaccccagctcctcagttctcgtcatcgtcctcgagatcagtgaagttggaagtgtagggagagagccacgccgcctgcgcagcgtgccgggccgggggcggtggcggcagtcgaatctgtttgcttttggggggtttctcttgacgccgtcccttgcggtgccacaagagagggagggacaggagcattctttattattcctgccatcgtcctggatctccatagtactagcgctgcgaaataatatattaaacttgagtaacgtggtgaagtttcaataccttcttgagcccacaccctggatggaaggagatctgaagtatcgagctatccatgtatggagaaagaatagcaagaagggagggtgtgcaataggcgggaggagtgaggaggacaggcggtgaaacggctgatgaaacagagacggcggggtgggcgagtcgaagtggatgcgcgggggagcgcgccgccggggagtgggcgagagcgttgagtttgccttgtgctgccgtaacttctgtgcgtatcatagcgccttcggacactccgttcgcctcccgggcgtcgaggtagtgatgcggggtcgtggggaagcatagccgacaacacanacgcatacccgtacggcgaggcctcgcgtggggcgcggtctgggtatacagcgcgcatcggagcacgcgn

SEQ ID NO: 68418 - DNA, 905 bp, Zea mays
  misc_feature: Ceres CLONE 1544690
  misc_feature: Encodes the peptide sequence at SEQ ID NO. 68419
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (462)..(462): n is a, c, t, g, unknown, or other
  misc_feature (809)..(809): n is a, c, t, g, unknown, or other
  misc_feature (825)..(825): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
nnnnnnnnnnnnnggggggaanacgnnnnnntnnnggtgatnnnccatactggagctccccgcggtggcggccgctctagactagtggatcccccgggctgcaggaattcgtctcacccctagaaaaattccgcttgcttgattgttccaggtattagcagtcgaccggttcctcggagcacgatgaagtttgttgctgcctacctgcttgctgtcctcgctgggaacgccaccccctccgctgacgatttgactgccattctggagtcagttgggtgtgaaagtgccatgaaaaaatggaactcctgctggtccaattgaacggtaaggaatttccccaccttattgggtgtggggacgggagagttttttttttttttcctttgggggggtgggggggacccccacggagtctttttttcccccccccccccgggggggggggggggggggaacccacanacacaacacccctggttttgggcgctcccccgtccggtgaaaccctggggcgcggccgttacgtatgttgggggtggggactacctcatttccccttcgtgctgatcgtgtagttgcgatatctttgtcttttttgtggggggtgtataaattttgttggggggccgcgcctggactggacctcggccccgcgggcgcggctgccccccgcgccgcgcctacactccgcgcgcaatactcttgtccgcctgaacccggttcccgtccccgcgcgggggatatagactcccgccttcccgttcccgcccccctggacgccgcgcccgccgccccggggggggtggggnggtctcccggttaacnctccctcctctctgcccctcggtgccgttcccccctcnnnnattggccggcctcttgttcgctcgtctggtggtgccccc

SEQ ID NO: 68419 - protein, 45 aa, Zea mays
  misc_feature: Ceres CLONE 1544690
MKFVAAYLLAVLAGNATPSADDLTAILESVGCESAMKKWNSCWSN

SEQ ID NO: 68420 - DNA, 890 bp, Zea mays
  misc_feature: Ceres CLONE 1544694
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (374)..(374): n is a, c, t, g, unknown, or other
nnnnnnnnnnnnnnnnnnnngggggannnnnnnnnnnngggaaaannnccaaactggagctccccgcggtggcggccgctctagaactagtggatcccccgggctgcaggaattcgtctcacccctagaaaaaagctgcgatccaaacgcgcgacgcgacttattcagcaccaccgccgcctttcattttttccttcgcatcttgagagagagagagagagagagcggaggaggagagcaaggacatgggcggcttctaccagcatggtgaggagcggaccaaggagctgagtcaccttaggaccgtggggatgatggggatctaggcgtcccgcgatctttgccagagcgcggtggagcccggcccggagccngcctctagcggctgaaaggccgcggggagtgggtggcgcggcggcttgttttttttcccccactttggggggggggggggggggccccccccttgtatggatcttggcgctcgaccgcctccccgttaggggggtgtggggggtctatcccgcgtggcgtcgccaggggggggggcgtgacggggcggcgcgagggctgcgagagggggggtggcgagccggaaaagagagggagcacgtcggcctgcgccccaatgggcgggtggggggctggcaaccactcccacgaccccttcaccgaactaccggctgataaagcaagcctgtagagtggccgtcggtagcgggtgctatcattggtcgttaagagattgctttctcttcctccgctgtttgtcgtgggtcaccaatatccttgtctggtcgcttttttttctctcctgtccactgtctttaatggtgttggctttattcatatgtggtggtttgtcaggtggtgtggtgcacggcattaat

SEQ ID NO: 68421 - DNA, 816 bp, Zea mays
  misc_feature: Ceres CLONE 1544700
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
nnnnnnnnnnnnnnnnnnnnnnnnnnnnnnnnnnnnaaaannnttcaaactggagctccccgcggtggcggccgctctagaactagtggatcccccgggctgcaggaattcgtctcacccctagaaaaaatacctttctcggccttttggctaagatcaagtgtagtatctgttcttatcagtttaatatctgatatgtggaccatgtgttcacttcgatattaaatttattttttgtgggggagggtccactacagtggcttgccactgggcccctcgagcgtcgctcggccgttgcactactggctgagcctggcgcaccccaaccaatccaattcgagattttttattaatattttttacgacatataagcagaagttgaaagtcttagtaacagatccagaggcaagggaggctgtgcatctcctgtaatcctgtcttacaatcatcgaatgtctcgttccttcgatgggtgaaagaaattaatttactttaaaccaccagtataaatatgcctaactgttgggccgctcgcgaaaaaaatagcggaaaacaatcgtcatttttaataaataaaaaaaaaaacggagcccccccagggacccccatttccccccttaaaggggggctctttattaagcgcgcgctttcgtgggctgtgttttttaaaaaccttcggggagctggggaaaaacacccggggggtatacccccaaattataatggccctgtgagaaaaattaatccccccttttttttcccccagtgtgggggggtttaaaaaccccacaaaaagagcgcccccgccacgagga

SEQ ID NO: 68422 - DNA, 914 bp, Zea mays
  misc_feature: Ceres CLONE 1544709
  misc_feature: Encodes the peptide sequence at SEQ ID NO. 68423
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (914)..(914): n is a, c, t, g, unknown, or other
nnnnnnnnnnnnnnnnnnnnnnnnggggggtgccnnnnnnngcaaactggagctccccgcggtggcggccgctctagaactagtggatcccccgggctgcaggaattcgtctcacccctagaaaaacccttcttacagccgccgccgccgcatcccagcctccatcaccgtttccgtctcgttgccatgggtaaggtgcacggatcgttggcgcgcgccgggaacgtccgcgggcagacccccaaggtggcgaagcacgacaagaagaagaagccccgcggacgcgcgcacaataggatgcattataaccgccgcttcttcaccgtcgtcgtctgctttctgctagaatcttgcctgcctcactcctccgagaattaattcgccgactcggtttcataccgtggttcctcctccctagcctgactttccggatgccttacgcccccctacgacggaacctacctttcttttgcttcctatagcattaataatacaccctctcccgccaaaccccgcgcctttgcgggcccaagggcgcgcgcgggtgggttaccgtatacacctgcctcccacactctgccccttcttaatggaatgtgttcattgttgtctatcttttctctcccctaccccaacacaaacaaaacacccccactcccccttcctcgggttgtcccaaaagcccggcactctatacagcacgcccgcgacagggggaccgggccgccccacgcgagcccgcggcgggcccccacacaccaccccacccccccgggcgaccggccccctctcggtggtgtgctcgtggttatgtggggcctctgggggggcgccgccacatccctgctgcccacgggcgtggggccgttggctcgccaaaacagggtggcggagcaaaaaactggggccgcacn

SEQ ID NO: 68423 - protein, 63 aa, Zea mays
  misc_feature: Ceres CLONE 1544709
  misc_feature (3)..(61): Pfam Name: Ribosomal_S30 Pfam Description: Ribosomal protein S30
MGKVHGSLARAGNVRGQTPKVAKHDKKKKPRGRAHNRMHYNRRFFTVVVCFLLESCLPHSSEN

SEQ ID NO: 68424 - DNA, 693 bp, Zea mays
  misc_feature: Ceres CLONE 1544715
  misc_feature: SWISSPROT Homolog: EC 3.2.1.23 Beta-galactosidase
aagctggagctccccgcggtggcggccgctctagaactagtggatcccccgggctgcaggaattcgtctcacccctagaaaaagaaagtaaggactcactttagtaagctatttctgcaaaagtatctaagttgatttttgctaaagcctctccttgattcccaaatccagcatacccttgagagtcttttctttagtcgggtaagacttgctgagtaattccatactcagggttttattccctgttgtttttcaggttttaattttgtgctgctgttgatggtgttaagtgccggtgggctcggccttcttataagtctaagtacttcttctatacttcttattgaggatggtcacttgagctagcatatatttcaaacttatacttttgtaatcactccgataaaataatgtaaaatttttgtaacctataaaatttggtaataagatttctgctgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattg

SEQ ID NO: 68425 - DNA, 816 bp, Zea mays
  misc_feature: Ceres CLONE 1544717
  misc_feature: SWISSPROT Homolog: EC 3.2.1.23 Beta-galactosidase
  misc_feature (1)..(1): n is a, c, t, g, unknown, or other
ncccccccccccccccccccccccctccttttatttttttttattaaaattggggctcccctcggtggcggccgctctagtatagtgtatcccccgggctgcaggaattcgtctcacccctataaaattcctgctcccctctcccccgttggcttgttctgttgctcttcgtgtcctcccctcccctctgccggctctccggcccctcttcgtccccccgaaataaaaaaaaaaaaacgagacgctctaggtaccctattctccctatattgattcgtatttcgttgtgctcattggccgtcgttttacaacgtcgtgactgggaaaaccctggcgttacccaacttattcctcttgaaaataatcctcctttctccagctggttgtaatagcgaagaggcccgcaccgatcgcccttcccaacagttgcgcatcctgaatggcgaatggaaattgtaagcgttaatatccccgtcaaaattcgcgttaaatgttggtgaaacccgcttcgtttttttagccactaaggccgaaatcggcttaaacccctttataaattcttaaaaatcgacccgagattatggtttgagttgtttgttccagtttcggaacaacgaattccactttttgaatgaactctggacctccaccgtctaaatgggcgaaaaaaacccttctaatccggggagaatggcccccaatatcttgatacctctccaccccataatccaagtttcatttagcgggccaaagagtcgcccttaataggccccttagatccgccgaaccccttaaagggggagcccccccctatat

SEQ ID NO: 68426 - DNA, 719 bp, Zea mays
  misc_feature: Ceres CLONE 1544722
  misc_feature: Translation starting site: 88
  misc_feature: SWISSPROT Homolog: EC 3.2.1.23 Beta-galactosidase
  misc_feature (263)..(263): n is a, c, t, g, unknown, or other
  misc_feature (719)..(719): n is a, c, t, g, unknown, or other
aagctggagctccccgcggtggcggccgctctagaactagtggatcccccgggctgcaggaattcgtctcacccctagaaaaatggaatggaaaccacaatcaaggctgtagtagtgtgtagtaacgaggtacggagtatcgaggtagatacatcagatggtgtaagggagtaccagttgttagttcatggcttcaagcttagcctcccttcaatttgttcgatgatgtattacttcacaataaacattattatttagatgtnaaaaaaaaaaaaaaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgan

SEQ ID NO: 68427 - DNA, 657 bp, Zea mays
  misc_feature: Ceres CLONE 1544725
  misc_feature: SWISSPROT Homolog: EC 3.2.1.23 Beta-galactosidase
  misc_feature (592)..(592): n is a, c, t, g, unknown, or other
  misc_feature (603)..(603): n is a, c, t, g, unknown, or other
tgtggatcccccgggctgcaggaattcgtctcacccctagaaaaaatgatgtatacggtattcctggcgaagcttgggataaagccgtcgctgaggtcaccaagatggctggacagagtgatgtgaaaattttaggagtagggcatcgtacgtagtgactgttcttcctgttctgctgttttagccttgctgtttgtcgcccctacctatactgggacctgtaaccatggggtgcatctgtgcatgcaaacgcgacaagcaaaattcgggattatcaatcaatcatctgtgctactcgtgctctgttgatgatcttcttgttaaggcaaatgcgagagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaattggaattgcacgcgttaatattttgtnaaaattcgcgntaaatctttgttaaatcacctcattttctttaccaataccgccgaatcccgaaa

SEQ ID NO: 68428 - DNA, 933 bp, Zea mays
  misc_feature: Ceres CLONE 1544728
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (531)..(531): n is a, c, t, g, unknown, or other
  misc_feature (696)..(696): n is a, c, t, g, unknown, or other
  misc_feature (739)..(739): n is a, c, t, g, unknown, or other
  misc_feature (741)..(741): n is a, c, t, g, unknown, or other
  misc_feature (910)..(910): n is a, c, t, g, unknown, or other
  misc_feature (933)..(933): n is a, c, t, g, unknown, or other
nnnnnnnnnnnnnggggnnnaaaannnntttttaaaannnnnncaaactggagtccccgcggtggcggccgctctagaactagtggatcccccgggctgcaggaattcgtctcacccctagaaaaagtgtataggctttggagggttcctaccttcctgctattgtaataagttatgcactttgagtatatcacgacttgtaataaatgtaactccttctatgtaccaaccttcggttttagaaataacaagaatgttttgtaaaaaaaaaaaagaaaaggagagtctcgaggtaccctcttcgccccatagcaaatcctattactgttgctcctatgtccgcggatatagaaagcgcagacacgccaaaaaccctttgtcttccaaccaagaaccctcatttcggcgggctcccctttttctttctctttgccgcaggggaggggggggggggggggaccttttctcatactccctccctctcacccccccttggagtctcaattcgccgaaagccgacatttttgggcnccacgtaacctgttattatgccctatctactaaatttaacctcttcccaaccttattttgctctccactccctttttttgtttcttttctgaggataatgtagtaaactgagaaaatatgttattttttcaaataattacccaccattcaccttctcccatgcgnccatatcataccatccatttttctgtttacgcccccacgccgncncgtaaatcccgcacctctcattgcgccctgcactacaattcacctaatctctcccactctctaaataattagacacaaaacatcactacactccacaccattcttataaaaaaaaacaaaacactatctgctttactatccaaacctattataactcattcctcttcanctttgttgcctcctctcatctcn

SEQ ID NO: 68429 - DNA, 886 bp, Zea mays
  misc_feature: Ceres CLONE 1544729
  misc_feature: Encodes the peptide sequence at SEQ ID NO. 68430
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (474)..(474): n is a, c, t, g, unknown, or other
nnnnnnnnnnnnnnnnnnnnnnngggggggggntaannnngggggggnnnagagagcgggcctctacgaagtggcggcccctctagaactggtggatcccccgggctgcaggaattcgtctcacccctagaaaaaaaagcgaaaggagagaaggaatccgatccctccaagccaagccaaggcagagaagaagaagaagaggaggaagaagaagcctccggcagcatgtcggaggggactgccacctgcgtggacatcctgatagccctcatcctgcctccgctgggggtgttgccccactccgggggccccccccactcttggatctgcctcatcttctcgttccttgcgccgcaagcggggggtatcagttataggagtatagcgctctccctgggacgccgcgggggggccgcccaaggtcgggtgttttttccccccccccccaggggggggggggggggggcgaggtgnccccaacagcgtgacccgggtgctgctgtggtgtgtggtgcgtgagcgcaccccccctcctttttgtgtgtctactacttttgcgttgtgtattcctccccccacccaacggctccacaccaatcgcccccccgccccccacccgcggcgcgccccctggcgcgcgcggccgcgccgtgcacccactccctcctcccccctccttcctccccccttccgcccctccctcttctccaccccccccccccagagagcgccctcggcgccggggccccggttgtgcgccggctgagtggccatccaataacagcccctgttgccgcgccccctgtgagcgccgtccccccccctcgctcattaacgacgtgtaccccaaccgataccctcaatctcacctcccgctcaataaaaa

SEQ ID NO: 68430 - protein, 97 aa, Zea mays
  misc_feature: Ceres CLONE 1544729
  misc_feature (83)..(83): Xaa is any aa, unknown, or other
MSEGTATCVDILIALILPPLGVLPHSGGPPHSWICLIFSFLAPQAGGISYRSIALSLGRRGGAAQGRVFFPPPPRGGGGGARXPQQRDPGAAVVCGA

SEQ ID NO: 68431 - DNA, 861 bp, Zea mays
  misc_feature: Ceres CLONE 1544731
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
nnnnnnnnnnnnnnnnnnnnnnnnnnnccgcggccccccccnntttctcnnnnnnnccaaactggagctccccgcggtggcggccgctctagaatagtggatcccccgggctgcaggaattcgtctcacccctagaaaaagacgaacaagagcagtgtgtgttcccggtcctttccaatcaggatctggtgaagtttttgcctttcatatcgaagaaattaataattcatgtagagggaggattcttccaacaatttgttttggatggagacttagatctccaaacactcgtaactatcctactaggtggtgacatcagtccccaaaaacaaatataattgcgtattatttaggaaaggagcgggcccgcacgctctattaaataacagcttttgatatggtcgtctgttacgaggctcggtcctttttttcttcctcacttctaggggagggggggcgggtgacaacacctttaaatctatattctatttctctgctgtttgtctttgatgttacgttttggttttttttgttgtagttctccctcctttgtgatctcccttgcccttcgtaggggttgcggtggcgtgtgcgcgtctcatcgaatattataaatatgggctcgcggtcgcggcagtttgtgtgttttttgtctgtttggagccgccggtttacaagataacgggtcattctctaccacccttattctgttctcatctatctctcttttcatctacctctacaacacaccacaacaattacacacttctaaacccccgctcagaaccctcgccaccgtaccaaaaccaccccctcgtattccccctccccacctcccccccctccctctccactcttccc

SEQ ID NO: 68432 - DNA, 792 bp, Zea mays
  misc_feature: Ceres CLONE 1544737
  misc_feature: Encodes the peptide sequence at SEQ ID NO. 68433
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
ggattggtcgaccngtnncgggagggaaatacgtnnnnnnnncccnnnnnnnaaatagtggagctccccgcggtggaggacgnnntttccctattggcatcccccgggctgcaggttttcttctcacccctagaaaaagagcaccaccagttccttgttcggtcggaacgcagcgcagcggcggcggcgatagggagagaggagagagtctgcaggatccagcaggccgagggaggagtcaacggcgggccggataatatgagcggcaacggcgcgaagaaggtggtcgatgcggcggtgaaggccggcaagaccatcatcgactgggacggcatggccttagtagctcggcaacgaaaatgcgcgcatgggatttttttgccctccgccgcgctttagaagacgtcaaccattattttccccaccccagtttcggagggggaagccccatcccaattgtatttgggttcatctttccaaccagtggaatggggaataagaacgctggcgggcgtttgcctcccattggaaggtctttcttataacctatctttggattccctgaaattttcgtctcgtccacttgtttcttgcccggaatgagataaagccttagagatcgtatagtgccggtaaatccgctttaatataataaaataatgtcatgcatgactatatctattctctttttgtgttttccgatacaccactactacgattatcgactccgtttctgtttttttgagttaattatgtttgtctaattttttagtgttgatttttttcgctgag

SEQ ID NO: 68433 - protein, 46 aa, Zea mays
  misc_feature: Ceres CLONE 1544737
MSGNGAKKVVDAAVKAGKTIIDWDGMALVARQRKCAHGIFLPSAAL

SEQ ID NO: 68434 - DNA, 829 bp, Zea mays
  misc_feature: Ceres CLONE 1544741
  misc_feature: Encodes the peptide sequence at SEQ ID NO. 68435
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
aaaaaaccaggtatattaaggtcctttnnntattttttnnnnnnggaannnnnnaaaaactggggctccccgcggtggcggccgctctagaatagtggatcccccgggctgcaggaattcgtctcacccctagaaaaaagaccgactccctcaattacctgcccgtcccaattgtttccgcaagtcgcccagaccagatttgccagaacgcaacctcggctccgaaaccctagccgcacgcagctgtccacttctactcccctcgcctcgccacacccgccgcgcggcacgatcagacgccatggccgccgagaactactggaggtacgctgatgcgcggcagcagcagcaggggatggtggccgccgcggcggccgcagcggggatggctccacgcgcgaccgtcgcctacggcccccaccgtcggggagtggggcggggggttatgaatccctctagggtgccggccgccccccattgggcgcactaaggcccacccccttgcgtcctcccttttgaagggggcggcgccacctccggtaaactttcggcgagaacgtagtgccgtggggtggggctagtcgagcggtggacgggagctcattttatcaccctcgcgtgaacaatagttaacgcggggccgagattatctattttctttctcactctaggaagatattccctaccccgcaccttggggaggacagtgcttgtacgacaacagctttacgcttacgcccgccatgtggtgattggggtcttccgcggtgtgtatggatgagtaacggacctacatcacactaggcggcgggcacggagtaaggcgcga

SEQ ID NO: 68435 - protein, 62 aa, Zea mays
  misc_feature: Ceres CLONE 1544741
MAAENYWRYADARQQQQGMVAAAAAAAGMAPRATVAYGPHRRGVGRGVMNPSRVPAAPHWAH

SEQ ID NO: 68436 - DNA, 756 bp, Zea mays
  misc_feature: Ceres CLONE 1544744
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (82)..(82): n is a, c, t, g, unknown, or other
ttttnttttttnnaaagtatctatctcttctttnnnnnnnnnnnggtttnnnnncccttctggtactccccgcggtggaggncgctctttactactggatcccccgggctgcaggtaattcttctcacccctagaaaaaaaaagacaccgcccgtacacaggctcgttggcttggctgctgtgtgttgcgctcagccattcagacttgagagctactagctaactgctcgttgggtgtgggtgcgctcccggcctagaccgtggaggaaaggagtccagtccactcactaccccctctgctccgttcgggttcctggccagcacagccgagggttccgcacagcgataagcgcgaagcggaagagatggagcatatcgtcagggtcttctttagagtttctggaaatgtctttttttctcttccctctttcaggagggggggggggttcctttttggtggggccttcttggaacccggccccacctgaggatcttctccaggagaaggcccttataagcgtggagtcttggctgaaactgggcctctctaatccatctttgtggtccggccctggccgttttgcgtttcgtcgagactaattatcctagagggcttatcaattctcgcttcttcacgtttccctcctatccaggaacaatatcttttttggggtaatttctatttactgtgcgcttctgtaaccttgctgggagaaggttttttcacccgcagcgaccaagtcgccacgcctagtt

SEQ ID NO: 68437 - DNA, 619 bp, Zea mays
  misc_feature: Ceres CLONE 1544749
  misc_feature: Encodes the peptide sequence at SEQ ID NO. 68438
acccgcggtggcggccgctctagaactagtggatcccccgggctgcaggaattcgtctcacccctagaaaaaaccgttcagtcccacctcgaccgcctcctctcccctcccccggctctgtctgttgacttaccccgtcgagctatctagtcagctgctcccgttgccatggggaaggagaaggttcacatcaacattgtggtcattggccatgtcgactccggcaagtccaccaccaccggccacctcatctacaagcttggaggcattgacaagcgtgtcatcgagaggtttgagaaggaggctgccgagatgaacaagaggtccttcaagtacgcctgggtccttgacaagctcaaggccgagcgcgagaggggcatcaccattgacattgccctgcggaagtttgagacaaccaagtactactgcaccgtgattgacgcccctgggcaccgtgacttcatcaagaacatgatcaccggcacctcccaggctgattgtgcggtgctcatcattaactcccccactggtggctttgaaagtggtatctccaaagacggccagacccgtgaacatgctctccttgctttcacttctgaaatgaggcagatgatctgct

SEQ ID NO: 68438 - protein, 150 aa, Zea mays
  misc_feature: Ceres CLONE 1544749
  misc_feature (5)..(150): Pfam Name: GTP_EFTU Pfam Description: Elongation factor Tu GTP binding domain
  misc_feature: SWISSPROT Homolog: EC 2.7.7.4 Sulfate adenylyltransferase
MGKEKVHINIVVIGHVDSGKSTTTGHLIYKLGGIDKRVIERFEKEAAEMNKRSFKYAWVLDKLKAERERGITIDIALRKFETTKYYCTVIDAPGHRDFIKNMITGTSQADCAVLIINSPTGGFESGISKDGQTREHALLAFTSEMRQMIC

SEQ ID NO: 68439 - DNA, 641 bp, Zea mays
  misc_feature: Ceres CLONE 1544750
  misc_feature: Translation starting site: 78
ggagctccccgcggtggcggccgctctagaactagtggatcccccgggctgcaggaattcgtctcacccctagaaaaatggttataatagtaaagagtattatcgtaactattgttgtaaaggcatttggatacaacattagaacaacttttgttgttggctgtccttagctcagataggagagtttgcttttgtgcttttgagtcgtgcctcccatctccatcttgttggggggaaaatgtatctactattactgggaacaattgcccttagcttggtaacaactcctcttattttcaaactaattcctatggtaatgcaccttggcatccttatgtgttggttcccctcggaaaacagtatgcagagtgaggtatcctttactaccctatttgctgtttttttattaaaaagcttgacctatggacattgttggctggagcggtaaagacgtaacgcctctgttcaaatttcatggtctagaatatttgacatgttaggttttgaagaagtatcacatttgtgtttttcttcttttaatcagttgaggtactatattaaggctgtaagggtagcctttcttcccgctgttctgccttccaactatctcaaccgtccatccatgcctctgttttcatcgt

SEQ ID NO: 68440 - DNA, 621 bp, Zea mays
  misc_feature: Ceres CLONE 1544752
  misc_feature: Encodes the peptide sequence at SEQ ID NO. 68441
aagctggagctccccgcggtggcggccgctctatactagtggatcccccgggctgcaggaattcgtctcacccctagaaaaacaccctccgcctcctgctctctctcgcctctggttggcagagctctcttgaagcctcgagactcgtctcgccgctgctccctcagctctggcgctgcgtgcctccgttagctgttgcattgcggcgcagccccgcgagccttgagctgctagctcgcccgttcaccactgccttcacacatggagttcgaagaccgctgccacaccgtccaggaccccaagttcgagtgcctgctcttcgacctcgacgacaccctgtatccgctgagcgccgggatcgccggccacgtcaagaagaacattgaagattacatggttgacaaactgggtattgtctacaccaagatcgagagcctgggcaatctgctgtactacaactacggcaccactatggctggactcagggccatcggctacagcttcaattacgatgagtaccacgccttcgtccatggaaggctgccgtacgacaacatcaagcctgaccccattctccagcacattctcaagaacctgcgcatccgctgactcatattcatc

SEQ ID NO: 68441 - protein, 115 aa, Zea mays
  misc_feature: Ceres CLONE 1544752
MEFEDRCHTVQDPKFECLLFDLDDTLYPLSAGIAGHVKKNIEDYMVDKLGIVYTKIESLGNLLYYNYGTTMAGLRAIGYSFNYDEYHAFVHGRLPYDNIKPDPILQHILKNLRIR

SEQ ID NO: 68442 - DNA, 697 bp, Zea mays
  misc_feature: Ceres CLONE 1544755
  misc_feature: Encodes the peptide sequence at SEQ ID NO. 68443
  misc_feature (36)..(36): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggttgtgttgtttctcctagtgtttatttgggttntnattnngcggggnnnccaaaactggagctccccgcggtggcggccgctctataactagtggatcccccgggctgcaggaattcgtctcacccctataaaaaacttctgttcccaatcagatgagcggcggcgcgtgcggtctaggtagcaggctgaggaggagttgtgccaagccacaatgggtatctcgcgtgtctccttgcacaagcgccgagccaccggtggaaagcagatggcctggaggaagaagcgaaagtatgatcttggtcgccagccagccatctccgagttgtctagcaataagacggtgatgagggtccgtgttctgggaggtaatgtgaaatggagggctcttcgccttgatactggtaactactcatggggaagtgaagctgttacccgcaagacccgtatcctcgacgtggtctacaatgcatcacactatgtgcttgtgaggacacacacccttgtgtagagtgcctttgtgcaagttgatgctgccccattcaagcagtggtacctcactcactatggagttgacgttggtacgaagatcaaaacccctgtctgcaagaaggataatgctgagggacatgaggttgaggcagcagctgaggaaacgaaatagagcaaccttgtcacgaggaagcttgagaagcg

SEQ ID NO: 68443 - protein, 98 aa, Zea mays
  misc_feature: Ceres CLONE 1544755
  misc_feature (1)..(99): Pfam Name: Ribosomal_S8e Pfam Description: Ribosomal protein S8e
MGISRVSLHKRRATGGKQMAWRKKRKYDLGRQPAISELSSNKTVMRVRVLGGNVKWRALRLDTGNYSWGSEAVTRKTRILDVVYNASHYVLVRTHTLV

SEQ ID NO: 68444 - DNA, 614 bp, Zea mays
  misc_feature: Ceres CLONE 1544763
ggatcccccgggctgcaggaattcgtctcacccctagaaaaagtttttgtctacttagccttgcacactgaggacctttattgaggtattccttgatccccatggttctagataacaaaccatgagtttatatcattatcccctctatctcaccttatattgaacatggtttttgatactattcttctttgtgcttgaaagttgccggtctgcgagttgaatcatggcggagcacttggcttctatcttcggcactgagaaggacagggtcaactgccctttttacttcaagattggggcctgtcgtcatggggatcgctgctctcttctgcaaagagggcaactatatcaccaactcttgtgcttgctaacatgtatcagcgccctgatatgataacccctggagttgatgctcatggcctacctattgaccctaaaaaaatgcaggaccttttttgaggacttctatgaggacatctatgaagaatcggggaaattttgctgaaattcgaaaatcctgaatgttttgtgataaaccctcgcctgaccacatgatttgggaaatgtcctatgctccagtttctaggacagaaattcttagtcttcccttcaac

SEQ ID NO: 68445 - DNA, 906 bp, Zea mays
  misc_feature: Ceres CLONE 1544766-R
  misc_feature (712)..(712): n is a, c, t, g, unknown, or other
  misc_feature (721)..(721): n is a, c, t, g, unknown, or other
  misc_feature (755)..(755): n is a, c, t, g, unknown, or other
acggcactccttatccagtacagacaaactgcacgtccatcaacaaaagcggctggctcatctcattctcatcaacgagctgcatgcagcacagggactagcgggtcaacggtccaaccaggcgcggggaacaacgtgcaccggcgaccggatcggtccggtcaagtcctccatctcctgcaaccggaacgacggcaccgaaaccgaatccgccggtccgggggcccatgagccgccgcagccaccgtggacgagcggcaagcaacccgtcgcagcagcagcagcagcaggagtcgtcggcgtagctgtaaccgctgctgctactgccgctgctgctccagcaggccacgtcgtcgtcgccggaaatcgccggagattcagtccccgtggtgacggtggtggaacaagcggaggcggcggcggcggcggctgacgtagttgccggaacgacgacgacgacgggatcggtgtgtgctgcaggtgcagggacgacgacgacgctggtagtggtctccaggatgaccggcggggcctccagcgcgtcgtcgttggccgtgcaggtgtgctccgccacgtacaccaccgtgtactctgcatgggcggcggcggcggcggtggcgcccccgtcagcgtcgtcgttgttgcgctgcaccgtccgtttggcctggcagccttgcttggcgctctgtatgcacctgtagtaactcctgcnaatacgganatatatatatatatatatataaaaaaagacggcnatctccatctatggatggatatattagcggctctctcattgcctgcgtgagagagacaaagaacaaggggtgtgtcgaactgccgataaacttattaacattccattcatggatgaatggaaggagggagaaaaatttcccttacctaccc

SEQ ID NO: 68446 - DNA, 637 bp, Zea mays
  misc_feature: Ceres CLONE 1544766
  misc_feature: Encodes the peptide sequence at SEQ ID NO. 68447
acccgcggtggcggccgctctagaactagtggatcccccgggctgcaggaattcgtctcacccctagaaaaactccccgccccgcaagccgcagtcgcaccgcacggcagcaggtagctagctagctagctgcgggcttctgtagccaagcagggccggagcacgcacgcacgcacgcgagcgcgagcgcgagcgcatggcggcgtccgcgagccgggcccgcgccggcgccggcggcgctggcgaggagtacgaggacctgctgccggtgatgggcgagcggctgggcgtggcggggctgctggcggagctgcgcgcggggttcaggctgctggcggacggggagcggggcgccatcacgcccgacagcctgcagcgcggcgcggcgactacgctgggcaagtcctggatggcgcccaccaactcagacgccatggcgtccgagggcgaagccgactgcgacgggtcgatcagcaaagtccatttctgagggcacttgatgatgctgctgcacgggttactggccgatgccaaatgtctggctcgccctactccatggtgtgccatggacatgacatctggtgaaagaccatgcggagggcatgctagctagaccttgagtcctgcatggggaggc

SEQ ID NO: 68447 - protein, 97 aa, Zea mays
  misc_feature: Ceres CLONE 1544766
MAASASRARAGAGGAGEEYEDLLPVMGERLGVAGLLAELRAGFRLLADGERGAITPDSLQRGAATTLGKSWMAPTNSDAMASEGEADCDGSISKVHF

SEQ ID NO: 68448 - DNA, 611 bp, Zea mays
  misc_feature: Ceres CLONE 1544771
  misc_feature: Encodes the peptide sequence at SEQ ID NO. 68449
  misc_feature (452)..(452): n is a, c, t, g, unknown, or other
tcgtggatcccccgggctgcaggaattcgtctcacccctagaaaaaagatctcaagccaccatcgaccttctagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcntcttcccggagctgctcgcccgcaacggcctcaagttcggcgaggccgtgtggttcaaggccggctcccagatcttcagcgagggtggactggactacctcggggaacccgagcctcatccacgcgcatagcatcctcgccctctgggcctggccagtc

SEQ ID NO: 68449 - protein, 156 aa, Zea mays
  misc_feature: Ceres CLONE 1544771
  misc_feature (65)..(151): Pfam Name: Chloroa_b-bind Pfam Description: Chlorophyll A-B binding protein
  misc_feature (114)..(114): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCXFPELLARNGLKFGEAVWFKAGSQIFSEGGLDYLGEPEPHPRA

SEQ ID NO: 68450 - DNA, 615 bp, Zea mays
  misc_feature: Ceres CLONE 1544777
  misc_feature: Encodes the peptide sequence at SEQ ID NO. 68451
tccccgcggtggcggccgctctagaactagtggatcccccgggctgcaggaattcgtctcacccctagaaaaaagcgccacacatgatcctctccacaccaatgagatgtacgtggaggagcacccatggcttcttcggtggccgccgcggcaagcacattcctgggcaaccgcctggcggacccggcgccacagaacgggcgcatcgtggcccagatctggttcgggttgggcggcaaggcaaaccctgctccgaagaaggtggcgaagacatcgacctcctctgaccggccgctgtggttccccagcgccctgacgcccgactacctggacagctcgctggtcagcgactactgattcgacccgttcgatctcgggaaacccgtgcagaacctgcagttctagttggactcgctggaccacaacctggccaataatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtc

SEQ ID NO: 68451 - protein, 76 aa, Zea mays
  misc_feature: Ceres CLONE 1544777
MASSVAAAASTFLGNRLADPAPQNGRIVAQIWFGLGGKANPAPKKVAKTSTSSDRPLWFPSALTPDYLDSSLVSDY

SEQ ID NO: 68452 - DNA, 644 bp, Zea mays
  misc_feature: Ceres CLONE 1544778
  misc_feature: Encodes the peptide sequence at SEQ ID NO. 68453
ctccccgcggtggcggccgctctagaactagtggatcccccgggctgcaggaattcgtctcacccctagaaaaaaccgaaaaactagcaaaccctacctcctctcctcccctcccctcctcggcggcggaatgtccgaccgccgccgcgacaaggagaagccccgcgaccgcgacatcgaccgtcatcgcgaccgagaccgcgacatcgaccgtcatcgcgaccgagaccgcgaccgggaccgggacagggacagggatcgcgagcgagaccaccgccgcgagcgcgagcgcgagcggaagcgctcccgctcccggtccccgtcggcggatcgggaccgctcccaccgccgccactctcattcgcaccgaggccgtccttccccctctcccgacgccggccgccacaagcgccgccgcgaggcgtcccctgcctccgcggaccatcaccataaggaggataagaaggctgccgactctcacgcgacacccggcggaggggacatcgcgggccgcggccgctggggtgggtgacggcgacgtgaatgcggaggaactggagatggatgaatatgatggggcattcccgcccggtttcgacttcccccaagggggaaacacgtggcccaacgccgaacttcggcgg

SEQ ID NO: 68453 - protein, 133 aa, Zea mays
  misc_feature: Ceres CLONE 1544778
MSDRRRDKEKPRDRDIDRHRDRDRDIDRHRDRDRDRDRDRDRDRERDHRRERERERKRSRSRSPSADRDRSHRRHSHSHRGRPSPSPDAGRHKRRREASPASADHHHKEDKKAADSHATPGGGDIAGRGRWGG

SEQ ID NO: 68454 - DNA, 713 bp, Zea mays
  misc_feature: Ceres CLONE 1544779
  misc_feature: Encodes the peptide sequence at SEQ ID NO. 68455
  misc_feature (30)..(30): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
tttcctttaataaatttttttataaacagncatggttcgtctttntttgtttnnnnttataactggagctccccgcggtggcggccgctctagaatagtggatcccccgggctgcaggaattcgtctcacccatagaaaaaaatcgtcacaacgcgtcctcgaataaagatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaagaggaggagaggctgcgatacctcaagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctccagttcatcgaccgcaaggttggtgagtccgttgatgagatagaccgccgcgtcccttccgtggggaaaggaagccccaaccttggcccggctcggctggcgaaaaaagttcgccaaagcagatctggaggggccgggccactgggccttgccatgtcaaacag

SEQ ID NO: 68455 - protein, 153 aa, Zea mays
  misc_feature: Ceres CLONE 1544779
  misc_feature (29)..(149): Pfam Name: REF Pfam Description: Rubber elongation factor protein (REF)
MADSATNDAPLVASNQPTEEEVTVERAAATEEQEEERLRYLKFVQQAAAQALVLAAAAYAYAKQGAGPLRPGVDQVEGTVKAVVGPVYDRFHAVPLDLLQFIDRKVGESVDEIDRRVPSVGKGSPNLGPARLAKKVRQSRSGGAGPLGLAMSN

SEQ ID NO: 68456 - DNA, 635 bp, Zea mays
  misc_feature: Ceres CLONE 1544783
  misc_feature (189)..(189): n is a, c, t, g, unknown, or other
  misc_feature (265)..(265): n is a, c, t, g, unknown, or other
  misc_feature (266)..(266): n is a, c, t, g, unknown, or other
  misc_feature (396)..(396): n is a, c, t, g, unknown, or other
  misc_feature (534)..(534): n is a, c, t, g, unknown, or other
  misc_feature (573)..(573): n is a, c, t, g, unknown, or other
  misc_feature (575)..(575): n is a, c, t, g, unknown, or other
  misc_feature (580)..(580): n is a, c, t, g, unknown, or other
  misc_feature (583)..(583): n is a, c, t, g, unknown, or other
tcccccgggctgcaggaattcgtctcacccctagaaaaaggtgtagtttttcaagcaagacaagatctcgctgctggaatcgctggatgaaaaggattgcctttacaattccatgtgcgcgctgctgtggtggtgtggttcgaccacaaaacatgtggctgggttcatagagccacagaaatacacgcngcggcgcatcctgcaccctctctcaccgactttccttgggggtttaaaaaaaaacagctctgttttttaattgtgnnttggtttaaaaacttgttgggtttgggggggcccaaaaaaaaaaaaaaaaaagaaagagcgccgggggcccccatccccccccaaaggaggagaataataacgcggccctcagtgggctttttttttttnaaactcgtggtcccaaaaaaaaaacggggggctacacccaattaacccgctggggaaaaaacccctcttttttttccaggggggggaagaaaaaaaaaagaagaccccccctcctgcgccctttctccttataccaanatccccccccccccccgggggtggggagtgaaaaggagntnagtgntcnttcgcgacggcacacagacatactctatggtagggagagcatgcaagctcgg

SEQ ID NO: 68457 - DNA, 832 bp, Zea mays
  misc_feature: Ceres CLONE 1544786
  misc_feature: Encodes the peptide sequence at SEQ ID NO. 68458
  misc_feature (48)..(48): n is a, c, t, g, unknown, or other
tgggaggagaaacggaggggcccgtgcgggggccaagggctcctcttntgtctacctgtagctcctccgcgttggcggccgctctagaactagtggatcccccgggctgcaggaattcgtctcacccctagaaaaagaaaccctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttaggctcttaatcctcgatctcgactttcctatcagtgcgagtgtaccacggctccgcgcgaccgaactgactccttcaatgtcgtccgatcgtgcgctctacgacgcgcctggatgtggtggctttttttttttcctcccgcccctctcccctcacttggggcgggggggggggaggggcgtactcgccttcctacctcttaccgcctccatacagaactgaagaaatcccactcgccccaccacctcgggtaatttggccgccaaaaattcacagatggtcgtcacgtacatacatcaggccgcttcatccccgcccgcttctctaaattcatagatatcggatgaccaccttcgatcacccgcgtcaatcgttcggcccg

SEQ ID NO: 68458 - protein, 60 aa, Zea mays; identical to SEQ ID NO: 195
  misc_feature: Ceres CLONE 1544786
  misc_feature (3)..(42): Pfam Name: Ribosomal_L29e Pfam Description: Ribosomal L29e protein family

SEQ ID NO: 68459 - DNA, 733 bp, Zea mays
  misc_feature: Ceres CLONE 1544796
  misc_feature: Encodes the peptide sequence at SEQ ID NO. 68460
  misc_feature (1)..(1): n is a, c, t, g, unknown, or other
naattctggagctcaccgcggtggcggccgctctagaactagtggatcccccgggctgcaggaattcgtctcacccctagaaaaaaatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcccttcagtagggggggggcatggttctagttgtatttgaatccagcgtttgccactaagataaatcagacattcgttttgtgaacctattatgatggagctttatttgctgataatatctacctacccatttgagctgaaaaaaaaaaaaaaaacaagacgctcgaggacccccattcgcccctaagggaggccgaattacccgcgcctcactggccggccgttttacaacgccgtggactggggaaaaccctggccgtttcccaccttaaatcgcctttgcggcacgatcccccctttccccagctgggggtaaatagggaaaaaggccccccccatttggccccttcccaaaatgtgccccgcccggag

SEQ ID NO: 68460 - protein, 48 aa, Zea mays
  misc_feature: Ceres CLONE 1544796
MTCVGTYISSDALVCLWRDVNLPWCHGPPSVERLACPSVGGGHGSSCI

SEQ ID NO: 68461 - DNA, 703 bp, Zea mays
  misc_feature: Ceres CLONE 1544800
  misc_feature (655)..(655): n is a, c, t, g, unknown, or other
ccgcggtggcggccgctcttgaactagtggatcccccgggctgcaggaattcgtctcatccctatgaaagactcggaaagtaagtggaggtgatttaccagacgactgattcctacatcctcattcccctcctcgcttgggttagactgtgggattactgctccctcatccgtacccgattccttttccttacggcgccggtgtgctgctgagatgggaaaattgagatcgggagtgtctgtttatgactagtgtttgctgaaattccgaaagttagttaccaggaggctggaccacttctgagctttctagatggttccacgagttcaaggagatcgttgtggacgctctagggaatcgttctccctatagcgagacttattacacaggctccctgagaatgactgtccatacgcgatctatgattaccactgtgtcactgcagattatgtccctaggagcacgatcttctatatcctatgggccccatactcaaccaaggtgaacagatagatgcttcatgcagctgccaccctgattggcgagtggacttgtgagattcaggtggatctgcaggctcctgatgcatgtgaatcagccttgattatatcaagctctggctcgatatcggtcacatgctcatgatcatggacanggaccaatactggggatatggatgccccatatgtacgagatgcacata

SEQ ID NO: 68462 - DNA, 768 bp, Zea mays
  misc_feature: Ceres CLONE 1544802
  misc_feature: Translation starting site: 378
  misc_feature: SWISSPROT Homolog: EC 3.2.1.23 Beta-galactosidase
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
ttaccttttctattcttgtgtgttttttnnntancggnnnnngnaaaaattggaactccccgcggtggcggccgctctttactagtggatcccccgggctgcaggaattcgtctcacccctcgaaaaattttccatggagaggagagagtggtgtttccatacgggttggatcaatttttcatgcttgttcttgtcggagcctcgatgaggtttcccttataatcggcatatgctgctggataattatgtacttgcttataccgttttgagccttaaaaaccgtcacgacgttgcgcactagccgtcagccgcaaagagcggcggcggaaaaaaagatgaacaaacgacacgctcgaggtacccaattctccctataatgagtcgtattacgcgcgctcactggccgtcgttttacaacgtcgagactgggaaaaccctgtgcttgcccaacttaatccccttgcagcacatccccctttcgccagctggcggaatagccaataggcccccaccgatcccccttcccaacagttgcgcagcctgaatggcgaatggaaattgaaagcgttaatattttgttaaaattcgcgttaaatttttgttaaatcagctcatttttttaaccaatgagccgaaatcggccaaatcccttataaatcaaaagaatagaccgagatagggttgactgttgttccactttggaacaagagtcccctattaaagaccgtgcgactccacgtcaaatggcgaaaaaccctctatcaagg

SEQ ID NO: 68463 - DNA, 874 bp, Zea mays
  misc_feature: Ceres CLONE 1544807
  misc_feature: Encodes the peptide sequence at SEQ ID NO. 68464
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (874)..(874): n is a, c, t, g, unknown, or other
ttttgttcttcttacatctctccttnnnngggccccnnnnnnaacctctcgactccccgcggtggcggccgctctagaactagtggatcccccgggctgcaggaattcgtctcacccctagaaaaaaaaaaattagaagacgatgctgccccgcttgccaatccgcctcgcgccgccgctcgccggcgtccttcgcggcatctgcgctaccgcgctgccgcaatccaagcccccacctcaacccctctccccgtccgacctggacgcgatctccgcgctcctcccgcgcctcctctacgcgggccacgtccccgccgccggccgcctcctctccgcggcgctcctcctcccgggctcccaggacggcctccccctcgattccctcccccctaaaaaaaaaaaatatttcgaccccccccgagggaggggggggggccctattactaatttcatattactcccccccccccgggtgcgtcggattttacaacgctccttgcccgggaaaaacccctgggtggttactccaactgaagtccgccttggcaaccccatccctcccttttcggccaggttgggcggtaataactcataaaaggccaccctcgccggattctccccctttcctcataaggtgggcgtccgcacctggaattcgccgaacgtgcacatatgtctactccgtcccaacgtttcggccaaaaccgccccgttaaaacactcttgcttgaacccccgcactgttctttttatatcctaggaggctggaaactcgtcgtatcattcccctcgtgtacgtccaatcggcttctggtctcgtgcgagcgttacgcggaggtgcattgccctattatgccgccctgcatctctctcn

SEQ ID NO: 68464 - protein, 150 aa, Zea mays
  misc_feature: Ceres CLONE 1544807
MLPRLPIRLAPPLAGVLRGICATALPQSKPPPQPLSPSDLDAISALLPRLLYAGHVPAAGRLLSAALLLPGSQDGLPLDSLPPKKKKYFDPPRGRGGGPITNFILLPPPRVRRILQRSLPGKNPWVVTPTEVRLGNPIPPFSARLGGNNS

SEQ ID NO: 68465 - DNA, 596 bp, Zea mays
  misc_feature: Ceres CLONE 1544810
  misc_feature (268)..(268): n is a, c, t, g, unknown, or other
gcggtggcggccgctctagaactagtggatcccccgggctgcaggaattcgtctcacccctagaaaaattgttgcccttcttgtggttggagttgctgctctagtgctgcattatcaccgctccaatgccaacctatgaatttgaatcatggaacatcagcatgcttaaatgtagctctagtggtcagtggcagcattggcttcgtccttggagtagttcaccagcatttgcttgcattggactggaatagaaatcgagttcctcggncttatctcactggggatttactggaaatacattttttgcgaccactgattcccagttatctccacttgttttttttttgggggggctggaacaaaaatataaagtttttcccccctccttttgaaaccccccaaggggcccccaccaaaaggggggggcgctccttttaaaaaaaaaaaaaaaaagaaaagccccgggggacccctttccccccaaaaagaggtaaaaaaaccccccccccccgcccccccctttttaaaacaacgccggcgggaggaaaaaaaaaacgcggggtttacacacaacaaaaaaaaaccccccgggcaga

SEQ ID NO: 68466 - DNA, 857 bp, Zea mays
  misc_feature: Ceres CLONE 1544815
tctttgttggcgtcgtccgcttttccatagcgaatcattctacaaaacacacaccccccgcgttcgtggccgctcttttctagcggatcccccgggctgcaggaattcgtctcacccctagaaaaactcgatgagatcaaggatcgggcacgctaggcgcaccgccatcgcgagtttcatggtcacgcatcatggactcgcctactactgtggatttgtacgccattatagacttggtgctgctaaagactgctttggtgatttgtgggtttgttgctgtgtaaaaagatcctcatggcttccataataccatgaaggtttggatctatactgtaattccctgttacccgccaattatgtatggactatggacatgtgttgcgctgttcaattccctacgaagaagtaatcgacatgtccgctactcagaggacctaatagtcgctagattgtctttgcccccccctctcctcttatactgaggcgtcatttcatcccgcttcattggcccggcgatatgcagagcgtccacgactagaagaaaatccggcggttacaacattgttattaatgcttgcaacagcttcgtaccctgttcggccacgttggctgctaactatccaaaaagggtcctaaagcgtataactcctatcggcgacactagtagatgcatggtctggaacatgttctgagagcgaaagactagtcgcgcgcattgaaggactttgccatacgaaaccaccttgtcatgataggctagagaatgacagtgcttctaggttagatctacgctttgtcggtcgtatactcgctgtctgtaattccgcctatttacatccacacgcgcatgaccgggg

SEQ ID NO: 68467 - DNA, 656 bp, Zea mays
  misc_feature: Ceres CLONE 1544819
  misc_feature: Encodes the peptide sequence at SEQ ID NO. 68468
caaagctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatcccctcccgctgggccatgctggggcgcgctcggctgcgtctttcccgagctgctcgcccgcaacggcgtcaagttcggcgaagcccttgtggttcaagggccggtcccaaaatctcaccgaggggcgggctggactaacctcggggaacccgagcctcctccacgcgcagaaaatccctgggtattctggggctggccg

SEQ ID NO: 68468 - protein, 146 aa, Zea mays
  misc_feature: Ceres CLONE 1544819
  misc_feature (65)..(143): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIPSRWAMLGRARLRLSRAARPQRRQVRRSPCGSRAGPKISPRGGLD

SEQ ID NO: 68469 - DNA, 653 bp, Zea mays
  misc_feature: Ceres CLONE 1544822
  misc_feature: Encodes the peptide sequence at SEQ ID NO. 68470
  misc_feature (389)..(389): n is a, c, t, g, unknown, or other
  misc_feature (653)..(653): n is a, c, t, g, unknown, or other
tggagctccccgcggtggcggccgctctagaactagtggatcccccgggctgcaggaattcccctaaccccgagaaaaaaaagcgaagcagcgaccagcaaagtgatcagtgtgatcgatcacacactgccatggccgtcatgggcaaggaggaggaggagcagcagcatcaccacaaggaggaggaggtggtccaaggagatgtgcgagtcgtcgtccagcaggagacggcggcggacgaggaggccgagtcggcgctggtgcgcaagatctccggcctggccgccgccatcgccaggctgccgtcgctgagcccgtcgccggaggtgaacgcgctcttcaccgacctcgtcacggcctgcatcccgcgcagcaccgtggacgtggancgcctgggcccggagctgcagcgcatgcgcgcgggcctcatccgcctctgcgccgacgccgaggcgctgctggaggcgcactactccgacctgctggccgccttcgacaacccgctggaccacctgcccgctcttcccctacttcaccaactacctcctggctgagccagctgggagcacggcctgctgggcgcgccacgtcccggggcccccccccccttccgggttggctttggttgggttccgggccgcttcccggttaan

SEQ ID NO: 68470 - protein, 140 aa, Zea mays
  misc_feature: Ceres CLONE 1544822
  misc_feature (35)..(141): Pfam Name: NAS Pfam Description: Nicotianamine synthase protein
  misc_feature: SWISSPROT Homolog: EC 2.5.1.43 Nicotianamine synthase
  misc_feature (86)..(86): Xaa is any aa, unknown, or other
MAVMGKEEEEQQHHHKEEEVVQGDVRVVVQQETAADEEAESALVRKISGLAAAIARLPSLSPSPEVNALFTDLVTACIPRSTVDVXRLGPELQRMRAGLIRLCADAEALLEAHYSDLLAAFDNPLDHLPALPLLHQLPPG

SEQ ID NO: 68471 - DNA, 638 bp, Zea mays
  misc_feature: Ceres CLONE 1544826
  misc_feature: Encodes the peptide sequence at SEQ ID NO. 68472
tggagctccccgcggtggcggccgctctagaactagtggatcccccgggctgcaggaattcgtctcacccctagaaaaaagctcgtgctagcccttcttggcaagaaacggtttgctatggccgttcttgcgctcaagcttggtttcgtggctccgcctcatcctaggaccagcagcggcaggttcgccttctcccccacgtcctcccgcgccgtcgccaacgcgggggtagctgcaggaccctcgcgcccgatcaccgtcgacggggacccgcccaccgtcgtctccgcgcccggccgccgcattgtcgccattggcgatgcccacggtgacctctcccagacgagagccgcgctggtgctcgccggcgtcctgagcacggaatcagagggccacgtgtggacaggcggacgcacgatacttgttcaagttggtgacatacttgatcgtggtgaagatgaaattgccatactctcattgttgagctcactcaacatgcaagccaaatctcaaggcggtgctgtattccaggtcctagaaatagtcaatgacagaccaagggttttgaaggagcggagagaattatatgatgagatggaagtgttggactatttgtaaaaccttgagaaacttatgta

SEQ ID NO: 68472 - protein, 166 aa, Zea mays
  misc_feature: Ceres CLONE 1544826
MAVLALKLGFVAPPHPRTSSGRFAFSPTSSRAVANAGVAAGPSRPITVDGDPPTVVSAPGRRIVAIGDAHGDLSQTRAALVLAGVLSTESEGHVWTGGRTILVQVGDILDRGEDEIAILSLLSSLNMQAKSQGGAVFQVLEIVNDRPRVLKERRELYDEMEVLDYL

SEQ ID NO: 68473 - DNA, 696 bp, Zea mays
  misc_feature: Ceres CLONE 1544828
  misc_feature: Encodes the peptide sequence at SEQ ID NO. 68474
gcggtggcggccgctctagaactagtggatcccccgggctgcaggaattcgtctcacccctagaaaaactccacaaccatccgtcccgacccgaccagctttgagatcgcgatggcggacggccgctgctgcaccttcctggagatcctcatcgccatcatcctcccgcccctcggcgtcttcctccgattcggctgctgcagaatagagttctacatctgcctgctgctcaccatccttggctacgtccccggaatcatctacccgatctatgtccttgttgctctcgactctgaccagcacgagagggaatactacacccttgcttacagcatctggttgtgccaggcgagcctgcacagttgactcaaaatcaagtattttgttttctcacgtcgattgtctgacatgacataaaccgccatgggtaaccaagtgttgtggtctatatctctgttacccaacttgtgagctctctttatagtgctccaggttattcaatctgtaattgagatactacaacagaataagatgcgcatgtatctctgacataacaaaacaaaaacagacgaggcgctcgatgtacccaattcgccctatagtgagtcgtattacccgcgctcactggccatcgttctaaacggcgtgactggaaaaaccctgccgttacccacttaatcgccttgcaacagatcc

SEQ ID NO: 68474 - protein, 84 aa, Zea mays
  misc_feature: Ceres CLONE 1544828
  misc_feature (7)..(58): Pfam Name: UPF0057 Pfam Description: Uncharacterized protein family UPF0057
MADGRCCTFLEILIAIILPPLGVFLRFGCCRIEFYICLLLTILGYVPGIIYPIYVLVALDSDQHEREYYTLAYSIWLCQASLHS

SEQ ID NO: 68475 - DNA, 626 bp, Zea mays
  misc_feature: Ceres CLONE 1544840
  misc_feature: Encodes the peptide sequence at SEQ ID NO. 68476
  misc_feature (394)..(394): n is a, c, t, g, unknown, or other
atagctggagctccccgcggtggcggccgctctagaactagtggatcccccgggctgcaggaattcgtctcacccctagaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccaccacatcagcggggtgatcctcttcgagganaccctctaccagaagaccaaggatggcaagccttttgtcgatgtcctcaaggagggaggcgccctccctggcatcaaggtcgacaagggcaccattgagggtgttgggccccgaccaggagacccccacccagggccacgatgacctcggcaagcgctgccctaatactaacgagcccgggccccgttttggcaaggggcgtggttgttctcaagatttggccccaacgaac

SEQ ID NO: 68476 - protein, 124 aa, Zea mays
  misc_feature: Ceres CLONE 1544840
  misc_feature (11)..(125): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (77)..(77): Xaa is any aa, unknown, or other
MSAYCGKYADELIKNAAYIGTPGKGILAADESTGTIGKRLSSINVENVEENRRALRELLFCCPGALHHISGVILFEXTLYQKTKDGKPFVDVLKEGGALPGIKVDKGTIEGVGPRPGDPHPGPR

SEQ ID NO: 68477 - DNA, 945 bp, Zea mays
  misc_feature: Ceres CLONE 1544841-R
  misc_feature: SWISSPROT Homolog: EC 3.6.3.14 H(+)-transporting two-sector ATPase
  misc_feature (861)..(861): n is a, c, t, g, unknown, or other
ctcgagcgtctcgtttttttttttttttttagtaccgaggaggccgagggagctcagcaagagaccaccgcagctgaagatatttgacgacatgtgcctttattacagtaacagtagccccattttacaaattacatggtgatcgtgatccatctacttccagtctcctcaaaagctacattattgatcggcttatatatccaatatataaattacatgatcacataaaagctgacagatcaacaaagaattgctgtaacactagtaatttacagaaccattcgatcgtttcgatttacttgagggcgtaacaccagtaatgctcagacaaagtttatggtgaatgaaacgtaaggatggacctctgattcacctcccaaaccagaaactgccacgtcatcttcgcctttccaataaatactatggacattgccgcaaaggtcctctaagatgctccttactttcttctcgccctttgtagacggagcaagaacagcagacaggaacgatggtggcagaccgtatctaagaatgctctctacaaatatgcgcacggcgcataagtgcatccaggaactgaaaacctcactgtagctggcatagcaccattgcagaagcgaggtcctcataacttcctgctctagcagtaacttctccatctcctgctttctactttcgtgtgcttcaagactatactcaaaatcacgaatctggaaacccttctcgcgagcacggaccttatagttgtcaacaaccttagcaaagagtgtatgttgtagagtgcgtactcattgtcgtcatagagctgcttagatgacctgggtacacaaatgtgtcgagtgattcatagcttgacacagnctttttggaagtacttcggacactacctagagtgtactagatgctctgagcaaacattccatctgttttacatattggaagata

SEQ ID NO: 68478 - DNA, 677 bp, Zea mays
  misc_feature: Ceres CLONE 1544841
  misc_feature (396)..(396): n is a, c, t, g, unknown, or other
aaagctggagctccccgcggtggcggccgctctagaactagtggatcccccgggctgcaggaattcgtctcacccctagaaaaatctctttcccctgcgcgcgaagctcaatcccttcctccgcgccgcccctgcgtactcgtctctggcgctgttcagctcaaaaaaaatctctcagccgctcatccctatctgttcagccagcacaagattttcctatgtcagtcgttctcatcctctccgcagccactgtacctgactgcgtgatatttttgccgccgccctgttcgttttatatgcgcgcagctcgccggccgtacgctcgccggagcccttcccctgctcggcctctgaggtttcccagtacccccccctaggaggggggggggggggagnttgcttcctccctctgccgctcgtctccatctctccatctcccaaaaaaccgcgccagctccaggccatgaccgccaacttcctctcctcgggcttgatctcccagccctccgctccctggaaaccttaccccaattttttgtgaaaggtcccggataggaaaaactttgcaaaggcccaccggctctgggccccctttttcccccctggttctattccccttattttggggccctacaatttggccctccggggagggaggttctaaatcaactcttttc

SEQ ID NO: 68479 - DNA, 808 bp, Zea mays
  misc_feature: Ceres CLONE 1544842
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gtttttttnnnnnnnnnnnnggcccgtgtattttcttaaggcccaannnaataacctataactaccagcggtgtccgggggtctatactattggatcccccgggctgctggaattcttcctccccctagaaaaatctctctagggtttttgattttagccgccgccgctgctcctctcacatccctcgagaaaacgcctgctcctcgccgatcgatacgatggccgtcttatccgacctccacaccgccgacagtctcaagtccctctaggctcacctcgccggcaaaacctaaagtatatggggactcccattataaagatgaaattaaggtcttcgcctctgcgccccggaaatctggcgctgattttcttttctaattccttactgctcctatacattttttttttttttttccctctagttggggggggggggtggcttataaccaactccttttttctgtcccaccacacaatcgtcctcattgctaattccttcttctcctgccgcccaccctatcactatttttaatacttttgtctaggtgtgtcattttcgcacatcctaatacggtttccttaatttatcacttcccttcctcctacttatagtttactttcacacacctcctactttatccgtcctcaacacttctactctctttatccacaccatttctttaattgctcttaaaaccatcccataaactcctcatcatctatctccctcaactcacatcccaactcgcctatttttcttctccacccttcctgttctcctcttccgctgctcatatactccaacat

SEQ ID NO: 68480 - DNA, 645 bp, Zea mays
  misc_feature: Ceres CLONE 1544844
  misc_feature: Encodes the peptide sequence at SEQ ID NO. 68481
aagctggagctccccgcggtggcggccgctctagaactagtggatcccccgggctgcaggaattcgtctcacccctagaaaaaactcggcccattccaagtcccaccttgcgtacgtgagccaaacgctcctggtcctggcagtctccatctccacctagggttccggcgatggtgcacggcggctacccgcgccgcgacgccgccgtccgccggcccaagtcctcgtcctccgccgtagttgccgaccgcaagcggaagtggaccgccgccgccaagaacacctcacttaaaaaccagatccgttccactgagcgctttctccacaaggtacttaccgacacctgggggctggggtcttctcgactgaactcggaacctctagtttagcgttgttcctacccagtggatgggctttggctgttgcttgtggagcgctgggtgtttctctaggaacctctccattttctagttgattgggaagcttccccgaacgtagctaggaattttagcacgaaagtctttctacaatgatgaattgttcaaccacaaatatttatttacttgttgcttctgtagggggctaggggcaaattgatgcttcaactgaggcctctgtttgttgcattccgctcagtagcctaat

SEQ ID NO: 68481 - protein, 72 aa, Zea mays
  misc_feature: Ceres CLONE 1544844
MVHGGYPRRDAAVRRPKSSSSAVVADRKRKWTAAAKNTSLKNQIRSTERFLHKVLTDTWGLGSSRLNSEPLV

SEQ ID NO: 68482 - DNA, 645 bp, Zea mays
  misc_feature: Ceres CLONE 1544857
  misc_feature: Encodes the peptide sequence at SEQ ID NO. 68483
aaagctggagctccccgcggtggcggccgctctagaactagtggatcccccgggctgcaggaattcctctaaccccgagaaaaaatagttttaccctaacgaggaacgcgccgcgatagtaattcaacctagagtcggccagaacaatccagcgagctcgaaaaaaagggtacgaataggaaccccaatccagggccggagggcgaacgaactcaaaagcaagccgttccagtccaatccgccccagtccaaatctaatcgccgggtttaggcacaaggggcgggacgcggcgaggtttagtcggggtttgttttgtcccttccgtgcgattctgctctccgcgcgggaggcaagtactgtcggacgccaacaccaaggcggaggaggggggtccccggcggtggaagtggaacgcgccgatgcgcaagtttcatgactccatcaaggccctccaggccgacatcgatcacgccaatgcgatggcgtcggaattcctgagggactacgacggctcggtcatcccaatgcgggtggcgtacagcggccgtcgcgcatttcctccctgcaagggaccgactggtagctcgccggcgcgctcgggctcctaagggtaaggcatacaagggggggcccggaaagctcct

SEQ ID NO: 68483 - protein, 62 aa, Zea mays
  misc_feature: Ceres CLONE 1544857
MRKFHDSIKALQADIDHANAMASEFLRDYDGSVIPMRVAYSGRRAFPPCKGPTGSSPARSGS

SEQ ID NO: 68484 - DNA, 628 bp, Zea mays
  misc_feature: Ceres CLONE 1544863
  misc_feature: Encodes the peptide sequence at SEQ ID NO. 68485
aagctggagctccccgcggtggcggccgctctagaactagtggatcccccgggctgcaggaattcgtctcacccctagaaaaaccccatcagccatcccctcccgcggcaagtctctctgaattgtgggtctccggcgatggcggctcttgctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcatcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggtcgtctgtgtcaagaccggagccctgctcctcgacagaaacaccctca

SEQ ID NO: 68485 - protein, 163 aa, Zea mays
  misc_feature: Ceres CLONE 1544863
  misc_feature (83)..(163): Pfam Name: Chloroa_b-bind Pfam Description: Chlorophyll A-B binding protein
MAALAPSKILGTKLNFAGSSRYATAAPTAGAQKIVSLFSKKPAQKPKPSAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEVVCVKTGALLLDRNTL

SEQ ID NO: 68486 - DNA, 814 bp, Zea mays
  misc_feature: Ceres CLONE 1544865
  misc_feature: Encodes the peptide sequence at SEQ ID NO. 68487
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (814)..(814): n is a, c, t, g, unknown, or other
tttttgtttggnggcccccnnnaactactnnttnnnnnnnnnnnggtgttttnnnnaaaaaaaatggagctccccgcggtggcggacgttctttactactggatcccccggggtgcaggaattcctctcacccctagaaaaatacttaggacaaatggcgcaacatgaatgtaattgtcacttcatcgagtactcgtgacagggggagaacttcttcgaggagaaaccgagctgctcctaagaataatgaccaattgtgggcaatgagcacaatcacttctgaggttgatgaagagattgttgatgttaaaccccatagtatccaggtctgttgagggttgttccacctaaaatggggaaaaatctccccccacatctttctctttcaaaaagggaacgctataaagaagtattattttttttccccccctaaaggaggggaagaaggggggggcgcctcccccccccccaaccaactcccccccccccatagataaaaaataaatcaatttaacaggagacggaggacgccgacacacactatacaaagacccgtgataataattaattttatatacaggcattaacatccttttattcacctcaacataccaccataattcaactcccacagatccacactcgacaaagataaatccctcatacgaacacaaccacacattagtataaagtagagcaccctccatctcctcccccggaatctatcacaatcaatcgacccgctctatgctgcttagtgaccatcgtgatagcggtgaacattgattgccccgtcaagcactctatccagctn

SEQ ID NO: 68487 - protein, 56 aa, Zea mays
  misc_feature: Ceres CLONE 1544865
MNVIVTSSSTRDRGRTSSRRNRAAPKNNDQLWAMSTITSEVDEEIVDVKPHSIQVC

SEQ ID NO: 68488 - DNA, 643 bp, Zea mays
  misc_feature: Ceres CLONE 1544866
  misc_feature: Encodes the peptide sequence at SEQ ID NO. 68489
aagctggagctccccgcggtggcggccgctctagaactagtggatcccccgggctgcaggaattcgtctagccccgggaaaaaatatcccccgacgcctcgcttcctcccgttccgtcgccgccgcgcgcctcggagaagagatagaggcggccgctgcatcgacctcgcgccacctccgcctgcctcccccggcaccgatcggtacggccacctccctcgattcgattggctctaactacggaaccctaccctaggttcgatttgatctgtggattttgggggattttgtttagggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggttttccacccgaacatcaacagcgacggcagcatttgccttgacattcttaaggaacagtggagccctgctttaactatctcaaaggttctcctgtcaatctgctcactgctcacggaccc

SEQ ID NO: 68489 - protein, 112 aa, Zea mays
  misc_feature: Ceres CLONE 1544866
  misc_feature (5)..(112): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPVGEDMFHWQATIMGPSDSPFAGGVFLVNIHFPPDYPFKPPKVSFRTKVFHPNINSDGSICLDILKEQWSPALTISKVLLSICSLLTD

SEQ ID NO: 68490 - DNA, 669 bp, Zea mays
  misc_feature: Ceres CLONE 1544870
  misc_feature: Translation starting site: 146
  misc_feature (1)..(1): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (408)..(408): n is a, c, t, g, unknown, or other
  misc_feature (409)..(409): n is a, c, t, g, unknown, or other
naaagctggagctccccgcggtggcggccgctctagaactagtggatcccccgggctgcaggaattcctctcacccctagaaaaaaaaacgccacttgttctccctccctctctgcctgaccagctaggatcagcggaagcagcaatggtgatggcgtcgtcaagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctctacgggtcctctcccggggacttcggcttcaattcttttggcccccccccccgggggggggggggggggtnnntttcnnnnattcnnattttttcccctgccccctgggcaatgcttgcccgccccggggatggggggggccggaagctctggggcctgggcaactgggtgaaaaggcgcaggattggggccgcccttccccccacgggaagggcccttttcctgggggcccccggggggccggggggtgccgctgcccagcctgcccggggggttccaggtttctggggcctgtggccctctcccgaaaatccgaggggacctgggatgaagtgacccccctaatg

SEQ ID NO: 68491 - DNA, 617 bp, Zea mays
  misc_feature: Ceres CLONE 1544874
  misc_feature: Encodes the peptide sequence at SEQ ID NO. 68492
caaagctggagctccccgcggtggcggccgctctagaactagtggatcccccgggctgcaggaattcgtctcacccctagaaaaaaggggccctgcagcggcggcagctggcgggagagaggcttggcttgggactgggccgcccggccgcgaggaataaactcactcctgccttcatacgtatccatagccgcggcagtacgtgtatgtggttagctatacgcgacctcagctcgggcgcaagctacaaccccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggc

SEQ ID NO: 68492 - protein, 98 aa, Zea mays
  misc_feature: Ceres CLONE 1544874
  misc_feature: SWISSPROT Homolog: EC 2.7.7.7 DNA-directed DNA polymerase
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAK

SEQ ID NO: 68493 - DNA, 634 bp, Zea mays
  misc_feature: Ceres CLONE 1544881
  misc_feature: SWISSPROT Homolog: EC 1.11.1.15 Peroxiredoxin
  misc_feature (634)..(634): n is a, c, t, g, unknown, or other
ggagctccccgcggtggcggccgctctagaactagtggatcccccgggctgcaggaattcgtctcacccctagaaaaaatagacagcgccaaccccggaaaggcggaaacccatcgcaactaatccacaaccccaaacctccaatccacccatcccctcctcatccactccgggaggacatggcctgctccttcaccacagcgaccgtcgtctcttccgcccccaccccggccgccaggcccctcgccgctgccccgcaatccgtctctatttcccgctccgcggtcagccaccgccgccaggccactccgcctcgtcacctccagatccacacgggccatcagactcgtcgcccgagccggcggcgtctatgacttaccactggtccgaaacaaggcgacaaacttcgaacccgatgccgtgtacgaccaagagtgcatcagagtgaaactctctgattacatcgggaagaaatacccagttaagttctcccaccccttggatttcacctttgtctgccccaccgagattactgacgtcagtgacatatatgaagaattcgagaagttgaacactaaggttcttgatgtctctattgacacagtgttctcccaccttgcatgagtgcagacan

SEQ ID NO: 68494 - DNA, 677 bp, Zea mays
  misc_feature: Ceres CLONE 1544882
  misc_feature: Encodes the peptide sequence at SEQ ID NO. 68495
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (245)..(245): n is a, c, t, g, unknown, or other
  misc_feature (362)..(362): n is a, c, t, g, unknown, or other
  misc_feature (406)..(406): n is a, c, t, g, unknown, or other
  misc_feature (421)..(421): n is a, c, t, g, unknown, or other
nnggctnnnnnccccagctggagctccccgcggtggcgggcgctctataactagtggatcccccgggctgcaggaattcctctcacccctagaaaaagcattccccgtttgccttgtttaccattcctccccaaaacacatcctgggatcctcgaagcctccgccgagcatcgatcatgtcggcctactgcggcaagtacgcggatgagctcatcaagaatgctgcctacatcggcacccctggnaagggtatccttgctgctgatgaatcaactggcaccattggcaagcgcctttccagcatcaaaggagagaacgtggaggaaaaccttcttgttctccgtgaagtcctggtctggtgntttttttttccccccccccgagaggggaagaaggggggtttttntataccccctccccnaaaacccagaaaaaaaaaaaatatatccatttcctccggggggggaggggtcccccccggcagtcacggtcgtcaaaggcaccccctgaaccgtattgggcccgcacaagaaaaagcccaccccacgcttcgcaagtacccccagcatgcagacccgcccgtaaacaatccgaggcccgtggcgaccaatacatcaaaccgagtcctctcgctccccggtgaaatccaactctctttagattctcactatccacaa

SEQ ID NO: 68495 - protein, 167 aa, Zea mays
  misc_feature: Ceres CLONE 1544882
  misc_feature: SWISSPROT Homolog: EC 4.1.2.13 Fructose-bisphosphate aldolase
  misc_feature (62)..(62): Xaa is any aa, unknown, or other
  misc_feature (77)..(77): Xaa is any aa, unknown, or other
  misc_feature (82)..(82): Xaa is any aa, unknown, or other
MSAYCGKYADELIKNAAYIGTPGKGILAADESTGTIGKRLSSIKGENVEENLLVLREVLVWXFFFPPPREGKKGGFXIPPPXKPRKKKNISISSGGGGVPPGSHGRQRHPLNRIGPAQEKAHPTLRKYPQHADPPVNNPRPVATNTSNRVLSLPGEIQLSLDSHYPQ

SEQ ID NO: 68496 - DNA, 648 bp, Zea mays
  misc_feature: Ceres CLONE 1544884
  misc_feature: Encodes the peptide sequence at SEQ ID NO. 68497
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (404)..(404): n is a, c, t, g, unknown, or other
atccccgcggtggcggccgctctagaactagtggatcccccgggctgcaggaattcgtctcacccctagaaaaaactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggtacgtctgccagtccaagaacgcagtggacgaatttgtggtggcggacgaaaagaactgggacgggttgtttttttccccccccacggcgggaaatgaaaaggggttttnnnnnccntnntnnntncccncccccgaagatcacaacaagagatccacgaactggccgggggggtaccccctcaaaatcacctggctgctaaggggaaaccagaacaaccagcccccaccttgtcctcctaccataaggtatcccgtatcatccccccccgggactttcttcaagggctcctaagaaaaaaagataatgttatccagccccctcccctaaacccaacttcaccccccttactcaaaatgacaatccgggtggtc

SEQ ID NO: 68497 - protein, 146 aa, Zea mays
  misc_feature: Ceres CLONE 1544884
  misc_feature (86)..(86): Xaa is any aa, unknown, or other
  misc_feature (87)..(87): Xaa is any aa, unknown, or other
  misc_feature (89)..(89): Xaa is any aa, unknown, or other
  misc_feature (90)..(90): Xaa is any aa, unknown, or other
  misc_feature (91)..(91): Xaa is any aa, unknown, or other
  misc_feature (93)..(93): Xaa is any aa, unknown, or other
MAMETCFRAWALHAPAGSKDRLLVGNLVLPSKRALAPLSVGRVATRRPRYVCQSKNAVDEFVVADEKNWDGLFFSPPTAGNEKGFXXPXXXPXPEDHNKRSTNWPGGYPLKITWLLRGNQNNQPPPCPPTIRYPVSSPPGTFFKGS

SEQ ID NO: 68498 - DNA, 668 bp, Zea mays
  misc_feature: Ceres CLONE 1544893
  misc_feature: Encodes the peptide sequence at SEQ ID NO. 68499
  misc_feature (460)..(460): n is a, c, t, g, unknown, or other
ggagctccccgcggtggcggccgctctagaactagtggatcccccgggctgcaggaattcgtctcacccctagaaaaactcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgatgcccccttctgggcgccggggggagtgcggcacgtcgtcggaaacccggcaacgggggccttctggcgggccgcctcccttgggagatttgcgcctgtcncatgcgatccgccgcggggataccgtcccccggtggtcctctcaagtacctccgtggcaggggacccgatttcaaacctatttcaccacctggatgaacggacccggcccttcttttccgaggggagaggctttccgggttcccaatccagcaccccagaaatccctttcttggcaacgccccggttccttccgagagggaacccttg

SEQ ID NO: 68499 - protein, 177 aa, Zea mays
  misc_feature: Ceres CLONE 1544893
  misc_feature (32)..(79): Pfam Name: F-box Pfam Description: F-box domain
  misc_feature (109)..(109): Xaa is any aa, unknown, or other
MDSRVVDGAGGGADASLPADPPSPVPDPAAGGMDARLPSDLLRAVLQRLPPIDLARSACVCRAWRAVASDRAVVDAPFWAPGGVRHVVGNPATGAFWRAASLGRFAPVXCDPPRGYRPPVVLSSTSVAGDPISNLFHHLDERTRPFFSEGRGFPGSQSSTPEIPFLATPRFLPRGNP

SEQ ID NO: 68500 - DNA, 677 bp, Zea mays
  misc_feature: Ceres CLONE 1544897
  misc_feature: Encodes the peptide sequence at SEQ ID NO. 68501
tggcggccgctctagaactagtggatcccccgggctgcaggaattcgtctcacccctagaaaaaactgcatcagagcacgaccacactacccacccacctccactactgacgaccgattcccagaaagctcgatctagcgcgcgcggctgcagagtgcaaacgacgacgtacaccatggcgcggcggtccctggccctgctgctcgcgtcgtcgctcgccctgatggcggccgccgtcgcatcggcggactcgtggctctacgacaagttcaacacggacggcaccgtccgcacccagtactacgcgccggggcaggaggtggcgatgctcagcctgtaccgcacccccgggggggggggggggggggcaaaaagccccacctgtaccgcccacccccccgttccagatgaatcccaccccccggcaatctccgccggccaccgtcctctggctttctacctaacgttacgctgtatttatattttctatcttccgatccggtctgacatggcgtcccaggggccccctatctcctaggttcttttgcgagtactctagtggggataaaatccgccaccccctcgccccgccgacacggtcacgtgccccccacctactttccccctcgctcctccctggtgccaatcgcttgggtgctcccctcctccggtctccc

SEQ ID NO: 68501 - protein, 120 aa, Zea mays
  misc_feature: Ceres CLONE 1544897
MARRSLALLLASSLALMAAAVASADSWLYDKFNTDGTVRTQYYAPGQEVAMLSLYRTPGGGGGGAKSPTCTAHPPVPDESHPPAISAGHRPLAFYLTLRCIYIFYLPIRSDMASQGPPIS

SEQ ID NO: 68502 - DNA, 786 bp, Zea mays
  misc_feature: Ceres CLONE 1544898
  misc_feature: Encodes the peptide sequence at SEQ ID NO. 68503
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (475)..(475): n is a, c, t, g, unknown, or other
  misc_feature (477)..(477): n is a, c, t, g, unknown, or other
  misc_feature (505)..(505): n is a, c, t, g, unknown, or other
  misc_feature (533)..(533): n is a, c, t, g, unknown, or other
  misc_feature (666)..(666): n is a, c, t, g, unknown, or other
nnnnnnnnnnnggggnnnnnnncccacggatggtgggcttnaaccannnnnnnnnnnaatagctggagctccccgcggtggcggccgctctacactagtggatcccccgggctgcaggaattcgtctcacccctagaaaaacctcgtttcgctagggtgattcgcccagccaccgcgtcgccgcagctccgtctctcgcagccatcggtgaaggttactctcctggccccatcgcgggcgcgcgcatctcgtcttcgcaggttccagtctatatatcagagataacaccaaagaatcttagaggaggtttcgcaactgtccaccagtttatgatatgttgtgggggatcacttgcttatgttctgggaacttttatctcgtgccggactttgcctatcctcggagtggagcatgatttgcagcatctggttggcgttcttgggagtggtgaattccctagacgcgctgccccaantntgggccacccaacgtacacttcgagggnactcttggccctaagctacgcgtggaanggggtagtggatatctcttgacggaagtaaataggcattcatcgccttgggtaatcccgggatttttacggaaaagagctttcgggccgattacgcctaagccgcaagaacggctgcgcacctttttttgcancaccggcattgattagccctgggacatgttaagcacggtggggaccaacggcgactaaactggggaccacttacaaaatgagcgtttggcggggaacagcggacacgctccgatttccgg

SEQ ID NO: 68503 - protein, 74 aa, Zea mays
  misc_feature: Ceres CLONE 1544898
  misc_feature (49)..(49): Xaa is any aa, unknown, or other
  misc_feature (50)..(50): Xaa is any aa, unknown, or other
  misc_feature (59)..(59): Xaa is any aa, unknown, or other
  misc_feature (68)..(68): Xaa is any aa, unknown, or other
MICCGGSLAYVLGTFISCRTLPILGVEHDLQHLVGVLGSGEFPRRAAPXXGHPTYTSRXLLALSYAWXGVVDIS

SEQ ID NO: 68504 - DNA, 798 bp, Zea mays
  misc_feature: Ceres CLONE 1544902-R
gtggtaaattcccggccacttgattgaatcgctgcaggttcaacgctcagcaggctctctgctgtttattacccatgtggttcttatcttacgtaacttataagagggcgtccgcaccaagtgccatatctggcgccaaggctaccttggccgtgttagcgccaaatgtgcagagacagccgctcaaaacctaagcacactcctctgctccttctgatagcgattgcgattcgtcagaagagcagggaaacagtacagacatcatcagcacaccataagctgtatgtacacagggtccttgttggtaccagacgcgctcgatcagtagctccaaagactgacctcgcattcgtactcgtcctcgatccacgccgactgcccagcggccggctgcggcgggtcgataaccatcccctgcgccatgtcaaggtacccacgcatctcgaactccagcccgtcgtccaccgggtagtaagggaattcgccgccgccgaggtcgccgctccccatcgcgcagggcgccgccgccgccgcctcggccgccgcctcggaacctcccacattgcgctccccgggctgcgggcggaacagctcggccgcctccaccgcggcgcggcgtatctcgtcgtggccggcgccctgcgcgggcacgcgcagcctgcgcggcgagtcggcgaatttgaggcaggcggcgcggccctctcatcgccagctcgggccacagtcgagcgcggcgggccgccatttttgggcgggttttcaaagggtgcccaaggccaaaatccgtcttgccgggca

SEQ ID NO: 68505 - DNA, 650 bp, Zea mays
  misc_feature: Ceres CLONE 1544903
  misc_feature: Encodes the peptide sequence at SEQ ID NO. 68506
acagctggagctccccgcggtggcggccgctctagaactagtggatcccccgggctgcaggaattcgtctcacccctagaaaaaaatcggccccatcactcttccgtcgtgtcttctcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggagcggtggggcacgcggcagatgggcccgccggcggcccccggggcgcacccggagaaccaggaggcggcgcggtggaccgccccccgcggggaggaggagctgccgccgtacgtcatcatcggtgagcccgtggcggcgccgccgcctccacagcataggggcaaaggggacaaccccatggagcacatcctcgacttcttcaaaacctggagccgccaaggcccaagagctcgcctccaacatctggttccatctgaagggccgccccatccatgttcggacgccgccgaggggaaaacctaagcccccgccccgaaagaccctgtcggaagggccggtctccaaaaaacctgaacaagccgacgt

SEQ ID NO: 68506 - protein, 131 aa, Zea mays
  misc_feature: Ceres CLONE 1544903
MESKDGTHDPATTAAPPAGAPQPAMPSAETERWGTRQMGPPAAPGAHPENQEAARWTAPRGEEELPPYVIIGEPVAAPPPPQHRGKGDNPMEHILDFFKTWSRQGPRARLQHLVPSEGPPHPCSDAAEGKT

SEQ ID NO: 68507 - DNA, 676 bp, Zea mays
  misc_feature: Ceres CLONE 1544905
  misc_feature: Encodes the peptide sequence at SEQ ID NO. 68508
  misc_feature (413)..(413): n is a, c, t, g, unknown, or other
  misc_feature (417)..(417): n is a, c, t, g, unknown, or other
  misc_feature (420)..(420): n is a, c, t, g, unknown, or other
  misc_feature (464)..(464): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (471)..(471): n is a, c, t, g, unknown, or other
  misc_feature (643)..(643): n is a, c, t, g, unknown, or other
  misc_feature (644)..(644): n is a, c, t, g, unknown, or other
caaagctggagctcaccgcggtggcggccgctctagaactagtggatcccccgggctgcaggaattcgtctcacccctagaaaaaagcttcgttgccctccaaagttccaaaaacaagaagcccagaaaacaaaaggagcagcttcgattcgagatcgcggcgccatcgaccatgcagctcaagaatcgccgcgaagccgtgacggcgacagtgctcgtggccgtatcagtcctggcgaccctggcgcgcaccgacggcgccctctgcgacaagtccgacaaggcagccttgcttgccgtgaagtcggcgctgggcaacccactggcgctctccggctggaactccaccgtggcctgctgctcctgggagggcatctcctggaaggcaccaccggccgcgtcaccgacctgancgtnttnaagctcaaatcatcgggccggtcccgggcgccatcgccaacctnannnngntgcaaagcgtcaacctgggcctacaaccagctggtccggcagccatcccgggcgttcctggggcccccggcgggctggccgggacctcacctttccccccgcctcgaagggaaaccggcgtctcgggggggccatccccgcccacgggaggaaccggtcttaaaacctccgnncctggggggggagaaccggccgcccagggcgg

SEQ ID NO: 68508 - protein, 79 aa, Zea mays
  misc_feature: Ceres CLONE 1544905
  misc_feature (33)..(71): Pfam Name: LRRNT_2 Pfam Description: Leucine rich repeat N-terminal domain
MQLKNRREAVTATVLVAVSVLATLARTDGALCDKSDKAALLAVKSALGNPLALSGWNSTVACCSWEGISWKAPPAASPT

SEQ ID NO: 68509 - DNA, 646 bp, Zea mays
  misc_feature: Ceres CLONE 1544909
  misc_feature: Encodes the peptide sequence at SEQ ID NO. 68510
ctatctggactccccgcggtggcggccgctctgaatagtggtcccccgggctgcaggattcgtctcacccctagaaaattcttgcgacattcatttgagtattcacttcatcatactcatatatgtcttccatgtagacttctccaatggtattattgcttttgctcccctgtgccttgcggctttaattctgttggcgatgtgtttgcgattgcaaattgagaagaatccgtagaacagtaaaggaatactcgttcactatttataggcacaggacacagcctgtgagcaattacaatcatacccctcataaaagtttcccacaacgactcaaacacttatggactaaaagtcattctacttttaatcgcctcctaattccgaagcttccgaacggacccttcggcatcctgtatacagttcaccgaactgtttctcctgcagaccttcgggacgaacatagtcccacattatccccttcacggtgctagatcatttttcgtaacgagcttgatccgtgaaaaaagtctcttaggcttccggaatcccaaaggtccgaaaaacccccttccctggagcttcgttgtccaaaaaaacttatttcatttgccccgagcgccgatagacggtccccaaccactgggaa

SEQ ID NO: 68510 - protein, 73 aa, Zea mays
  misc_feature: Ceres CLONE 1544909
LSGLPAVAAALNSGPPGCRIRLTPRKFLRHSFEYSLHHTHICLPCRLLQWYYCFCSPVPCGFNSVGDVFAIAN

SEQ ID NO: 68511 - DNA, 672 bp, Zea mays
  misc_feature: Ceres CLONE 1544911
  misc_feature: Encodes the peptide sequence at SEQ ID NO. 68512
cagctggagctccccgcggtggcggccgctctagaactagtggatcccccgggctgcaggaattcgtctcacccctagaaaaaaagttcagtgcccccatacttccgtcgcggcggagatcgagtcgagcgcccgccacggcgatggcggctagagtcctgccgccgccgccgctccctctcgtactcctcttgctgctgctcccgctctcagcccgggacaccgtcgccgcgggcgaggatttcccacgcgacgggcgggtgatcgacctcgacgagagcaacttcgaggcggcgctgggcgtcatcgacttcctcttcgtcgatttctacgcgccatggtgcggccactgcaagcgtcttgcgccccagttagatgagggtgcgccaatgttggcagggttgagtgagcccattgttgttgccaaagttaatgctgataaatacgggaaacttggatcaaaatatggagttgatgggttccctaccctcatgctttttatccacggtgttccaattgaatacactgggttcgaggaaggctgatcagcttgtccgcaatctgaaaaagtttgttgcgcccgatgttttctttccttgagtcacaactctgcgataaagaactttgttgagaatgccgggtcaaaccttttcctatgtttcctggggtttg

SEQ ID NO: 68512 - protein, 133 aa, Zea mays
  misc_feature: Ceres CLONE 1544911
  misc_feature (39)..(132): Pfam Name: Thioredoxin Pfam Description: Thioredoxin
  misc_feature: SWISSPROT Homolog: EC 5.3.4.1 Protein disulfide-isomerase
MAARVLPPPPLPLVLLLLLLPLSARDTVAAGEDFPRDGRVIDLDESNFEAALGVIDFLFVDFYAPWCGHCKRLAPQLDEGAPMLAGLSEPIVVAKVNADKYGKLGSKYGVDGFPTLMLFIHGVPIEYTGFEEG

SEQ ID NO: 68513 - DNA, 652 bp, Zea mays
  misc_feature: Ceres CLONE 1544912
  misc_feature: Translation starting site: 211
  misc_feature: SWISSPROT Homolog: EC 1.1.1.42 Isocitrate dehydrogenase (NADP(+))
aatgctggagctccccgcggtggcggccgctctagaactagtggatcccccgggctgcaggaattcgtctcacccctagaaaaacccctgttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttccacaccgtgatgctaccgacgagaaaggggagtggaggctgcggaggccacactcaagtacaatgtggctatcaagtgtgccaccattacaccagatgaagcaagggtaaatgagtttggcttgaaggctatgtggaagagcccaaatggcacaattaggaatattctgaatggccctgggttcataaaacccatcatctgcaaaaacctcccacggcttgtttccagggtggacaaaaccccttttgctccgggaggcatggctttccgggaatcagaaccgggcaactgaagcaa

SEQ ID NO: 68514 - DNA, 659 bp, Zea mays
  misc_feature: Ceres CLONE 1544913
  misc_feature: Encodes the peptide sequence at SEQ ID NO. 68515
  misc_feature (389)..(389): n is a, c, t, g, unknown, or other
  misc_feature (390)..(390): n is a, c, t, g, unknown, or other
  misc_feature (632)..(632): n is a, c, t, g, unknown, or other
aaactggagctccccgcggtggcggccgctctagaactagtggatcccccgggctgcaggaattcgtctcacccctagaaaaagaggcagactaaaaacaagaacatacctacgcaactagcagagcttacagatttgcacccacaggactctgaataaagctggggctttttgcagcacaaggacatggagtacccaagaaggacactgctgcacacccctttctccgggcatccctctggtccaagccagccaatagatggagccacggccacagacggaagcaacttcgacgcgaacttggtcatgatcctggctgtcctcctgtgcgcgctgatctgcgctctcgggctcaactccatcgtccggtgcgtgctgcggtgctcgannccggtggtggtggttcctgaaccgaaccaggtgacgcggcttgtccagagcgggctgaggaggaaggcgctcccagccatgccggtccctggtctactcgcctgggctgaagatcaatgctgccaacccgacatgcgcgatctgcctctcggaatttcaagggaggggaacatgtcagggtccccccccaaatgcaccaccggtttccatggcagggggattcgacccggtggctgctggcncggtccaaaatgccccaacttgccggg

SEQ ID NO: 68515 - protein, 157 aa, Zea mays
  misc_feature: Ceres CLONE 1544913
  misc_feature (68)..(68): Xaa is any aa, unknown, or other
  misc_feature (149)..(149): Xaa is any aa, unknown, or other
MEYPRRTLLHTPFSGHPSGPSQPIDGATATDGSNFDANLVMILAVLLCALICALGLNSIVRCVLRCSXPVVVVPEPNQVTRLVQSGLRRKALPAMPVPGLLAWAEDQCCQPDMRDLPLGISREGNMSGSPPKCTTGFHGRGIRPGGCWXGPKCPNLP

SEQ ID NO: 68516 - DNA, 665 bp, Zea mays
  misc_feature: Ceres CLONE 1544921
  misc_feature: Encodes the peptide sequence at SEQ ID NO. 68517
aagctggagctccccgcggtggcggccgctctataactagtggatcccccgggctgcaggaattcgtctcacccctagaaaaaactgacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacaagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactgccttgccccatggttctctcatcccactcgtactgctattcgacaacgctacaatcttgagggtagctttgaggctttcaccaa

SEQ ID NO: 68517 - protein, 160 aa, Zea mays
  misc_feature: Ceres CLONE 1544921
  misc_feature (64)..(158): Pfam Name: PLAC8 Pfam Description: PLAC8 family
MGAGANNHEESSPLIPAAVAAPADEKPPQAPAPEAANYYADGVPVVMGEPVSAHAFGGVPRESWNSGILSCLGRNDKFCSSDVEVCLLGTVAPCVLYGSNVERLAAGQGTFANSCLPYTGLYLLGNSLFGWNCLAPWFSHPTRTAIRQRYNLEGSFEAFT

SEQ ID NO: 68518 - DNA, 862 bp, Zea mays
  misc_feature: Ceres CLONE 1544924
  misc_feature (7)..(7): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (69)..(69): n is a, c, t, g, unknown, or other
  misc_feature (511)..(511): n is a, c, t, g, unknown, or other
ttttttnttttnttttnnnntttttttttccttnnnggtgtggntgaaaaatggagtccacgcggtggnggtcgctctgaactagtggaatccccgggctgcaggaattcgtctcccccctagaaaaatccctcgtcggctcgtgcgttgactctctctctctctctgtctctctctctctactcgtccgcctctcgctctcagacgatcggtgggtcgccgcctccgactccgccctctgctccgcgctgaggctcttgtttggctcttcgccccccaccgccactcccccccgacaacgcaacagtctttcggcccacggacccccccctcttgtcctgcccctggaggtctcctcctctgctgcaatttgatgccccctgatttctccgtattcctcgctttcgattgacctctgtttcttggtgagtggatttcccagcggccggcggaccctcccccccccgaccgcctcccctcccccccgcctgatttacatcctgcatatatnttttcttccgctcgaaggtcgacagcgaccatctcctatccttcttcttttctttcctctctctcttcttacctcttttttttctattacgtttgtttttgcttcgttagttcccacaaaataacaccacgccgtcgaccacacgtcctcgtcccttagaatctctcccttctccccttgttttccctctttttcctctttcggtggaggccttcgggcgtgcggtcgtcgtcgcaccccccccacttccctccccgttttatttcttttctttttctccctccccgtttatccttttcacccctaaatacactcaaaatactattttctctcttttgtttaccgtttctg

SEQ ID NO: 68519 - DNA, 799 bp, Zea mays
  misc_feature: Ceres CLONE 1544928
  misc_feature: Encodes the peptide sequence at SEQ ID NO. 68520
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (19)..(19): n is a, c, t, g, unknown, or other
  misc_feature (28)..(28): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggtttgggcccnnttnttnttccctttnacccccccaaaagatannnnnagaagctcggactccccgcggtggcggccgctctagaatagtggatcccccgggctgcaggaattcgtctcacccctagaaaaaaggacgacccaagcaagcaagcaagcagcgagtacatacatactaggcagccaggcagccatggcgcccaccgtgatgatggcctcggcggccaccgccgtcgctccgttccaggggctcaagtccaccgccagcctccccgtagcccgccgctcctccagaagccccggtaacgacagcaacggcgaaaagatccggcgtatgcccggaacaaatgcctcctaactagcacgctcctttgccttgcacgagccggccgctagcgaattctcttatttttttttcccccccccaagggggggcagagagggggggaaaatcattatcccactcccattccccccccccgaccctgcaatatgaaacccacccatacgctgcacgggccgccgctagcaagaccagccacaccaaaagacgaaaaacactctaggacgagacgcagaccccgcggcgccccgccacgcccacgagaagcaaccgagaaacagaacaagagacaatataaccggccaacactgcccgcgccgcgacgtactcgtcactacccgagtccttcatccgcgcccgcggacactcgcgtcgccctccggtgtgccgtaagccagccgcgaggcgtcgatctctacctcccccccctactactagacccaacacgatcgcgat

SEQ ID NO: 68520 - protein, 54 aa, Zea mays
  misc_feature: Ceres CLONE 1544928
  misc_feature: SWISSPROT Homolog: EC 4.1.1.39 Ribulose-bisphosphate carboxylase
MAPTVMMASAATAVAPFQGLKSTASLPVARRSSRSPGNDSNGEKIRRMPGTNAS

SEQ ID NO: 68521 - DNA, 620 bp, Zea mays
  misc_feature: Ceres CLONE 1544931
  misc_feature: Encodes the peptide sequence at SEQ ID NO. 68522
  misc_feature (620)..(620): n is a, c, t, g, unknown, or other
ggatcccccgggctgcaggaattcgtctcacccctagaaaaatccgctccacccactcccgctctgctcccgtcgatctgccatcctctgcctgccccgcttgctccgcgcgtctgctctagtgatttgagacggagatccgccagagatcgaggagccggagagcggcgtcgacgagggatggacgtccacggcggcggaacgggagccggcaagctgacgcggacgccgtcctcgctgctgcgctcgccaacggtgcgcaactgctcctcgttccaggccgtggttgtcgaggacccggagcccgacgacaagaaggcacaggcgcaccccaagcctccgccccaccacttccaccccggcggcggctccaaccacccgctgctcgtcctcgtgctcccgctcgccttcctgcccctgctcctcctcctccgcggcggcgacggccgccacctcgccctcctcgcggcgtccgcggccgccgcgctcgccgccgccgcgggggccgcgcgcctgctccggggacgcctgcgccgctcgccgggctccggctccgtccagtggttcatcggggaccacgacgactagccgctgatacgggcggactaggccgccgcggn

SEQ ID NO: 68522 - protein, 135 aa, Zea mays
  misc_feature: Ceres CLONE 1544931
MDVHGGGTGAGKLTRTPSSLLRSPTVRNCSSFQAVVVEDPEPDDKKAQAHPKPPPHHFHPGGGSNHPLLVLVLPLAFLPLLLLLRGGDGRHLALLAASAAAALAAAAGAARLLRGRLRRSPGSGSVQWFIGDHDD

SEQ ID NO: 68523 - DNA, 783 bp, Zea mays
  misc_feature: Ceres CLONE 1544935
  misc_feature: Encodes the peptide sequence at SEQ ID NO. 68524
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
tttgcttttttnncnnnncncatggacactcttaataaaataattttcttactgcgagctccccgcggtggcggccgctctagaactagtggatcccccgggctgcaggaattcgtctcacccctagaaaaaacacatctccagtcctccactgacaagccgccgccgctcttccacccccaccacccacacacctctccccggcctcgcacccatggccacgactttgatggttgcagccaccacctcctgctccccgggccgtgccgcgccgcgcctgaagccggtggactcctcctcctccagcagcagcagcagcaactcggcgcggccgctgaggcccttgacgcaacaactcccgcggctgctggcgacagctgcggcggcggaggtggtagacgcaccgctcccggcgctggccgaacatatggagaatgtcacactgtatgacttcaacctaacactcccggcaaaatccatcgaattcctagcctactcatggtgtgctctggaaaagcatcttacatacaccccgctatgaaagttcaatgaatttaacatatactataaaaattcccccgacaaatcttcataaattttcaaaagacccctcccaatagaaggcgaaaactatcagtaaaaacaacaattcactccttcccaatctattaaaaggcaggcataagacgccaaaaaattacccgatcggtgtcatctaaacacatacagaatagaatgtgaagacctcccatcccaccaaacctgggaaaagtctataaatat

SEQ ID NO: 68524 - protein, 108 aa, Zea mays
  misc_feature: Ceres CLONE 1544935
  misc_feature: SWISSPROT Homolog: EC 3.6.3.14 H(+)-transporting two-sector ATPase
MATTLMVAATTSCSPGRAAPRLKPVDSSSSSSSSSNSARPLRPLTQQLPRLLATAAAAEVVDAPLPALAEHMENVTLYDFNLTLPAKSIEFLAYSWCALEKHLTYTPL

SEQ ID NO: 68525 - DNA, 756 bp, Zea mays
  misc_feature: Ceres CLONE 1544946
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaatgtatgcatgtcgtataaccgtgtactcctctgcttttatccactcaccctcttggagaatatgagttaattaccctcgccgtacgctgtcccgaactagtgttgctgtatcttggccagaataaatctaattgatcgggtgacttttttctttagaacagaaagagagaaaccagacgctcgacgtacccaattctccctaaactgagtcttattacgcgcgctcacaggccgtcattttcctgctctgtgactggcaaaaccctggcgttacccaactaaagcgtcttgtatcacaaccgcctttcgccagctggcgtaataggcaacaccccctgacctatcgaccttccctacgtagcgcatcctaaatggcgaatggaaattctaagcattaatatttttgtcaaatccgcgttaaatttttgttaaatcagctcattttttacaccaatagccccaaatcagcaaaatctcttataactcaaaagaacacacccgaaaaagggcttgaatggggaaacccctttggaacaagcagccctctattaaatgaacgtggaaccccaatgttcaaaggctaaaaaaccaccctatcatggccgaatgcccatctaccattacccaataatccttagatcaatgttattttcgaagtcggaagttgcccaa

SEQ ID NO: 68526 - DNA, 853 bp, Zea mays
  misc_feature: Ceres CLONE 1544951
  misc_feature: Encodes the peptide sequence at SEQ ID NO. 68527
  misc_feature (20)..(20): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
tttttgttttttttgtattngaaaagaaacaacntnnnttcttttgttcaaactggtactccccgcggtggcggccgctctagactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgcgggcaagcccaaggtggcggcgtccggcagcccctggtacggccccgaccgcgtcaagtacctcggccccttctccggcgagcccccaaactacctcaccgggggagttccccggcgactacagcttggtacacctccggggctgacccgcccgacccccgatacctttccccaaaaaacactctagtctgtatgttgaatcctcaccccatctatgattcatgcttcaggtcacggactctgtttagccgcctatcccccttaatctgtcttctcctccagcaaaccccccctccaagtttatctggccccaaaatctctcttcccgtgtttcctaattctccggatcctccctataaattctctctatccaagaattcctagacctgggaaactaccccttccggcacaaacccccacgcctcgatattctctattttcacaataaaaataccccacccgcacactcttggagccctcgccccacacaccctcctccccctcccacttgacctatcccaaaaggacatccatataatttactaattagtgggacccctcctcctcat

SEQ ID NO: 68527 - protein, 95 aa, Zea mays
  misc_feature: Ceres CLONE 1544951
MAASTMAISSTAMAGTPIKVGSFGEGRITMRKTAGKPKVAASGSPWYGPDRVKYLGPFSGEPPNYLTGGVPRRLQLGTPPGLTRPTPDTFPQKTL

SEQ ID NO: 68528 - DNA, 902 bp, Zea mays
  misc_feature: Ceres CLONE 1544961
  misc_feature: Encodes the peptide sequence at SEQ ID NO. 68529
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (44)..(44): n is a, c, t, g, unknown, or other
ttttttttttttttttttnnncacggcgccgtctccnacacatngggtgtgaaaatatggaactccccgcggtggcggccgctctagaactagtggatcccccgggctgcaggaattcgtctcacccctagaaaaaaacgagcacctccaagccaaagcaagttgctaggtcctttgaaccagcaactgaagcttcctcgtctcatcatcgagaccagtaagcaacatggcggctaatctcaagtgggctcctgttctagccctcctcgtcgtcgttgctgccacaattggcaccaccatcgccggaaacatcgcagtgtactggggccagaacggcaacgaaagcagccctggcggacgcctgcaactccggggctctacgcctactttcaacattcgcgttccttatcaaccttccggaaaccggaccagaccccctgtttctcaaacctctgccgggaacactgcgccatccccgggctcccccgcaatgcttgcacccgggctctatagatcatcctaaccttaccaagcactcattggcccaggtcccggattggaggtcattcataggggtgggcttctcttcctctcctatctgggcgaaggagcgcaactaagcgaggacaaacctccaccatgactcttatcttcccttcttagccgaaaagtgaaggattctaacacggtgctctgtcgtccccaactatatccctccgttggtgcaacacactatttcccgtgggtgaatggtaaaaccgttcttccgttaccgccgccccctcccccgggctccaccccgcgcagccctccatcgagccttccattctttctcaaacaactattataaacgtggccaaataattgatatctacttacacaactaacccacgtccaaaaaa

SEQ ID NO: 68529 - protein, 98 aa, Zea mays
  misc_feature: Ceres CLONE 1544961
MAANLKWAPVLALLVVVAATIGTTIAGNIAVYWGQNGNESSPGGRLQLRGSTPTFNIRVPYQPSGNRTRPPVSQTSAGNTAPSPGSPAMLAPGLYRSS

SEQ ID NO: 68530 - DNA, 785 bp, Zea mays
  misc_feature: Ceres CLONE 1544962
  misc_feature: Encodes the peptide sequence at SEQ ID NO. 68531
  misc_feature (80)..(80): n is a, c, t, g, unknown, or other
cataagctggagctccccgcggtggcggccgctctagaactagtggatcccccgggctgcaggaattcgtctcacccctngaaaaaacaaaagaagaacacaaacatcgtataaaaaatacgcacaaaaaaaagaaagacaaaagagttaaaaaaaaagaatcaaaaaatggaataccggggggttcggggaacccaattcgccatatggtgagtcgtattacgctgactcaatggacgaacttttcaaccgacaagactggtgaaaaccttggatttccccaacttaatcgcattaggtaccaccccctttgccccgtgtgggataatatgaaaaaggcccgcaccggattacctttccaaatagttgcccaccctgaatggcaaatgcaaattgcacccttaaagtttttgttaaaatccgcgcaaaatttttgttaaatcggcaaaatgttttaaccataagggcaaaaatcggcaaaaacctttaagaaccaaaaaactcccccgaaataggggttgaaggttgtcccatttggcaacaatattccaccttttaaaaaagggtgaacccccgccgtctacgggcataaaaaccgctttataggggggaagggccctccttacggggaacccttaactcctaaataaaggttcttttggggttctaaggtgtccctaaaaagtttctaaatcccgaaacccttaaaaaggggagccccccgtatttcagaatctttgtacgggggaaaaagacccggccaaaacgatgctataagaaaaaaa

SEQ ID NO: 68531 - protein, 37 aa, Zea mays
  misc_feature: Ceres CLONE 1544962
  misc_feature (27)..(27): Xaa is any aa, unknown, or other
HKLELPAVAAALELVDPPGCRNSSHPXKKQKKNTNIV

SEQ ID NO: 68532 - DNA, 748 bp, Zea mays
  misc_feature: Ceres CLONE 1544963
  misc_feature: Encodes the peptide sequence at SEQ ID NO. 68533
agagctggagctccccgcggtggcggccgctctagaactagtggatcccccgggctgcaggaattcgtctcacccctagaaaaacttccccctcgttcccagaatgcaacagcactccatcaccatcacatatggcgcccttcctcccctgcactacaccgacgccggaactctgtcaacacattactgcgatgccatttccgagcttcaaagaatcgacagtctagcttggcgaccaagggatcgaactcttccagttctacgaggctgaagatcttgagcatctgtttggtgaaggttgcctttggcgcaatctatgctcacgtaaagaagaaggcgtcgaggtggatctccacgagttccaggacgttgatgagttcgaggattatgctagcgacctcccccagtcaactccctgtggtgagttgattacgttagctacgttatcgatgctgcgagcttcgatataatattaggtaaatgactccagtctgtaatactattactcactctttattgaatctcgaagcattgaactataatgacctcatatatggttgagagatggtcccaatttagaacaagaatcctcaattaaagaacagtcgagtcccctcggggaacccccaatacaccccatcaatgatggcgtaattcccccctccctcaaaacccttcccctttaacaacagttttttagggaggaaaaagaccccgtttatatccaccaaatttggtaaccccttga

SEQ ID NO: 68533 - protein, 142 aa, Zea mays
  misc_feature: Ceres CLONE 1544963
RAGAPRGGGRSRTSGSPGLQEFVSPLEKLPPRSQNATALHHHHIWRPSSPALHRRRNSVNTLLRCHFRASKNRQSSLATKGSNSSSSTRLKILSICLVKVAFGAIYAHVKKKASRWISTSSRTLMSSRIMLATSPSQLPVVS

SEQ ID NO: 68534 - DNA, 722 bp, Zea mays
  misc_feature: Ceres CLONE 1544966
  misc_feature: Encodes the peptide sequence at SEQ ID NO. 68535
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
gggtgttttgtttccccccnnnancacccagcgttnttattnnnnggggggnnnnnnaaaactgagactccccgcggtggcgggcgctcttccctaatggatcccccgggctgcaggttttcctctcacccctagaaaaagttccagcacgtacacaccacaccagcacccagcctccccaacgatgacggcggcggcggcaccggcggtcgctagcagggtgtgggagtgggaagggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggtgaccccgcgcccgactgggcgcgagagaccctgctggagcacgacgccgacccccccttcttccgctaccagatgaacgaaaaccaaatggggcttcggcctccttcttcgccacgttcctcagtcttcccgggccgcccccgggagggtggatagttgccctgggcaattcttagcggccagccccttgtaccgggaagaagataggtatttttattctttgttgccgccagacaagatcagacctccaccgggtatggttcggagaacgacgggccatcgtacaaccgccacctccggccctcat

SEQ ID NO: 68535 - protein, 128 aa, Zea mays
  misc_feature: Ceres CLONE 1544966
MTAAAAPAVASRVWEWEGKVASAVAEATADEAWALLSDFLAFHRWHPRVAACRLASGTPRAPGCVRYCEGTATAADGDPAPDWARETLLEHDADPPFFRYQMNENQMGLRPPSSPRSSVFPGRPREGG

SEQ ID NO: 68536 - DNA, 816 bp, Zea mays
  misc_feature: Ceres CLONE 1544977
  misc_feature: Encodes the peptide sequence at SEQ ID NO. 68537
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (816)..(816): n is a, c, t, g, unknown, or other
ttggggcgtcctccccccccccttcnnnnaaancnnnnnggtaannnnnnncaaaatgggactccccgcggtggcggccgctctataactagtggatcccccgggctgcaggaattcgtctcacccctagaaaaatgttcaagagcacatatgagtccatcacccaaggaaatcctatgtggaatgagctgccagtctcaacaagcactctctatccctgggatccatcatctacatacatccatgagcctccttacttcaaggatatgacaatgactcctcctggcccgcgaccggtgaaagatgcatatttgccttctgaactttggtgacagtatccacaactgaatcacatcttccctgccggaaaaattcatccagaccgcgcagctgccacactatctcaaggaacttgttttttccccccaagggaggggagggggggatgctattcaaaataagaaatgatcgccccccccggctcagggcaaaccttttaccccacactccgcccctgcacaattaagttccttttcaatcggcggagcgcttggaaccctcaaaatgatcctaatgtttccccttccgagacacgaaagcctctcacggttattagatcgcatctctgcatacacaccacataaacatgtacgggaccggtgctaacctaaaccacccaacgaggctggctgtcctgtggttgtgtggtacttcctattgctattgttgggaagttcggccccacgacaagacgactccgcacgttatcaatattgaattgataatagcgcaaacaataatcctctattcaccttn

SEQ ID NO: 68537 - protein, 65 aa, Zea mays
  misc_feature: Ceres CLONE 1544977
  misc_feature: SWISSPROT Homolog: EC 4.2.1.3 Aconitate hydratase
MFKSTYESITQGNPMWNELPVSTSTLYPWDPSSTYIHEPPYFKDMTMTPPGPRPVKDAYLPSELW

SEQ ID NO: 68538 - DNA, 883 bp, Zea mays
  misc_feature: Ceres CLONE 1544981
  misc_feature (19)..(19): n is a, c, t, g, unknown, or other
  misc_feature (48)..(48): n is a, c, t, g, unknown, or other
  misc_feature (49)..(49): n is a, c, t, g, unknown, or other
gggggtgcccctgcccccntttttagtatttataattaggggtttttnntagaaagctggagctccccgcggtggcggccgctctagaactaagtggatcccccgggctgcaggaattcgtctcacccctagaaaattcaagctctcctcccctcttcctaccattagcagtagctacagccagaacaccagcagacagcagcatcagcagggaggaacacgatgagcggcgccggtccggatctgcagctgccaccggggttccggttccacccgacggacgaaggagctggagatgcactacctctgccgtcgttgcgctggtctgaccatcgccgtccccaatcatcgacgagatcgacctctaacaaatccgaaccatgggcacctcccatggaatgatgctgtgacggcggagaagagaagacgggtaatttctttctccgcgggggggaccggagagtgaccccgaacgggtacccagagagcaatatcgcggaccgaccgaagagactgggggcaccttggtaaggggctcaccgaggggagaccgcacactggttctagaaggggtcgcgcagccccataagaccaaccgtgggtccactgcaataaaagaggcgcgccccacggccgtgttctgtactgacgcggacatgaggaggggcaccaaagggtatgtaagattgtatctcaccccggcgacacgcatcgccaaagaggacaaacggacgctgtgagccggaaacgcccgtagccgaaatagtgttttacatatattgtaatatatacaggacctccgcccaggacgccacgcagctcggaggattactataaatttctcaataacaaggatagatagaaaatatgcaccgggccacga

SEQ ID NO: 68539 - DNA, 772 bp, Zea mays
  misc_feature: Ceres CLONE 1544984
  misc_feature: Encodes the peptide sequence at SEQ ID NO. 68540
  misc_feature (37)..(37): n is a, c, t, g, unknown, or other
  misc_feature (38)..(38): n is a, c, t, g, unknown, or other
tgttggttggtccccccccccctccccctcggcccanntttttaacaaaacaacaaagtgagactccccgcggtggcggccgctctaaactagtggatcccccgggctgcaggaattcgtctcacccctagaaaaagctagcacccatcgtcttgcagcaggcggagccgcccgacccgatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggtcgccatccagcccgagaaggcaacgtaccaggtggtgcagcccatcaacggcgacccgttcatcggcagcctggagacgccctgtacctccagcccgctcatcgcgtggtacctctccaacctgctggcctaccgcttctccgttagtctcgatgctacgcgcgctttaggtcctgtctcttccacgagctaccttcctcgttaaggccactataactgctctccagcgtcccgccctccccgctataccgcccccgtgtatacttttatgtttgtgaatctcccccattgacccgccatgaccctctcttcccaatccttatatcagctcagcgcctacacacatggtacctggttcttccccccctccctttcctcataaagcggtattaatccgtcctcacacgattcactttcatacgctatactccccttccttccga

SEQ ID NO: 68540 - protein, 102 aa, Zea mays
  misc_feature: Ceres CLONE 1544984
  misc_feature (44)..(103): Pfam Name: PsaL Pfam Description: Photosystem I reaction centre subunit XI
MASQVMKSSPVHSRPRGLSGAALTRPRPRFSVVKVAIQPEKATYQVVQPINGDPFIGSLETPCTSSPLIAWYLSNLLAYRFSVSLDATRALGPVSSTSYLPR

SEQ ID NO: 68541 - DNA, 673 bp, Zea mays
  misc_feature: Ceres CLONE 1544989
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (139)..(139): n is a, c, t, g, unknown, or other
tttagttgttttctttatcttctttcccccttcctctctgggtgggtggccctttggttgtttttgttcttctatttgggagccttgggggtggggactcccttctttttattnnnnnttttttttttttcaaactggnactccaccgcggtggcggccgctctagactagtggatcccccgggctgcaggaattcgtctcacccctagaaaatggcagccatggcaaggacccctacaagagatctgcttaaccttgtgtcggtcgaggctcgtccacattgatacacctatatccgtgcctacacctcaactaaaggagagtgtggtgatctatccgtgtactggaaaattacttcctttgtgggccaggcgctataatttccttatctttgagttgcagggtgttccctgggtcagcttggttttttcaccccctttttctttttctggcttgccaaaaatttctttttgtcccaacacttatcttttatttaaaaataaaaatttttaaaaaaaaaaaaaaaaaaccggaaagcctcggggggtaccccccatttccccccctaaatggggggggttttatttttccccgccgccgtccctctgggggcgcgtttttttttttttaaaaaaaccttttggtgggtggggggaaaaaaacacccccttgt

SEQ ID NO: 68542 - DNA, 948 bp, Zea mays
  misc_feature: Ceres CLONE 1544995
  misc_feature (12)..(12): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (539)..(539): n is a, c, t, g, unknown, or other
  misc_feature (627)..(627): n is a, c, t, g, unknown, or other
tttattgttttntctcccctcnccnnnnnnnaaattnnnnnaaaaactagagctccccgcggtggcggccgctctagaactagtggatcccccgggctgcaggaattcgtctcacccctagaaaaaaaaaagaaataaagcaaaaaaaactttctctcaggaacgaagaggaaacgggatgcgtatttggatcatgaacaatcaatctgtgagcgatcgctgtaaaatactcggaaatgcctgtataatagttcttgttggttcagatgcatgcatccaaggttcccgtcgtacttatgaaaagggggtgcagcaacaacccttctggtgttttccagcgacgaaatccaatcccttcccacaactattcgtgtaaaaaaaaaagcaatactcataccgctctaggctctcttttcttccccccctcaccgagggggggggagggggggtggctaatcggtctcccactcctccccccccccccttattatttgcaaaaaacacagatgattgctcgatacgtagccggccttttgcgncgttgactcaccgtggtgccggccagatcgcaatcagtctcctcccaacccacgatctcaccgcctttcatcccccaccaccatactnccactccttttctgccgccctcgccccctactcttcttctccgaccgccggcgttacgccggtccagactacgattattctttcgcgctatccgctaattcagcacacttcatccaactcagtttcgttactataaatctgtgagtcttgtaacacaaaccacaaaagcgcacaccactcctcgctctacacgtcttcgctccccattcctccccacgtaacatcgactaggtacctattgtttgtctttaaattcgtgcttaaacggactctcgcctctctcctcctacgcagcgccgcctcctctcataaactactata

SEQ ID NO: 68543 - DNA, 948 bp, Zea mays
  misc_feature: Ceres CLONE 1544997
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (371)..(371): n is a, c, t, g, unknown, or other
  misc_feature (372)..(372): n is a, c, t, g, unknown, or other
  misc_feature (375)..(375): n is a, c, t, g, unknown, or other
tgggggggtttcccatttccccccnnnnggggtgnnnnnntaaaagtgggactccccgcggtggcggccgctctagaatagtggatcccccgggctgcaggaattcgtctcacccctagaaaaaatctgatctggtctgttcggccgccctccctccgtaatcgtcgactccccctgcgtgcgttcctttggatctgaataagatggtggtgatctgagtggtggtcttagtttatcatgtatcgctcgcaatttaatttagcggcttaggggtggatctgtgaaccccatggggccctctgcttggatccgctgttcccctggtttgtgcctgagattcgcgacagtgccccgacgaacagatcgttggnnttntcgccgcgtcttcttccactgacgtcccggcgtggtagcctaaggtcctctgctgggtttctaatgtaggccgatgggacaaacgttggtaccacgattttttgttggtcccgttccccgctctcgctgaggcactgagccgggtgtcatcgcccgccgctaacattgttatgatgactgtagagcacgaacctctctcgttccatgtttcgaactcgcccttccgccgcgttcttgtcgatgatgctactgatcgcacgatggtcctgttcttggccgcgtcaccaccccaccgccgcccataccagacatgctccagaacctgcgcagagaccgtgaacctcgaacgtatgagtgcctcacgcctgcagcgcgctgtcctgtgcacattatctactcgtaccacggtaccggggtgcgttgtcgtacgttggcggcgcagatggatccatgttaatgctcgaactcgttgcgacagttgcggtctgtcgacatttgcccagctcgcctcgtgcggctgtgtccgtattctgcaggtctccacctgataccccgcgagcgaacagcagttgg

SEQ ID NO: 68544 - DNA, 762 bp, Zea mays
  misc_feature: Ceres CLONE 1544998
  misc_feature: Encodes the peptide sequence at SEQ ID NO. 68545
caagctggagctccccgcggtggcggccgctctagaactagtggatcccccgggctgcaggaattcgtctcacccctagaaaaaagcctcagcaccggcacacagcccgccgtacctctcctcgtacgctccctcccggtgtgccgtcgccccctcgaccggtccatcgttcgtcggctcggtagccgccggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggggagggaaatacagtgaagtctttgagggtattaatgttaacaataatgagaaatgcatcattaagatcctcacgcccgcccacaaaaaaaaaaaaaaaacgagacgctcgaggtacccaattccccctatagtgagtcgtattacccgcgctcactggccgtcgttttacaacgtcgtgactggtaaaaacctggcgttacccaacttaatcgccttgcagaataatccccctttcgccagctggcgtaataacgaagaggcccgcaccgatggccctttcccaaaatttgctcaaccttgaatgggcaattggaaattcggaacgcgttaatatctctggttaaacttccccgttatacatttttttggtcaaatcacgctacatttttttttaaacgtcatacggcgcgaaatttctgtgttaaa

SEQ ID NO: 68545 - protein, 141 aa, Zea mays
  misc_feature: Ceres CLONE 1544998
  misc_feature: SWISSPROT Homolog: EC 2.7.11.1 Non-specific serine/threonine protein kinase
MSKARVYTDVNVLRPKEYWDYEALTVQWGEQDNYEVVRKVGGGKYSEVFEGINVNNNEKCIIKILTPAHKKKKKTRRSRYPIPPIVSRITRAHWPSFYNVVTGKNLALPNLIALQNNPPFASWRNNEEARTDGPFPKFAQP

SEQ ID NO: 68546 - DNA, 820 bp, Zea mays
  misc_feature: Ceres CLONE 1545003
  misc_feature (15)..(15): n is a, c, t, g, unknown, or other
  misc_feature (19)..(19): n is a, c, t, g, unknown, or other
  misc_feature (22)..(22): n is a, c, t, g, unknown, or other
  misc_feature (25)..(25): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (472)..(472): n is a, c, t, g, unknown, or other
  misc_feature (473)..(473): n is a, c, t, g, unknown, or other
tggtgtctccccggntttnacnctnacccacnnnngggctccattnnnngagccttagtattccccgcggtggcgagggctctttcatactggatcccccgggctgcaggaattcctctcacccctagaaaaaacagcaaaatctcaccaagtctgtcgctttggaaaccgttggtgacaccataaccactcctgttcgtcgtgctcccccgcggggggagaggtgaatggcatcgtcttcgacgttctcgtgaccgttggactcaccccccatcccaggatattttctatgattgcgctcccccaccccgctccccgctccccctgcttgtttttgtttctcccccccgcctcccggccagtcctccaccctccccctcctcttctcggagcttcctgacctcccccggagttcatcattttttttcccccccccccgggggggaagagggggggcttcccaccctctctnncttcccactcccccccttatatataaaaaacacccaataatccggttgggggtgtgggggggggtcttatctcctcttttcctcctctcccccggccatctgctctcccgtcaatatattcaacctcgagaatccatctagaaatggtgcgttgtcttgatatatttttcctggcaccttctcgggtgcgttctttgtcttgcgcccccctgtcttttttagagtaaatgtaagtattttgttatgtttttcgaactaactctccccctcgtagttggtctaccatgctcgctcctctcacattactccccccgcccaccgtaccaccctccccgacttttcttctc

SEQ ID NO: 68547 - DNA, 904 bp, Zea mays
  misc_feature: Ceres CLONE 1545013
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (63)..(63): n is a, c, t, g, unknown, or other
tggtccctccnntnnnnnnnntttctttactnnnnggcgcaccccccccaggctggggctccncgcggtggctgccgctctttactagtggatcccccgggctgcaggaattcgtctcacccctagaaaactcctgccttcctccatccctcccccctaccctaccccccacacggccacacacacaccgtccgcgtccgacccccacgccgtcgactgctcgaccggtcggctccgatggggtacgtgccgtccgccgtgggcacggtgctgaaccacccccccgcgtgtcgggcggactgtgatatggcactcttcgttgggtccctttgcttcccccccccctccccgagcctgctactccgctgccccctggcctcccccccctagcctacctgtcctacttcattgttattttttccccccccccccccccgtggggggggggggggggcccgttccatcctttccctttttaactcgcccacgaaatatgtggcgatgggctctcgccttgccttctccctccgccgtccgcgcatgcctcggccgcaccctcacctccgccccccccacatgtcttgcaaggactcactggattatccccatccgcccccccactctagcgcttttcaccttctcctccccccccgaccacgcttgcccccctccccccccaccacctctccactaacacacgatttatccacccaacctgacacgtctcgcccccttcctctccgatatctagctatattattagtatgacttcatccatactgcgactgtttgcccctcatgcgtagatgctacccctctccccccacctcatcccgcactcccgtctacccccctccgcaccacccccctctcccccctccctgctctccccaccttcctcccc

SEQ ID NO: 68548 - DNA, 651 bp, Zea mays
  misc_feature: Ceres CLONE 1545014
  misc_feature: Encodes the peptide sequence at SEQ ID NO. 68549
atagctggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgag

SEQ ID NO: 68549 - protein, 158 aa, Zea mays
  misc_feature: Ceres CLONE 1545014
  misc_feature (64)..(158): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDE

SEQ ID NO: 68550 - DNA, 796 bp, Zea mays
  misc_feature: Ceres CLONE 1545015
  misc_feature: Encodes the peptide sequence at SEQ ID NO. 68551
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
gttgttttctttttttcctttctccctccccccccnnnnnnagtcaccgctcaaactggagctccccgcggtggcggccgctctagaatagtggatcccccgggctgcaggaattcgtctcacccctagaaaaaactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcatagcatgtccacgacggcgctgcgcaccaagtccaagtcggccgcgtctctgctgagcaaggtgcccttcacgacgctcctccccgtcctcgccaatctgcaggaggtgttcctcggcaccaagctcgccgttgctattccccggccgtagccactcgccatccccgttccagtgcgtctactttctgcccaagtggtgggttgttctaaccctccagccctatatcgagcctccatctcccccttcgtccgaagcagtgttcatccttccctccccccgatgccaaatccgccgaatataacacccgggaccccacccgtggggcgggaccatccctcaaaacaccaaccttgccggctaaccgccatcgagaacctccattcattcagacccccctttccccgcttcctcggggggggccccacatccaaaaggccgatcatgatggctccccttccttcgggctcccggatcctctaccaaaa

SEQ ID NO: 68551 - protein, 88 aa, Zea mays
  misc_feature: Ceres CLONE 1545015
MDRLPESTRSMRKYASEAGGLRAARQGPHGRSLTARTAHSMSTTALRTKSKSAASLLSKVPFTTLLPVLANLQEVFLGTKLAVAIPRP

SEQ ID NO: 68552 - DNA, 790 bp, Zea mays
  misc_feature: Ceres CLONE 1545017
  misc_feature: Encodes the peptide sequence at SEQ ID NO. 68553
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (790)..(790): n is a, c, t, g, unknown, or other
ggttgtcctctttttnttnncaaannncccctnnnnggggccnnnnnnncagcactcggactccccgcggtggcggccgctctagactagtggatcccccgggctgcaggaattcgtctcacccctagaaaaagggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggagtttgcatttgcaaagaactgtatcggcccgaagcggttgccacggcgtgtgggccttggccatgccccacggcagggatcttagaccagcagccgggaggcaacaatgaatttttttttccccccccctaggggcaagaaaggggtcccctctttatctttctaattcccccccgatcccaaattttaaaaaataaaccagcccccccgtggggggcccccccccccggtcccacctaaccccaaattctcccgcatccgaacggtgccgtctttggttggctccgctattgcatcgcccacccccaccctccctgtctccctttcatcaagtttcatgtttgggccgttgcgccggtcaactcccgccacgcactcccatcaaacctcacccacccgtctgcccctcctcctccctccccctcactccgctcgacagcagaggggcaagaggggccaatccccccaccggcacgatccaatccgcacaccn

SEQ ID NO: 68553 - protein, 79 aa, Zea mays
  misc_feature: Ceres CLONE 1545017
MLRANPERKKEKKKTERGESGRRSETEASLLHTLSRLPVPALSWIARKPLGEFAFAKNCIGPKRLPRRVGLGHAPRQGS

SEQ ID NO: 68554 - DNA, 806 bp, Zea mays
  misc_feature: Ceres CLONE 1545022
  misc_feature: Encodes the peptide sequence at SEQ ID NO. 68555
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (30)..(30): n is a, c, t, g, unknown, or other
ttttttttttnnnnnnnnnncggtcttntnatacctaccccttttttgcaaagctggactccccgcggtggcggccgctctatactagtggatcccccgggctgcaggaattcgtctcacccctagaaaaaattccagtcctcctcctgttctttgtttcccgtcccatcgtgtgtgagcgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatctgcggtggccgcagcatcaggccgttcctgctcacctgcaacgcttcctcttctccgtccccttcctcgccggcgccggctcatgaatacctctaccgcccccaggaggagggggcggcggagaaggaggtcgggagcctgaagcgcttgattggctggcccgatgcaatagaaccctggttctgtctgctactttttcccctccccaagaaaaaaaagggtggaaccggcctctagatggaaaaagtgaataccccctctgccccaaacccaaccctctaccatcccgtctaagcccaattgggtgtatcctgtgttcctaaataccgcacctatcaccttcccgggacctgctagggtatacttaaaagtaaaaaatgataccaaaaaaaaacagtttccgtcttaatttcccctatgtgatattcattctccaaaacattcaataaaccacacacccctcccctatccttccaccaatcccaaata

SEQ ID NO: 68555 - protein, 110 aa, Zea mays
  misc_feature: Ceres CLONE 1545022
MACPAQSMLSASGCIFLRSKPQAASQVRGGIICGGRSIRPFLLTCNASSSPSPSSPAPAHEYLYRPQEEGAAEKEVGSLKRLIGWPDAIEPWFCLLLFPLPKKKKGGTGL

SEQ ID NO: 68556 - DNA, 803 bp, Zea mays
  misc_feature: Ceres CLONE 1545025
  misc_feature: Encodes the peptide sequence at SEQ ID NO. 68557
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (107)..(107): n is a, c, t, g, unknown, or other
tgttttggtgcttccccctnaatgaggnnagagntttttttggcaannnnnaaaaagtggagctccccgcggtggcgggcgctctatactagtaggatcccccgggntgcaggatttcttctcacccctagaaaaaccaccgcatcccacaccccccgagctcagcttagttccactccagctccaatcacagtcgtgaccagagcgcgagagctagctagaggggcgtgaaaatgccgatcaataggatcgccctggggagccaccaggaggtgtaccacccgggggcccctcaggcggggttcactgagttcatatccacccttatcttcttcttcaccgggccaggggtcggggatggaattcagaaaacttgaccggcggggggcccgagtattttgtgtgggttttatttttcccccccccctagtgggggggggggggggggcttttcctttctcttgttctgtggtccccgtgagtatgtttggggggggaagatgaaatccctaatcaatgaacgttgggggggtttgtgaggtgggggcggatcggttgcacggggtgtaaggaaggcctccctcccatcgttataacgtcgccaagtgcacgggggtgggagggttatgggggggtgctgccgcggaccggccgtaccttcacacgccgcccggcggggggacaacgagcaaggcttttaccttgccatcataggccgtaacgaacgagggggccgacgcccgcaccaccgcagcccagagggatacgggaagggtaaccgcccatcgcggagtcgtatctct

SEQ ID NO: 68557 - protein, 47 aa, Zea mays
  misc_feature: Ceres CLONE 1545025
MPINRIALGSHQEVYHPGAPQAGFTEFISTLIFFFTGPGVGDGIQKT

SEQ ID NO: 68558 - DNA, 751 bp, Zea mays
  misc_feature: Ceres CLONE 1545031
  misc_feature: SWISSPROT Homolog: EC 3.2.1.23 Beta-galactosidase
aaaagctggagctccccgcggtggcggccgctctagaactagtggatcccccgggctgcaggaattcgtctcacccctagaaaaaatcaagaaaaaaccaataattttcctgtgacctgaattgagaggattaaatagcgtgtgcccggggtttcgggtggactgcctacagaatcgactgtgtcaagctttcttgattccgtataaacatgttttgtttgagctcaaacatataggatctccccattttatcgcacaaagattgtgatctgtttttagccttctttctacctgaataaaaagattcctgcagacccttttacaaaaaaataaaaaaaccatacgctcgaagtacccaattcgccctataatgtatcgtataacgcgcgctcactggtcgtcaattcacctcgttttgactgccaaaaccctgacgttacccaacttactcatcttgcaaaacatccccctttcaccagctggagtattatccaagaggcccacaccaatcgcctttcacaacagttgcactccctgaatggcgaatgaaaaattgtaaacgaggatatttggctaaaattcgcaactaatctttgttaaatcatctcagttttttagccgctagaccgaaatcagccaaatcccttatgaatccccccaatataccgctatacggttaaatgctgctacagtttggaacaagagtccaaaaataaagaacggggactgcaccgggcgcacggccaaaaac

SEQ ID NO: 68559 - DNA, 769 bp, Zea mays
  misc_feature: Ceres CLONE 1545044
  misc_feature: Encodes the peptide sequence at SEQ ID NO. 68560
aaaactggagctccccgcggtggcggccgctctagaactagtggatcccccgggctgcaggaattcgtctcacccctagaaaaacatctctgcttggatacgaggcactgacaggttccttggatgattttggatttgaagattatcttaacatgcctcatgattctgacagtttccgtcaacctgacatgcaccatggaatggaggttcgccttggtttgtccaagggacctatctgtcctaacttcaattgaggcagtaatgtaattctgctgcaagttcacctctcagtccagtacttcagtcaatagaccatattaagatggtgaaatatgaaaactggtagcttgcatctgttcaatgttatgttttaatcaacgctgaatttaatatttgtcaaggtttgaactttgacacctactttttctggtttccttgccactgcgaggccatggaacctacctaatttatatatgttctaaccaaaaacaaataaaacgatcacgctctaggtacccctatccccccctatactgattcctatttacccgctgcttccctggcctgtcgttttttccaacattcttgacctgtgaaaaacccctggcgcttacccctccttaattcgcctttggcaccaatacccccccctctccccccccctggggcgaaattacgcacaaaaggcccctctaccgaatcggccccctttcccaaagcagtgtgcagcacgtccttgaactcccgcccattcggatatatttgagca

SEQ ID NO: 68560 - protein, 33 aa, Zea mays
  misc_feature: Ceres CLONE 1545044
MPHDSDSFRQPDMHHGMEVRLGLSKGPICPNFN

SEQ ID NO: 68561 - DNA, 696 bp, Zea mays
  misc_feature: Ceres CLONE 1545052
aaagctggagctccccgcggtggcggccgctctagaactagtggatcccccgggctgcaggaattcgtctcacccctagaaaaagtgggcttgcccagtggcttggacactatatggacttgttgcctcacaatttggagacatcgcagacatcaggctggaagatgacggggaactagtgaaagatttcgtcaacagattctttggattcgagcatgacaacttgggttatgtagctaccgctgttgttggattcactgttctctttgctttcgtctttgccttctccatcaaagtcttcaacttccagagaagataagggagggcgtcatccaaaaaggatttggtgttattccagctcacttcagtatataggtcctgcagcaatgtaaagtgacgagaaagagtgtatacttagcctttgtttatttctaggaagtttgacttcattttttgtattccggccagtttggcctgtactgaacagaaaagggcttctgtgtaaattgtatgtagtagactgtgcacagctgggttcaatacttcaatgtaagatttttccattaaatttataccttttgtccaaaaaaaaaaaaaaaaacgagacgctcgaggtacccaattcgccctatagtgagtcgtattacgcgcgctcactggccgtcgttttcaacgtcgtgactgggaaaacctggc

SEQ ID NO: 68562 - DNA, 813 bp, Zea mays
  misc_feature: Ceres CLONE 1545056
  misc_feature: Encodes the peptide sequence at SEQ ID NO. 68563
aagctggagctccccgcggtggcggccgctctagaactagtggatcccccgggctgcaggaattcgtctcacccctagaaaaagcataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacaggggcttgggcactccaagaagagcacaaccatgtaccaaaccttccactttaaaggtgttggctagttccaataagtccaaaactataatatacctttagggcttgggcccctataaaagcctaaaaagggccccaaggttcaaaaaaaaacccaaatggcctctgttttgcaaacccctttggggaaaaattttcgggagggagggaaacaccctctttggttatacagcccccttaggggattaaaaaaaaagacaagctgtaattttttcttcgggaaaaaataggtggaatacaatgtgggcggcataatcttttcttcccccccccgcaaataaaaaaaaataaaaaacgctgcgagggctctcctgatggtaacccccctatttctcccctcctcaaaggaacgagaatgtatctttatgtactccggtcccgccctgttgtgggtggtggcgatactttgtcttctataattaggattctgtcgattagg

SEQ ID NO: 68563 - protein, 92 aa, Zea mays
  misc_feature: Ceres CLONE 1545056
MSHAQPLRLQAQWKHVDIQDNQANAMKEPGTSGGYGSPMKDDKNKDVDTIASNFIKLKHRGLGTPRRAQPCTKPSTLKVLASSNKSKTIIYL

SEQ ID NO: 68564 - DNA, 676 bp, Zea mays
  misc_feature: Ceres CLONE 1545060
aaagctggagctccccgcggtggcggccgctctagaactagtggatcccccgggctgcaggaattcgtctcacccctagaaaaaagaccttatccaccaacctccggtccacggtgaactgggccgcaagactcctcctctcccgcaaacacccacgcccactccatcgctcctctcctccaacatcgctcacgcggtctcctctccccgctcagctccgctcccggagacacgcaagcttcccgttcccgggaacacgcactaaagatgcctccatgccttcgccgcccgcaccttcctgctcgatatgtgggcgtcgcatcccactgtgcgccgttttcgagcgcaagcacggtttcacggccagaattctgcgtaatcgggtgcagcaaaacacggtctacatcagctgggtccttgaagctggctgtgggattccttaaaatgggcttttgaagaatatacccgtccaaaacagtaaagcccccccggcccccctggatgggaaaacctttgccggtggaaaaaaacccccaaaaagaaactacctgatggaagtcccgaaaaaatttttttttcttttccccgaaaaggtttaggttttttaaatttccaaggccctttttggaaaaaaggggaggggggcccccccggggccctttttaaaaagaaaaaa

SEQ ID NO: 68565 - DNA, 900 bp, Zea mays
  misc_feature: Ceres CLONE 1545062
  misc_feature (1)..(1): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
naatttttaatctattacacccaccccnnnnnnnnnnggtgttnnnnnncaaaactggagctccccgcggtggcggccgctctagactagtggatcccccgggctgcaggaattcgtctcacccctagaaaaaattcggcctatcacaaccacttactctcgtgcgctctccgtgggagcgaggactcgcggccggcggcagcggcaggttctcctagatctccgggatcatcagtaacaaatggcctgacggtgaggacattcagccccttgtttgtgaccatggaactggcatggtccaggcctggtttttgctggggaccatgcgcccagggcctcttttctcccgcacggggcgggacccccccctcccccttggcgttgatggtttgctacaggcagaaaaaaagatgccgccacggcccttttttttttcccccccccccccccccgggggggggggggggggagcctacaaatccccccccccttctcaaactcccctccccctcgtcccccctcactcggtcgctctcaaccactcggaggacaaacaccttctggcgaccccgccccgcactctttataccacaccgcgcaactccctccccctggtcggcacgccaccctgctaccgaatccctccccttgacgtgcccagtctgaacaacgtaccccttccctcgcccctgatgcgcgcccgccgcggttcaccgccggggtgcacgcacacagccacgctccacaaaaccggcggccacacgcactacctccttctcccgtgtgtccgcctgaccagacccaagggggtccgggcgctatcccacgacgactaatcttctatgacccctgggcgccgttcactcgcgtcccggccctcgctgaccacgggggttcttg

SEQ ID NO: 68566 - DNA, 672 bp, Zea mays
  misc_feature: Ceres CLONE 1545064
  misc_feature: Encodes the peptide sequence at SEQ ID NO. 68567
  misc_feature (213)..(213): n is a, c, t, g, unknown, or other
  misc_feature (216)..(216): n is a, c, t, g, unknown, or other
  misc_feature (217)..(217): n is a, c, t, g, unknown, or other
  misc_feature (221)..(221): n is a, c, t, g, unknown, or other
  misc_feature (225)..(225): n is a, c, t, g, unknown, or other
  misc_feature (228)..(228): n is a, c, t, g, unknown, or other
  misc_feature (229)..(229): n is a, c, t, g, unknown, or other
  misc_feature (234)..(234): n is a, c, t, g, unknown, or other
  misc_feature (323)..(323): n is a, c, t, g, unknown, or other
  misc_feature (336)..(336): n is a, c, t, g, unknown, or other
  misc_feature (380)..(380): n is a, c, t, g, unknown, or other
  misc_feature (381)..(381): n is a, c, t, g, unknown, or other
  misc_feature (503)..(503): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (547)..(547): n is a, c, t, g, unknown, or other
  misc_feature (548)..(548): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (574)..(574): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (592)..(592): n is a, c, t, g, unknown, or other
  misc_feature (593)..(593): n is a, c, t, g, unknown, or other
  misc_feature (598)..(598): n is a, c, t, g, unknown, or other
  misc_feature (599)..(599): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
atagctggagctccccgcggtggcggccgctctagaactagtggatcccccgggctgcaggaattcgtctcacccctagaaaaaagccacgtcttcatcacacacggtcgcggcgcgaagcaatggcgaccacggcgccgctgctctcgccccagcgcgcttgccctacccatctccggcgccgcctctcgcccctacatctcgtattccccnccnntcgnacgncgnntcagncgaagagcagagctgggcgccttctgccgagagcagccgccacctgtgttcggccaagttcggcaagtcgacgccctccgacgccccgncggaagccgtagnaagagcgggggggcgcccacaaaaaggggggggctcggggcgcnnccccccccccgggaaaaaagaaaaaaacgctttttccttttcccccccccggttttttgggggggcgcccttcccccccccgggaggagaggagacccccaattttttttttttttttcccncggagaannnanagggggggggggggggtgttcttccccccctnncaaaccnnnaaaaaacaacacccctncccccgcnnnncnnnncnncaccnncnnnnnnnccaccagaatcctaccnnnnnacaccnnnnnnnnnnnnnnnnnnnaaacaaaaannnnnnnnnna

SEQ ID NO: 68567 - protein, 70 aa, Zea mays
  misc_feature: Ceres CLONE 1545064
  misc_feature (31)..(31): Xaa is any aa, unknown, or other
  misc_feature (32)..(32): Xaa is any aa, unknown, or other
  misc_feature (35)..(35): Xaa is any aa, unknown, or other
  misc_feature (36)..(36): Xaa is any aa, unknown, or other
  misc_feature (38)..(38): Xaa is any aa, unknown, or other
MATTAPLLSPQRACPTHLRRRLSPLHLVFPXXRTXXQXKSRAGRLLPRAAATCVRPSSASRRPPTPRRKP

SEQ ID NO: 68568 - DNA, 759 bp, Zea mays
  misc_feature: Ceres CLONE 1545070
  misc_feature: Encodes the peptide sequence at SEQ ID NO. 68569
  misc_feature (20)..(20): n is a, c, t, g, unknown, or other
  misc_feature (28)..(28): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
ttgtttttgtgtcagctcanaccacatnganaatnngcgcgatacacaaaaaatggagctcaccgcggtggcggccgctctagactagtggatcccccgggctgcaggaattcgtctcacccctagaaaaaccctagaaaaaaactagaaaaacagatcagatcggcaaggccaatccgaaatctcgagctttcgcgccggcgaccacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaacagtggcgtcggcgtggcgtccatgggcgtcatgcgcccagagctcgtcatgaagtccatcgtgcccggggtcatgcccggtgtgctcggtatctaaggactcatcatcgccgtcatcatcagcactggggatcaaccccaaggcccaacccatactacctcctatgacaggaaagccccaactgtagatcccggccttggcatgtgggaccttgcagggccttggtcggcaagcaagggcaatttggacaccctacggggggaaacaagggggcgacaggggtaaaaagtcaccagcctaaccctaaagaaagggttatggtgggggcaaaaaaaacccgccaatacctgggaaatatttcatgtacga

SEQ ID NO: 68569 - protein, 67 aa, Zea mays
  misc_feature: Ceres CLONE 1545070
  misc_feature: SWISSPROT Homolog: EC 3.6.3.14 H(+)-transporting two-sector ATPase
MSSVFSGDETAPFFGFLGAAAALVFSCMGAAYGTANSGVGVASMGVMRPELVMKSIVPGVMPGVLGI

SEQ ID NO: 68570 - DNA, 608 bp, Zea mays
  misc_feature: Ceres CLONE 1545076
  misc_feature: Encodes the peptide sequence at SEQ ID NO. 68571
cgcggtggcggccgctctagaactagtggatcccccgggctgcaggaattcgtctcacccctagaaaaaaaagcagagttgatcgggattcctcgtctctggtctgtctgtgctccacctgctgctgctgccatggccatgggtagtctcgccttcgccacggcgctcgtcttcgtcttcgccatcgccgtgccggccgtcgcggccgccgcgcaggcccccgccccggcgcccaccagcgacgggacgtcgattgaccagggcatcgcgtacctgctgatgatcatggcgctggtgctcacctacctcatccaccctctggacgcctccgccccgtacaagctcttctgagcgagcagattttttctcctccattttttggtaggctttagtggtggtggtgtgggtgtgggtgagattcggtccctattcattgccatgaattacattcggtttcgcgcgcgtgtgtatattattaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcg

SEQ ID NO: 68571 - protein, 72 aa, Zea mays; identical to SEQ ID NO: 7477
  misc_feature: Ceres CLONE 1545076
  misc_feature (7)..(61): Pfam Name: DUF1070 Pfam Description: Protein of unknown function (DUF1070)

SEQ ID NO: 68572 - DNA, 769 bp, Zea mays
  misc_feature: Ceres CLONE 1545083
  misc_feature: Encodes the peptide sequence at SEQ ID NO. 68573
ttattttttaggaaagggcccacccacatatataaaagaaggaaaaaaaaccaaaatggagctcaccgcggtggcggccgctctattactagtggatcccccgggctgcaggaattcgtctcacccctagaaaaaagctcccactcgcaccgcccgtccgcccagaactatctcgctcgtccgcgttccgctcagctactccaatttcgcaacaagttgcaagccataaccgaccaaagacgaagaacgggtcgatggccacgctctcctcctgcagccgcctgaatagcggcaccggcgccgcggccctccaccggcagccgggccgtgctggaaccgtcctcgtcgtcacctggaggcggagctcctccgcgaacggtcgcgccgcaaccgctggccagggcggcgggggccggctgccgtaaaactgcagaacaagggggtaagtggatatatagggggtgtaaccccacaccctgggttggcggctcttggtaacaaaattggatcgaaggctgctgctggctgctggttggaacccacgtgggtggacctcccgaccgacttgccaattgcaaaagggtgggtcgcttgccgaagtggggcagcaattcccgagcttccgggccgggccgcccggttcaactggagaagaacccaccgagagggcctacccctaccctcccccggggcctaagggggcttgaaaccctggtttccataaaaaccccgggaggacgaacaaaaaaaatggggcccccggaaacag

SEQ ID NO: 68573 - protein, 56 aa, Zea mays
  misc_feature: Ceres CLONE 1545083
MATLSSCSRLNSGTGAAALHRQPGRAGTVLVVTWRRSSSANGRAATAGQGGGGRLP

SEQ ID NO: 68574 - DNA, 765 bp, Zea mays
  misc_feature: Ceres CLONE 1545090
  misc_feature: Encodes the peptide sequence at SEQ ID NO. 68575
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
tttttttttttttttttttttttttttttttttttannnnggccacccacaaaaagctggagctccaccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgacgcgctttccctggatgtcatttgattaattataaccaagtacgtgaagaaacgacggccagacgactgtcatccagcgattggttatttgtgaacttgtcgtttgtcttcttatttcaacttttccataaacccccttcgtgaagtgtcatcccccttcaaacctctgtccaactgttaccgtattacaaatcctatatcatcaaaactaaaagaccggcctcacttacaaattaacataaataaacccgaggacgcctcgcaaagataccccaattttctgccccctaataagtggcaagatcgtaaattaacggccgggcgaacttccaccttgggc

SEQ ID NO: 68575 - protein, 90 aa, Zea mays; identical to SEQ ID NO: 53771
  misc_feature: Ceres CLONE 1545090

SEQ ID NO: 68576 - DNA, 731 bp, Zea mays
  misc_feature: Ceres CLONE 1545093
  misc_feature: Encodes the peptide sequence at SEQ ID NO. 68577
  misc_feature (641)..(641): n is a, c, t, g, unknown, or other
ggagctccccgcggtggcggccgctctagaactagtggatcccccgggctgcaggaattcgtctcacccctagaaaaagacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatcccgcgtgagctcggcgatgtcaagggcgcctccgaaggagtgaagcagctggaggaaccaggcggcggcatcatgaaagcggcgcgcgccgagatcgcgggcgcgctaacaagatgaagaggagaccaccgcggagctggaggccaagctgacaagggacgcanccgtgtggagccgagctcgtaaagcgctccccaactcgaggcgcaaaagagaagctgtcaagcgctcgaccccaaatcgctcgctcatgg

SEQ ID NO: 68577 - protein, 155 aa, Zea mays
  misc_feature: Ceres CLONE 1545093
  misc_feature: SWISSPROT Homolog: EC 3.6.3.14 H(+)-transporting two-sector ATPase
MATALMVAATTSCSPGRAAPRLKPVASSSSSSSSSSSARPRRPLAQQLPRLLATAAAAAVAAAPLPALAEQMEKAALFDFNLTLPAIATEFLLLMVALDKLYFTPLGKFMDERDAKIPRELGDVKGASEGVKQLEEPGGGIMKAARAEIAGALTR

SEQ ID NO: 68578 - DNA, 814 bp, Zea mays
  misc_feature: Ceres CLONE 1545096
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (522)..(522): n is a, c, t, g, unknown, or other
nnnttttnnnnnaattaatgttgctttnnnnnnntnnnnnnnnnaacaccnnnnnngtatacctggactccccgcggtggcggccgctctagaatagtggatcccccgggctgcaggaattcgtctcacccctagaaaaaagcggcatctatagcaaccggtccaacactttcacgctcaagcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagccccctggtacggccccgaccgcgtcaaggaacctcggccccttctccgggcgagccccccgagctacctcacccggcgaggttccccgggttactacccgctcgggacaccgggcggaggtggggcgcccgacccccgaagacctttccccaaaaaacccgcgaagcttggaaggtgaatcccaactccccgncttgggcccatgacctcaggcgccgcctcaggactgaccatctttcccccgaaacctggctctcccccgccaaccggacgttcaaaagtttccggcgaaagcccggtcctggggttccaaagggccccggcttccccagaattctttccaatcgaaagggccgggagcctgggaaccaaccctcttggagcaaacccccagacccctgaaaatccctcggacgccaaaaaaacaaacccctcccccccaattctttggaggaccctcggcccaatggacccgctgggctccc

SEQ ID NO: 68579 - DNA, 642 bp, Zea mays
  misc_feature: Ceres CLONE 1545102
  misc_feature: Encodes the peptide sequence at SEQ ID NO. 68580
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (16)..(16): n is a, c, t, g, unknown, or other
  misc_feature (53)..(53): n is a, c, t, g, unknown, or other
nnnnnnnaaaaccccnaaaaaaaaaaaaaaaaaaaataaaaattaacagattnttcaaactggactccccgcggtggcggccgctctagaactagtggatcccccgggctgcaggaattcgtctcacccctagaaaatctcggctcggccgggctcctctgatcctctcccagtccggcaaaacacacctcccgctctcgcgtcgcgttcctgtcccgtcgtgacaagcacaaacacgtagtagcagcaaaccgaagcgacgcgtgcccgtcccgcgatggccacggcggccgcggccaggcaccaccaccagcaccagcaccagcagcgccggggtgcccagcgggggcggcgccgcgggagcgggatacggtgctcgtcgccggcgcaagagttcgcgtcgctggccgcggtgttccggcggcggctggtggtcggagccaccacggcggcggccgcggcggtgggggccaacttcggcggcgtcaccagcttcctgctgggcctgtcgccggagctcggccgctcgctccgcctcgacgtgctctaccccgtcggcggcttcacgcgctgcctcgactccgacaatgggttcgaattcatctatccatccaagtggggttggaagaccaaacgccaccg

SEQ ID NO: 68580 - protein, 121 aa, Zea mays
  misc_feature: Ceres CLONE 1545102
MATAAAARHHHQHQHQQRRGAQRGRRRGSGIRCSSPAQEFASLAAVFRRRLVVGATTAAAAAVGANFGGVTSFLLGLSPELGRSLRLDVLYPVGGFTRCLDSDNGFEFIYPSKWGWKTKRH

SEQ ID NO: 68581 - DNA, 653 bp, Zea mays
  misc_feature: Ceres CLONE 1545113
  misc_feature: Encodes the peptide sequence at SEQ ID NO. 68582
  misc_feature (653)..(653): n is a, c, t, g, unknown, or other
aagctggagctccccgcggtggcggccgctctagcctagtggatcccccgggctgcaggaattcgtctcacccctagaaaaatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaagcacatttgcaaacagctgtttgccttacactgggctgtatttgcttgagaactctctctttgggtggaactgccttgccccatggttctctcatcccactcgtactgctattcgacaacgctacaatcttgagggtagctttgaggctttcn

SEQ ID NO: 68582 - protein, 159 aa, Zea mays
  misc_feature: Ceres CLONE 1545113
  misc_feature (64)..(158): Pfam Name: PLAC8 Pfam Description: PLAC8 family
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQSTFANSCLPYTGLYLLENSLFGWNCLAPWFSHPTRTAIRQRYNLEGSFEAF

SEQ ID NO: 68583 - DNA, 642 bp, Zea mays
  misc_feature: Ceres CLONE 1545114
  misc_feature: Pfam Name: Kinesin Pfam Description: Kinesin motor domain
atagctggagctccccgcggtggcggccgctctagaactagtggatcccccgggctgcaagaattcgtctcacccctagaaaaattttaatacacgtgcttctcaagttgaagtattctctgatatccagcctctgatcagatcagttcttgatgggtttaatgtgtgcatttttgcctatggtcaaactggttcaggaaagacttacacaatgagtgggccaggcacatcaaaagaagattggggtgttaactatcgagctttaaatgacttgttttatatctctctaagtagaaggaatgctttctcatatgaggtgggagtgcagatggttgagattacaacgaacaagtgcgggatcttttatcaaatgatattgcacaaaaaagacttggaatttggagtacatctcagcctaacggacttgttgtccctgatgcaagtttacatccagtcaaatcaacattggatgtgctagagttgatggaaattgggcaaacaaatagagcagttggatcgacagctctgaatgataggagcagtcgatctcacagcattctaactgtgcatgttagaggggtggatttgaagaatggatctacttccagaggatgtctacatctgattgatcttgctgggagt

SEQ ID NO: 68584 - DNA, 825 bp, Zea mays
  misc_feature: Ceres CLONE 1545123
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
naaaaaaaagggggaacaannnacaaaacccccccggtntttggtaannnnnnacaaaactggaactccccgcggtggcggccgctctacactagtggatcccccgggctgcaggaattcgtctcacccctagaaaaactcttccccagatctggtggggaagaaccctacctcacgtcccggatcccatctggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgaaacagcatgcctaagataaagacaagtccgcgtcaagtatccctggaaggaaggggagcttatttgacccaaccatcccccacaattgggaatgcccaaaatgagaaaaagctgaaaaaaggatcccaccttgatgggaaaaaaaaaaaatgtggcaaaacctccccttgggcccctattttttccggaagtttcccccctcccaaaagggagcccccccccaacatatacatgaacccctttcaccaccgagaaaggaaaggggaaaatatatcccccggggataactctttaataaaaatattttgccctcgggacccccaaaacacttttctcccaaaaaacttttacccccttgaaaccgacaatatgtgggtaaaaatagagcccggagaaaatacccaaatcgggcctcttttgtgggagggcccc

SEQ ID NO: 68585 - DNA, 651 bp, Zea mays
  misc_feature: Ceres CLONE 1545125
  misc_feature: Encodes the peptide sequence at SEQ ID NO. 68586
tagctggagctccccgcggtggcggccgctctaccactagtggatcccccgggctgcaggaattcgtctcacccctagaaaaaactccctgaagtgcctgccaccacgccacgccgcgcccgcgatacaacgacttcctgcagtcctgcgctgcgcccctcctttccgcctccacggctccacgctgccgacgtccaccacacagcacggtcgagtcacccgatccctccatggcggcggcagtggcggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctggcagcacccgggttgcccggctagaagctcttctgtttgaagcgaaaagtgaatgggctgaagctgaaagagcttacaggcaaatcctggaaatcaatccatttg

SEQ ID NO: 68586 - protein, 140 aa, Zea mays
  misc_feature: Ceres CLONE 1545125
MAAAVAAVAAATTAEDEARLLRLEEQAEHGGGGAWDYLCLARRLRARRPAHVLRVGLALLNNASARSGLASEQWTLYEQVATAAMDCQRLDVAKDCIGVLSKQFPGSTRVARLEALLFEAKSEWAEAERAYRQILEINPF

SEQ ID NO: 68587 - DNA, 768 bp, Zea mays
  misc_feature: Ceres CLONE 1545126
  misc_feature: Encodes the peptide sequence at SEQ ID NO. 68588
  misc_feature (768)..(768): n is a, c, t, g, unknown, or other
gtttttcttttccttttacttgttgtactttttcccaacacatagcccgcgcccaacaaaattggagctcaccgcggtggcggccgctctataactagtggatcccccgggctgcaggaattcgtctcacccctagaaaaaacggcgtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccccggcggggactcgtcgtcgtcgtcgtctgactcggacgaagaaaataaggggtcctcgttggcgtcggcggcggacgcccagaaagccaagaactaccgccttttccgcccgggaaaggccgagaacttccaacctcggcggcggcaagtcttgcccatcctattcttaccgacgaaccgggaataacttctggtcggcccaacttgcctggtgctcacggaccctccgggtttcctattccaacatccatgccgtaaaaccatcccacccacccttggtatgggaccaatcatcgcctaatcccccctgacacgtgaagttacccaccaattattataagatataaaaaggcccccacacatactcttcaaccacataccgaacacccactctcctgaacatatatctcttctgaccgttcccactgaatcccccctcggtagaacaaacacgtgtatgn

SEQ ID NO: 68588 - protein, 83 aa, Zea mays
  misc_feature: Ceres CLONE 1545126
MADHKEEPVPESVMDKITEKFPGGDSSSSSSDSDEENKGSSLASAADAQKAKNYRLFRPGKAENFQPRRRQVLPILFLPTNRE

SEQ ID NO: 68589 - DNA, 981 bp, Zea mays
  misc_feature: Ceres CLONE 1545131-R
  misc_feature (981)..(981): n is a, c, t, g, unknown, or other
aattgggaacctcgagcgtcgcggaacgcctagcacccctacaccccatgtccccttgtatgcatatagcacccacatatgcaccttcacctatatgaacagaatcagcaggcaggtcttaagagaacaataccgttaataaatcttgaaataagttccaagaatattacgatcaaccctatcgatcaaggatttgaaccagttgacaccaaagaaacccaagcaactgacccttcgaagaggattcctgacggctgacgcccactcagataacggatgggtcattctatcacactagcgtcaaagaggattccctgaaatcaatggtataaacattttatggccttccaaggtgatatccaacggcgcatcatgtccagcatccttcacggtggcaagtcccaggccgctggcataactgcttgtgaatccagcagcttggccatcaacggtaccatgggtcgccaaaccctgaacaaattggcaaagtttgggcgtatctaaattccaggggttgggggggcccaacatggggggtacaaacaagcattaggggatccaccctctattattatgaggcggcccctggttgtgctttatagttgggctaaaccccggggaaagggggaaatttacaattaaacaccgctccggggataaccccaaaactttggggaaagggccaactgtcaaaggggcgtgagaatccgcgttttcccacaaggcggggcaaaaatttgttcacctcttttgcggggaaaaatcctagggggcctttttttcggaaactggggaaaaaatttttaagtttgtcccccacagtggttaggggagaagaaaagagtggatataaagcccctccacctgggactgttttctggatacacccccccgcaaataaaagaatgttggaggaacgattcttagtacgcgacgcaccgcgccggctgttattgtggcgaagacagaggaagcatagan

SEQ ID NO: 68590 - DNA, 628 bp, Zea mays
  misc_feature: Ceres CLONE 1545131
  misc_feature (628)..(628): n is a, c, t, g, unknown, or other
cgcggtggcggccgctctttatctagtggatcccccgggctgcaggaattcgtctcacccctagaaaaagaatctcaggcgtgccgaatggaggcagcaagagatggctgctactgctgccttctgagtttggtctctgctttgcccctcccttcttgtactcgtccgctccatcaaactccatgccgattcgcccatgtcattgtgaaactgacgtgtttggtactaccttcaaacagagcatgagcactggcactagtaccaggggggcgacctcatcaccgtctccagatgggtctgctgatacagtattgatgatcatctaatcaacctccccggcggtggggagccgtcctgcaccaccgacccctgttcctggcacacaaaactctcccattcatgtggagcgcgtcgaagatgaagttcacgctgtatctccctcgcgagtgcccccaccgaggatggacacgatatccttgagggaacctataacagtggctgacttgtaggttgacgcttcccaggaagggaacaaacaccacagggttgtggcagtgaatcacctctctcctctctgcagagaagggttccaacatgcatccccagtggcgtgcaagacccctcatgn

SEQ ID NO: 68591 - DNA, 637 bp, Zea mays
  misc_feature: Ceres CLONE 1545132
  misc_feature: SWISSPROT Homolog: EC 3.2.1.23 Beta-galactosidase
ggatcccccgggctgcaggaattcgtctcacccctagaaaaattgccatgtcccttttgagtacacatcagtatcatgcaggaggtaatgtctagtagtggtcggtttaggtggtgtaatcatgggaactccacatcagatacctggtctcttttgattgtgatgttatcttgcattattgctcctgctggagcttttaggatttgttgtaagctcatattttcctggggttttcgaaaaaaataaaaaaaaacgagacgctcgaggtacccaattcgccctatagtgagtcgtattactcgcgctcactggccgtcgtttttacaacgtcctgactgggaaaaccctggcgttacccaacttaatcgccttgcagcacatccccctttcgccagctggtgtattagcaaagaggcccgcaccgatcgcccttcccaacagttgcgccagcctgaatggcgaatggaaattgtaagcgttaataattttggtcaaaattcccgttaaattttttgttaaatcaacctcatttttttttacccaataggccgaaatcggccaaaatccctttataaatccctaagaatacaacctcagattgggtttgaagcggttgttccccggtttgggaaacacg

SEQ ID NO: 68592 - DNA, 735 bp, Zea mays
  misc_feature: Ceres CLONE 1545137
  misc_feature: Translation starting site: 196
  misc_feature (19)..(19): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (735)..(735): n is a, c, t, g, unknown, or other
gggtgttgtgggtggtgtntcccccccggcccctccccccaaccaaaannantaaaactggagctccccgcggtggcggccgctcttcaactagtggatcccccgggctgcaggatattcgtctcacccctagaaaaaaaagaagctccataattaattattgccctttcagttcgccatcgggagccgatcaccatgagctccacaggcggcggcgactatggcgccaagaagtcttggccggaagtggtcgggctcagcctggaagaagccaagagggtgatcctgtgcgacaagcccgacgccgacatcgtcgttgctgcccgtcggcacgccggtgaccatggatttgcgccccaaccgcgtccgcatcttattcgacaccgtcgcgtacgcaccccacatcggctgaggttttaatcctcaaaatgaatgactcggacatgccatgcgtacctgtccggcgccaaccaatggatgtgtgtgtgcttcgatcgttccctttagttgctaacaaaaataatggcctcggtcgttattgctgaattaaaagtatcaagattaatgttcacccccaaaaaaaaaaaaaaaacgagacgtctcgaaggtacccaaatttcgcccctatagttggagtccgtatttacgccccggcttctctgggcccgtcggtttttccaacgttccggggcctgggtaaaaaacccctgggggggttcaccccaaccctttaan

SEQ ID NO: 68593 - DNA, 679 bp, Zea mays
  misc_feature: Ceres CLONE 1545139
  misc_feature (208)..(208): n is a, c, t, g, unknown, or other
  misc_feature (214)..(214): n is a, c, t, g, unknown, or other
  misc_feature (219)..(219): n is a, c, t, g, unknown, or other
  misc_feature (228)..(228): n is a, c, t, g, unknown, or other
  misc_feature (232)..(232): n is a, c, t, g, unknown, or other
  misc_feature (386)..(386): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (480)..(480): n is a, c, t, g, unknown, or other
  misc_feature (500)..(500): n is a, c, t, g, unknown, or other
  misc_feature (608)..(608): n is a, c, t, g, unknown, or other
atagctggagctccccgcggtggcggccgctctagaactagtggatcccccgggctgcaggaattcgtctcacccctagaaaaaaccgagttcgtcggtcgtcacctgatattttttccgacggacacacaagcatatatacatacacgccgacatagggatgatggcttcctctagtcctcagcgtgcagccggcgccgccgtcgcncggcgntggcntagctgggntgangcggctgccgccctgtgatcgtgcgggccatggcgcagctgaccgcggactactacgactgcacatgccctgacgcctacaacatccgtgaagcaggtccctgaatcaaaggcgcaacaaaatcccgaaaagttggggcaatttttaccccccnggcccttaaagccgccttccaattttccaagaattggtttcgttccaaggggttggccaaaggggtctcggggggcccccccttggnnnncccnaaattacgcagagtagtggnccccacccacacccccctaaaaaatttgggggggcccggggcataaaaaaaaaaaatctctcgcggggggggggttcccccccgggggggggaaaaaaaaaaaaaaangggggcggccgcccttttattaaaaaaaaaaatcccccccccccccccccttttttttttttttttttttt

SEQ ID NO: 68594 - DNA, 890 bp, Zea mays
  misc_feature: Ceres CLONE 1545145
  misc_feature: Encodes the peptide sequence at SEQ ID NO. 68595
  misc_feature (154)..(154): n is a, c, t, g, unknown, or other
  misc_feature (836)..(836): n is a, c, t, g, unknown, or other
aattgctggagctcacgcggtggcggccgctctagactagtggattcttgggctgcaggattcgtctcacccctagaaaaaagcatctcaagtcttcacactcctcgccatcacataaaaccagtgcaagcagaagcagcgcaatggcaagcancaccatggccctctcctccacagccttcgccgggaaggcattgaacgtgccctcgtctctcttcggcgaggcccgcgtgacgatgcgcaagaccgcggctaaggcaaagccggcggcgacctcctgtaacccggggaagggggccgacccctggctcaacctggtgcctgctaccccgcgctccccccaacctcgtttaattttttccccccccccccggggggaagtacggggggacactttttaccctctcctctaaacctccccaggttcgttgctgcggccacacacacgtctcctgccggggcgcgagggcggggcgggcgtaagtctgccctgctgctgcctgacggtccgtcactgaggaggctgccccccggccgcgctacctcgcgcctcccccggcgccaggtcccatcttccgcggcgatagagtcgtgctcctagcggctccaatctggagagggggatcacaacaagacctgtaaataatcgcgtgcgactctcgtgtgaacacatcgcgccgatcctcctcacaagtgaacgacccgcagtgtctcgacctgttcagctcctactccctagttgccttcacgaccggtccgtattgccgattcgtcagctcagtcgagttaaacacgccagcgagggaacgccacctgcgacgctcatgctggcgcgngccgctatctgctcatcctgcgcccacgactcttcctatcctcactcgacaaag

SEQ ID NO: 68595 - protein, 89 aa, Zea mays
  misc_feature: Ceres CLONE 1545145
  misc_feature (4)..(4): Xaa is any aa, unknown, or other
MASXTMALSSTAFAGKALNVPSSLFGEARVTMRKTAAKAKPAATSCNPGKGADPWLNLVPATPRSPQPRLIFSPPPRGEVRGDTFYPLL

SEQ ID NO: 68596 - DNA, 750 bp, Zea mays
  misc_feature: Ceres CLONE 1545148
  misc_feature: Encodes the peptide sequence at SEQ ID NO. 68597
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
nnnnnnnnnnaaatgggccttttctctcctcctttnnnaannnctttttnnnnnccactgnnnttcaccggggtggaggaaggtttttccctaccccatcccccgggctgcaggaattcgtctcacccctagaaaaaactgcccctctaccctgcctgccgtttccatctccatccagttctccgcacccacccacccacccactccagtcctttccccaacccatggccggcgccgccgccgccgccggcacccgagaggagatggtctacatgggccagctagcggagcaggcggaacggtacgaggatatgggccagttcatggagaaagccgccggcgccgactagctcaccgtctaggagcgcaacctgctctccccctccctacataaccatagtcgggcgaatcttccccccctcgcccaccggaggcgggagacgatctaatggaggaaaagcgcgggctcccccgtggcacactagcgccgccaaagagtaccgcaggggggtcgtacgccaaaactttcaggaacacactaaatagattccccccccctccaatacagaccaccctcgaggagccctacagtccatacccgccaaacccttcgtcccttccttaccgtagctataaagggaggcaatccgccccaatctccaactcaccaaaagttctaaagaaaccatatcacaaagcatttacctagggaaccgcgtaaactccccccacggcatcccaccacataag

SEQ ID NO: 68597 - protein, 41 aa, Zea mays
  misc_feature: Ceres CLONE 1545148
MAGAAAAAGTREEMVYMGQLAEQAERYEDMGQFMEKAAGAD

SEQ ID NO: 68598 - DNA, 853 bp, Zea mays
  misc_feature: Ceres CLONE 1545155
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (403)..(403): n is a, c, t, g, unknown, or other
  misc_feature (404)..(404): n is a, c, t, g, unknown, or other
aaaagctggagctccccgcggtggcnnnnnntctnaactcatggatcccccgggctgcaggaattcgtctcacccctagggaagtcactcgtcactcatcactcatcagctattcttctcttctcctggacaactcaagctcaaaacccagggtcggccttgccgacccggatgcgagctaggcccccgcacgaccacccgtctcctgacggtcaccgggacctagcatcgccggggggcggagggaaaataaaacgtacgctattatgaaacttgatctgtattttccctcccgggatggagagaaataccacaattactattattgtctagttttccccggttgctccccccaccgttttttttttttcccccccccccaggggaaaagaaaaggggaatnntatttccttctttcctcacataattttcctccaacaaataacaaaaaaacctacgttaatctccgtgggagcgcgtgcgggcgttccataaggtctccacaaacagctcaattaactgccccatatttgtttgtatatttgtcggcctagaactgtacgtaatatgtccttctctccgtttctccccgcgtacgtagtacgactctcccataccacttcatcatcgccctctgtcgtattcctaattgtggtcagcagcactcataattgttgggattgtattcagcagaacttgtcgtctcgcctctgtactctagttagtatttcctgtttcccgagcagatttgtttcgccctctatcatattgctcgatgacatgtcgcttcaccccacgttcctcctctgttacttaacctcacccacgctctcttgtgattccagcactattg

SEQ ID NO: 68599 - DNA, 666 bp, Zea mays
  misc_feature: Ceres CLONE 1545158
  misc_feature: SWISSPROT Homolog: EC 2.7.9.1 Pyruvate, phosphate dikinase
ggagctccccgcggtggcggccgctctagaactagtggatcccccgggctgcaggaattcgtctcacccctagaaaaagaccgtctcttgccgtatcctatgactgacttcaaacgccttttcggtgctctggatggactcctggtgaccatccgactcctggaccctcccctccactagttcattccacaaagcaacctcctggactttgtaagtgaattgtgtgctgacacctgagcccaccaatatgatgccctctcgcgaattgaaaagctttcccaactgacccctatgcttggcttccatgtgtgcaggcttgcgtatatcatacccatgcttgacagacatgcaatgcctgtccatttttgaatctgcgataccaatgaccaaacaccgtgctcaggtgttcccccagataatggttcctcttgtagcatcaccacagaatctgtgacatccggtgacttcttatcctgcaagttgcagagaagctgctcgccaatgagggcgagactttcttgttcagagtcggaacgatgattgagatcctcggagcatctctgatcgctgatgagatatcgtagcatgctgcaatactctccttcaggacgaacgacctgacttcatatgacatttggaacctgcatgaatgtattcggtaaattc

SEQ ID NO: 68600 - DNA, 761 bp, Zea mays
  misc_feature: Ceres CLONE 1545162
  misc_feature: Encodes the peptide sequence at SEQ ID NO. 68601
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnnnnnaaaattttaaaaagaaaaccntcctctnncntttnncgnnnnnnnccaacactggagctcaccgcggtggcggccgctctatactagtggatcccccgggctgcaggaattcgtctcacccctagaaaaacggcgcgagcgttgcgctccacgccttcctcttcctcgtctggcatcgcgaaccgccgcaccccacccacccgcccacaggccacagcccacccccttctccaggtctctccccggcggcggcgggtgcggttctccggccatcaccgtgcgcaccaggaaaaactatgaggaggtacagccccccttatcgcagtccccccaggaggggatatggtggcagaggaagaagcccccctcctcccaggaggggatatggaggacgcaaggagggtagtggaagccttttggtccgcaacatcccattaagcgtcaaagcggaggatcctcccacctccttttgaaaggtttggccctgttcgggatgtttaacttcccaaggaactattactctggggagcctcccaggaatttgcctttgacagagcttggttgatcccttacgatgccccctgaaaccccagttatcccattaaatcccccaaatttttcccttgaggccgggaaaaaaaacctggttgctccttcgcccggccggaattcccccgaaaaaaaggcccccaaaaaaaaattggccgcccccccaaacccttaaaatgaaaataaggggttacctccctggggt

SEQ ID NO: 68601 - protein, 58 aa, Zea mays
  misc_feature: Ceres CLONE 1545162
MRRYSPPYRSPPRRGYGGRGRSPPPPRRGYGGRKEGSGSLLVRNIPLSVKAEDPPTSF

SEQ ID NO: 68602 - DNA, 704 bp, Zea mays
  misc_feature: Ceres CLONE 1545163
  misc_feature: Encodes the peptide sequence at SEQ ID NO. 68603
tccccgcggtggcggccgctctacaactagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccaggtcacccgcaccctcgacaagaacctcgctacgaacctgtttaagatgcttctcaagtaccggcctgaagacaaagctgccaagaaggagaggcttctgaagagggcccaagctgagaatgaaggaaaaactggttgatccaagaaaccaaattgttgtgaaagtatggccttaaccatgtgaccttacctcattgaccaaaacaagggctcagccttgggtggccttcccttcatggacgtggaatcccgattggaactgggttgttgggggcttccagccccctagtggcagaaaaaatggcaaggtcccctctacggggctctggtgaaaagg

SEQ ID NO: 68603 - protein, 120 aa, Zea mays
  misc_feature: Ceres CLONE 1545163
MAPKRGGRAPVPAKKKTDKVTNPLFEKRPKQFGIGGALPPKKDLHRFVKWPKVVRIQRQRRILKQRLKVPPALNQVTRTLDKNLATNLFKMLLKYRPEDKAAKKERLLKRAQAENEGKTG

SEQ ID NO: 68604 - DNA, 414 bp, Zea mays
  misc_feature: Ceres CLONE 1545170
  misc_feature (222)..(222): n is a, c, t, g, unknown, or other
aagctggactccccgcggtggcggccgctctagaactagtggatcccccgggctgcaggaattcgtctcacccctagaaaaaagcatctcaagcccaccatcgaccttcaagtctcgctacgtagcagtgcaataaaaaaagcagccgcaatggcgagcagcaccatggccctctcctcacggcctttcgcggcaaagccgtgaaacgtggcgtccgtcctnttccccgcccctttcggggaaagccccccttgaaaaatttcccaaaaaaacgcgggggaaaaagccaaaacccgggggggggggtttccggagaaacccccggtgaaaagcccccccaaccccggggtttttaacttggggccccactgtgggcggggggaaaccccccccaaaaaattttttttgaggggg

SEQ ID NO: 68605 - DNA, 604 bp, Zea mays
  misc_feature: Ceres CLONE 1545173
ggatcccccgggctgcaggaattcgtctcacccctagaaaaaagcttgctcagtagtggttgctagcatacatatccaatccaattatattgctacaatacaggcctacaccctcagctcaacgtcgacgtcggcgatgtgtctgccgttctcctgttgccaccgcggtgaccatgacacaaaggagtctgaagtggaaagccaaccttattatcatccgtctcctgtgaaagaagcacatgatggtcaccgtgcgaccaacgacatgcctcccgtcgtcgaggacaacagcaagaacggaggagggcacacgacgggtttcagcagccactcagacgacgggcgttgtcccgaggtggagagacgacgataactaccgaaaaagatctgggcgccgcccaccactactccagaacccgcaagctggtttcctaggaatctgcttggcaacaagctcctccagggtaccttatgtcccctggctaaatacacccttcccccaacccattgcccgtggggtcgtcgggaaaaatcgcctccccaagaagggcccctctcccccaaaatcttgaaccaaccccatttgccccccccgggaggggaa

SEQ ID NO: 68606 - DNA, 633 bp, Zea mays
  misc_feature: Ceres CLONE 1545174
  misc_feature: Translation starting site: 163
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaatatagttttctattggtttgtctgagtgactcagttggtcccctagactacctaccacctcggagtcgtattgatgaacatgtgatggtatatctgaagaacttttgttctcagttctcactcttgagttgcagcgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaag

SEQ ID NO: 68607 - DNA, 737 bp, Zea mays
  misc_feature: Ceres CLONE 1545180
  misc_feature: Encodes the peptide sequence at SEQ ID NO. 68608
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
tgggggggnnnnttggtggggtctttttaacaaatacaaaccacacatttacctaaaactggagctccccgcggtggcggccgctcttccctaaaggatcccccgggctgcaggaattcccctcacccctagaaaaaaaccgcacacgcacgcacgaacgcgctcccaccccctcccgccgccaccgccgccaaaaccccggcccgactcggcgtcctccgccaacctcctcctgggcagcgccggcgggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgccccaagttcaaaatccgcacagcatcaagtacaatggtactgttcagggtctcaagtatatctggagaacagagggcctccgtggacttttcaagggcaatgggtaccaattgtgcaaggaatggttcccaaattctgaccgtggaaggttttttagctaccgaggcagggggtccaaaaggaaattcctggggaggccttacccgctcaaacagaactggggggaaaaaagagaaggcccccaactttaaactcccggctcccttggcagg

SEQ ID NO: 68608 - protein, 153 aa, Zea mays
  misc_feature: Ceres CLONE 1545180
  misc_feature (42)..(117): Pfam Name: Mito_carr Pfam Description: Mitochondrial carrier protein
MASEDVVGKSRGDTAVTTIVNLAEEAKLAREGVKAPGHQILTICKSLVAGGVAGGVSRTAVAPLERLKILPQVQNPHSIKYNGTVQGLKYIWRTEGLRGLFKGNGYQLCKEWFPNSDRGRFFSYRGRGSKRKFLGRPYPLKQNWGEKREGPQL

SEQ ID NO: 68609 - DNA, 624 bp, Zea mays
  misc_feature: Ceres CLONE 1545187
  misc_feature: Encodes the peptide sequence at SEQ ID NO. 68610
cccgcggtggcggccgctctttcctagtggatcccccgggctgcaggaattcctctcacccctagaaaaaagcacggtggtatttggagttttgtgcagataagaccaccacgcatccaattcatccctgtcttctcttcccacttcccagtccccaatcgcgttctcttcctggccgacatggcggccgccaccggctacagcgacgccccaaccgacgagcaactgctggcgtactctgagctgcccatacatggccgcgacatggcggaggtgttcgccgtgcgcatcccggccatcgccggaggagacccgccgccccgtggcatcatctctttctacggcggccactgctgcagcgatttcatttacagctggaactcactggaagaggaagaagacacctcgaagcaaacctgcgacagccagggtaacctcgtgctaactgggccatcaatggccacctcggcagaaagtccaattgccttcaccttctacctccatgatggcagcccgcaagccggagaagccgctgaggacgacgaggacatcgggaggataatctgcgactgcatcggcgacgacttctccaactacaacagggccatagtcgagactgtccaa

SEQ ID NO: 68610 - protein, 148 aa, Zea mays
  misc_feature: Ceres CLONE 1545187
  misc_feature: SWISSPROT Homolog: EC 3.2.2.22 rRNA N-glycosylase
MAAATGYSDAPTDEQLLAYSELPIHGRDMAEVFAVRIPAIAGGDPPPRGIISFYGGHCCSDFIYSWNSLEEEEDTSKQTCDSQGNLVLTGPSMATSAESPIAFTFYLHDGSPQAGEAAEDDEDIGRIICDCIGDDFSNYNRAIVETVQ

SEQ ID NO: 68611 - DNA, 723 bp, Zea mays
  misc_feature: Ceres CLONE 1545189
  misc_feature: Encodes the peptide sequence at SEQ ID NO. 68612
aaagctggagctccccgcggtggcggccgctctagaactagtggatcccccgggctgcaggaattcgtctcacccctagaaaaagatgcaccaaagccctagctcggctcacttgctttcctggccgccgtctcctccgcggctcttaacgccgcatccactcgccggttcttaacgccgcccgccgcctcctccgcggctctgccctcccgccgctgccgccgcctacccaggaatcaggatgcgggtgaagaagcggtcgaagcaccgcaaagcggtcaagttctacgccacatgcttcggcttccgcgagccctataaagtcctcatcgacggcaccttcgtccaccacctcctcacccagcgcctcctcccggccgacgaggctctccgagacctcctctcggcctccaggacgccagccctcttcacctccaagtgcatcctcgcagagctcagacgtctcggcaagtcacatgccgaatcatttgacgccgcgcagcttctcaccacaaccaagtgtgagcatgacaaggtggtcggtgcagttaactgtgtccagtcactgataggtgataaaaatcctgaacatttcttcgttgccacccaggatcctggtctccgagaaaacttacgagagattcctggggttcctgtgatatatggtctgaagaactctttatgcatagaacggccctctatgcagcaacgcaagtttgctcc

SEQ ID NO: 68612 - protein, 160 aa, Zea mays
  misc_feature: Ceres CLONE 1545189
  misc_feature (51)..(152): Pfam Name: Fcf1 Pfam Description: Fcf1
MRVKKRSKHRKAVKFYATCFGFREPYKVLIDGTFVHHLLTQRLLPADEALRDLLSASRTPALFTSKCILAELRRLGKSHAESFDAAQLLTTTKCEHDKVVGAVNCVQSLIGDKNPEHFFVATQDPGLRENLREIPGVPVIYGLKNSLCIERPSMQQRKFA

SEQ ID NO: 68613 - DNA, 742 bp, Zea mays
  misc_feature: Ceres CLONE 1545200
  misc_feature: Encodes the peptide sequence at SEQ ID NO. 68614
  misc_feature (405)..(405): n is a, c, t, g, unknown, or other
agagctggagctccccgcggtggcggccgctctagaactagtggatcccccgggctgcaggaattcgtctcacccctagaaaaagtcatcaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacaacncggccgccatctcctaccagctgaccccggcgtcccggctgctcgtcagcagcagcagcgtcgacgacgccgccggcgcctcgaaggagaacactactaccccgagcatcctccccaacatcgcccacctggtccgccccaacaccaatctcctgctgttcaacatgggccagtggatgaaagacaaaaccccggtctccgtgtcgctttacaaaaccgggcaccgccaggggaattgggccttcctggaagaacaacccggccaacagggccactttctccaaaaactggaccccccacccccggcctcggatgcaggccgtggtccccccgggcc

SEQ ID NO: 68614 - protein, 210 aa, Zea mays
  misc_feature: Ceres CLONE 1545200
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
  misc_feature (99)..(99): Xaa is any aa, unknown, or other
MGHQQAQHGKDDTEELLAAHRQLWCHALGYVKSMALKCALDLRIPDTIDRCGGSATLGELLAASEIPASNHDYLRRVMRTLTAMRIFAASHDPAKADNXAAISYQLTPASRLLVSSSSVDDAAGASKENTTTPSILPNIAHLVRPNTNLLLFNMGQWMKDKTPVSVSLYKTGHRQGNWAFLEEQPGQQGHFLQKLDPPPPASDAGRGPPG

SEQ ID NO: 68615 - DNA, 776 bp, Zea mays
  misc_feature: Ceres CLONE 1545202
  misc_feature: Encodes the peptide sequence at SEQ ID NO. 68616
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (776)..(776): n is a, c, t, g, unknown, or other
aaaaaaaaatattattacaaaaaaaaaaacncnnnntatgagggaataaaattataaaaaaaggaactccccgcggtggcggccgctctagaactagtggatcccccgggctgcaggaattcgtctcacccctagaaaaaatacaagccgttgacgcaccagatggcccttccaaaatggctaatgtaaatgataagaatcatgattctcatatcgaagtgacaccccatgagttgggtttgaagagatcgagaacaactggagctacagcggaaatccatgatgagcgaaatattctgaaaagatcagatcagtcagccttcaccaggtaccatacatctgtggtttccaatcaaggtggagcaagatatggggaaagctcttcatcacaagataacagttctgaggccatgaaaacggactctacatgcaagatgaagtccaattcagatgctgctccaataaagcagggcctccatgggcagtaacaataacgatgtggggatccactacaaacaaatgttgcctgcaagggccttcgggtggacaggggagagaagtagccgcccccctttaacccacaaaatctaacccaacatggcctccgccatttcccaacctcttcccagaaatccgaaacggtcacccagcctaaaaccttaaattgggggaaaaaaacaaacacccggaattaaaacgaaaatttttcccaaaatggcccctggaaaaaaatggaaagcccccctccccaaacaaggaaagtgtttttcctttan

SEQ ID NO: 68616 - protein, 103 aa, Zea mays
  misc_feature: Ceres CLONE 1545202
MANVNDKNHDSHIEVTPHELGLKRSRTTGATAEIHDERNILKRSDQSAFTRYHTSVVSNQGGARYGESSSSQDNSSEAMKTDSTCKMKSNSDAAPIKQGLHGQ

SEQ ID NO: 68617 - DNA, 716 bp, Zea mays
  misc_feature: Ceres CLONE 1545208
  misc_feature: Encodes the peptide sequence at SEQ ID NO. 68618
  misc_feature (11)..(11): n is a, c, t, g, unknown, or other
  misc_feature (13)..(13): n is a, c, t, g, unknown, or other
  misc_feature (20)..(20): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
atttttgcgtntncgccccngttgtgagaaaaatttncttnnnnnnggcgcattgttcaaactggaactccccgcggtggcggccgctctaccactagtggatcccccgggctgcaggaattcgtctcacccctagaaaaaaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggaaccttcgccgtggtcaggtccgccaaggtcgaccgctgccaggagcccgccacgctagcagcaaccgaggccaggcccgccaccgacggacgccgcgccgtcatgctcgcggctgctgctgcggccgaggcagccatctgcggcgccggcgccgccatggcgggccccaagaacgggacccccgaggcgaagaagaaatacgcggccatctgcgtcaccattcccaccgccaagggtctgccacaacttgaacccgcccgccgttgcaagctgcaggggcccggggggtgggtataaaatttaaggtaccgcgccaccggtagtttggtgtcccccaattggttgggttccgaagctttaaaaatcgcatgcccttggacgtagtagggccggcctaaaatgtgcgtttcactga

SEQ ID NO: 68618 - protein, 120 aa, Zea mays
  misc_feature: Ceres CLONE 1545208
MASLTMMASFAAVAVAAPSRRGTFAVVRSAKVDRCQEPATLAATEARPATDGRRAVMLAAAAAAEAAICGAGAAMAGPKNGTPEAKKKYAAICVTIPTAKGLPQLEPARRCKLQGPGGWV

SEQ ID NO: 68619 - DNA, 598 bp, Zea mays
  misc_feature: Ceres CLONE 1545210
  misc_feature: Encodes the peptide sequence at SEQ ID NO. 68620
  misc_feature (212)..(212): n is a, c, t, g, unknown, or other
  misc_feature (287)..(287): n is a, c, t, g, unknown, or other
  misc_feature (300)..(300): n is a, c, t, g, unknown, or other
  misc_feature (305)..(305): n is a, c, t, g, unknown, or other
  misc_feature (335)..(335): n is a, c, t, g, unknown, or other
  misc_feature (375)..(375): n is a, c, t, g, unknown, or other
ctggagctccccgcggtggcggccgctctagaatagtggatcccccgggctgcaggaattcgtctcacccctagaaaaaactagatagctaggattgcattgtgttccaccaaaagccagccacaacacatcgacatgatgcaggacttgttctcggtcccttcgtgtttctcggcgggcgagaagcttccggacgtcccggcgtccgctgncgccaccaccaggtccgggcagagcgcggcgacgctggtctaccgcgcgggaatcgcccggcacgaccggctggntgacgtgacgtgntgcangaacctgctcaccacgggctgaccgtgtcnatcaaagggtcggcgggccggcgcaaagacaaaaaccgcngccgcatgtattgggggcgaccccaaagtggcgcgggcctcctcctccaaaaagggctggaacacccccctgcaaggggaaaatgcaaccctgtgccccttttgggccaaggacgggggccaagaaattccccctcaacggccagggccctggaaacttggccttggaaccccagggaacccgaggtacccgaacgtagcccaaaccgcttgtccgactactc

SEQ ID NO: 68620 - protein, 63 aa, Zea mays
  misc_feature: Ceres CLONE 1545210
  misc_feature (26)..(26): Xaa is any aa, unknown, or other
  misc_feature (51)..(51): Xaa is any aa, unknown, or other
  misc_feature (55)..(55): Xaa is any aa, unknown, or other
  misc_feature (57)..(57): Xaa is any aa, unknown, or other
MMQDLFSVPSCFSAGEKLPDVPASAXATTRSGQSAATLVYRAGIARHDRLXDVTXCXNLLTTG

SEQ ID NO: 68621 - DNA, 818 bp, Zea mays
  misc_feature: Ceres CLONE 1545213
gctctagaactagtggatcccccgggctgcaggaattcgtctcacccctagaaaaactccctcctcctcctcctccttcctccttcctctcgctcgctcgctcccctcccttcccccgctccctctcctcctcctcccttcattcctacctccgctcgcgccactctcctccgaccgaggggcagggaacggtgcccacccgcccgcccgtccgaccgccatggtctcctggcggcgcagcgcgtcctggctgtcgtctgcgtcgcgctcctcgctcggcaccgccgtcggaggggaggccaaggtcaccgccggaggcggatccggccgccccatcaccaccaggcccgagaaggagcgtctggtcgccccttgctgcccggatctcccccacggagtatcatgcccccccgtcgactcccgggcccccaagcttctggcccgccgtcgcctgggactttcttcggttctgccgccctgcgcggggcccgcccggtcggtgtctcacctcctcccgagcctttgcgtacgtccctgctcccacctttctcgcagttgatcaccaaggatccccgcctctcctccgactcttccgttcaatccgggccctggcaacccttcgccaatccgccgcaaaggccatggctttactccctcccagcggacaatacatcatatcctgtgtcctcatgcctgcctagcgctacgccgggcaccacaagctccctcgatggagtataacaggtcatagttgtctatgtggagacgtcgtccagcgtgctccatcacgatcagcgctactcgcatccgcaagactg

SEQ ID NO: 68622 - DNA, 708 bp, Zea mays
  misc_feature: Ceres CLONE 1545217
  misc_feature: Translation starting site: 155
  misc_feature (462)..(462): n is a, c, t, g, unknown, or other
aaagctggagctccccgcggtggcggccgctctagaactagtggatcccccgggctgcaggaattcgtctcacccctagaaaaaacgcctcacaccaccatccggacgctagctcaccaccaatgcttgcacatcgaggagaagaggagtggccatggcttcgtcggtggccaccgcggagagcacattcctgggcacccgcctggaggacccggcgccgcagaacgggcgcatcgtggcccggttcgggttcggcggccgacagcccaaggctgccgtcccaaagaaggtgcctaagacgtcgatctcctctgaccggacgctgtggttccgcggcgtcgtggcacccgactacctcaacggatcgatggtctgcgactacggtccgacgcgttcgggctcggaaagcccgtgcagtacatgcagttcgaactgtactcactggaccagaaccctgactanaaagagacggacgcatcatctgcacccggtggagtccttccgactctagtccaccccgctctagccatacaggaggggatcggcctcccacggtcccaaaattgcaatccctctccacgccgaggcccctgctcctcatcccttgggccctccacgttaagaggtctcacggggcaccctgacggaatctggcaagggggaactggggaaaggttctccctccttggggccaaccccttccttttc

SEQ ID NO: 68623 - DNA, 713 bp, Zea mays
  misc_feature: Ceres CLONE 1545220
  misc_feature: Encodes the peptide sequence at SEQ ID NO. 68624
  misc_feature (40)..(40): n is a, c, t, g, unknown, or other
  misc_feature (450)..(450): n is a, c, t, g, unknown, or other
  misc_feature (451)..(451): n is a, c, t, g, unknown, or other
  misc_feature (713)..(713): n is a, c, t, g, unknown, or other
cgctcttaactagtggatcccccgggctgcaggaattcgntctcacccctagaaaaaaaaggccctctcacgctcacgcccccggacccttctccccgcgccgccgctcgccggagctccgcgtctccgcccgcgccacaccctgtagaatcctcaatggctgccgcaaggggcattaaccagctcctgaagagaactctctacaaccagtctgctggttcgtcgccgcttttctcatttcggggaaagcatgaagaaccctctgctggactgagagcattggctcttcttggatttggtgcccctgggccttttgaatttttccaccataccacccccccaatgaagggggagcgggggcttggccacccccccaaattatccccctggccccattgcctgggaatccatgaagcccccccaaacaacccgcgcttttcacaatttccnngcgcggggccctccccaatttacacccccaagttttgttgccctctttgtccccccccatggcctttatattcacaacaccccgatttgagcggtggcggttgcctccttactcgcgaaaaaaaaaaccaaagggcacggggcgccctctcaatatataaatccatgtttatatggcacccaatcgcaggaaggggggccactgagcttccccgcctcctcatgaaaactgagtcggtattgccttcccccatcgtgctgtn

SEQ ID NO: 68624 - protein, 185 aa, Zea mays
  misc_feature: Ceres CLONE 1545220
  misc_feature (99)..(99): Xaa is any aa, unknown, or other
MAAARGINQLLKRTLYNQSAGSSPLFSFRGKHEEPSAGLRALALLGFGAPGPFEFFHHTTPPMKGERGLGHPPKLSPWPHCLGIHEAPPNNPRFSQFPXAGPSPIYTPKFCCPLCPPPWPLYSQHPDLSGGGCLLTREKKNQRARGALSIYKSMFIWHPIAGRGATELPRLLMKTESVLPSPIVL

SEQ ID NO: 68625 - DNA, 690 bp, Zea mays
  misc_feature: Ceres CLONE 1545223
  misc_feature: Encodes the peptide sequence at SEQ ID NO. 68626
  misc_feature (355)..(355): n is a, c, t, g, unknown, or other
cgcggtggcggccgctctagaactagtggatcccccgggctgcaggaattcgtctcacccctagaaaaacctgagaaatggcggccgtctcctccacctcaaccgcctcctcctacttctccccgcagccgcagctgccgatctccaccgccgaccctgccgccagcaaaagtaggttgatgcggcagccacggcggagcagcagcttcgtgatggtggaggcgtcccgtgccagcgccagcgagggcgggggggccaggacaaaaacccctcacggaggaagacctgaaaaacctggggggcttgcctcaacctcggcttcggattcgggaaacggggaaatacccaaattttntggggaacgctgcccccgcccttaaaattttggtaactcctgggacccggaggtccccccaaaaaaaaaaaacgcccccgggggaaaaaaaaaaaatattgaaccctggctcccccccccccccccccaaaagggaaaacatcccccgcgcccggggggcactcccctaaaaaaaagggggcggggggggggtgggaaattttgtggcgcccacccttttgttgtagagccccgttaacaaccctctctccccctaaaaaaaaaagggggggaaaaaaaggagcgaaaaaaaaacccgggctttttgggggtttggggaaaaaaaaagggaagag

SEQ ID NO: 68626 - protein, 100 aa, Zea mays
  misc_feature: Ceres CLONE 1545223
  misc_feature (93)..(93): Xaa is any aa, unknown, or other
MAAVSSTSTASSYFSPQPQLPISTADPAASKSRLMRQPRRSSSFVMVEASRASASEGGGARTKTPHGGRPEKPGGLASTSASDSGNGEIPKFXGERCPRP

SEQ ID NO: 68627 - DNA, 807 bp, Zea mays
  misc_feature: Ceres CLONE 1545227
  misc_feature (807)..(807): n is a, c, t, g, unknown, or other
gtttttaggaagtgaaacgcaccgaggagagggtggggtgtttgctatatatgggtatacttggactccccgcggtggcggccgctcttcaactaatggatcccccgggctgcaggattcgtctcacccctagaaaaatacccaaccagaagagcggcggcgcgggcggacaaggagcatgcggaggaggagttgtgccaagccacaatgggtatctcgcgtgactcgatgcacaagcgccgagccaccggtggaaagcacaaggcctggacgaagaaacgaaagtatgagcttggtcgccagccagccaacaccaagttgtcaagcaataagacagtgaggagggtccgtgttcgtggaggtaatgtcaaatggagggctcttcgccttgatacggggaactactcatggggggagggaagctattacccgcaggaaccccgtatcctcggacgtgggtcctacgtgggaggccaacaagtggagcttgggggagggacacagaaccccggggggaagaagtggccgggtgtggcaagtttggagtgggggcccccattcggggggaggggggaagcgcttccacgtggcggatgggaagttgacagattgggggaggaggtgagggaaaacccccggtggtggggtagtaaagggatagagttgcgtggagggggacaacggagggttggagggcgggcgcccgcgaaggggaagcccaaaaaagaagccatggcatggtcaacgagaggaaaggtttagggaagaaccggaaaggggggggacgggaaccgctgtgaacgggan

SEQ ID NO: 68628 - DNA, 711 bp, Zea mays
  misc_feature: Ceres CLONE 1545235
  misc_feature: Translation starting site: 345
  misc_feature: SWISSPROT Homolog: EC 1.9.3.1 Cytochrome-c oxidase
  misc_feature (461)..(461): n is a, c, t, g, unknown, or other
  misc_feature (501)..(501): n is a, c, t, g, unknown, or other
  misc_feature (524)..(524): n is a, c, t, g, unknown, or other
ggagctccccgcggtggcggccgctctagaactagtggatcccccgggctgcaggaattcgtctcacccctagaaaaaaaatcgaatcgagcccatccatctccatttccgccgccgccgccgccgagagaccccaaccccacccatccaccaccatgtggcgccgcctccacaccctagcccccgccttgcgcagggctaccgccgccgccgccgccgccggggcccctgcggcgtccgcttcctctgcagcccgcgccgccccgctctcctcggcggccgccgctttccgccgcaccagcccgctcctctcaggggacaagccggcgagtgtggaggacgtcatgcccatcgccacggggctcgagcgggaggagctggaggccgagctcaaggggaagaagcggtttgacatggatcccctggtcggccccttcggtacaaggaggaaccatctgtangtgagtcctactataacaagcggatagtcggctgccctgntggtgagggagaagatgaacacnatgttgtatggttctggttgaaaaaagatgaaccgcattgagtggtccagtcctgctccccataactttgggccttaaggccattggtgatggggggtgatcccaaatgggccctgacccatggagaatgaatggaactcccctaaggatgcccttgggggttctgaaaaaaaaagaaattggggga

SEQ ID NO: 68629 - DNA, 724 bp, Zea mays
  misc_feature: Ceres CLONE 1545246
  misc_feature: Translation starting site: 241
  misc_feature: SWISSPROT Homolog: EC 3.4.25.1 Proteasome endopeptidase complex
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (42)..(42): n is a, c, t, g, unknown, or other
  misc_feature (48)..(48): n is a, c, t, g, unknown, or other
ccccnnccccncccggcgcgcgatcgacgccggcatcccctncgccgncgggtcctattagtactttcattaagcggcggccgctctatactagtggatcccccgggctgcaggaattcgtctcacccctagaaaaagggtgccagacaaattcagcaaacaagcaaaaggcacgaccaccaccgccggccgggaagcaagctcaaaccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgcgggccctgaaagcggacgcgcgcgtgctcatcaaccgcgcgcgggtcgagtgccagagccaccgactcaccgtcgaggaacccgtcaccgtccgagtacatccccccgctacatcccttggggcttgcagcaaaaagtattctgcagaagtggggggaagtccaccccctttcggacctttcccaacccccaattggtcagagcttccaaacccccataacaccgaacaaagccaagggtgcctgttacccatgaaaccg

SEQ ID NO: 68630 - DNA, 638 bp, Zea mays
  misc_feature: Ceres CLONE 1545250
  misc_feature: SWISSPROT Homolog: EC 3.2.1.23 Beta-galactosidase
aagctggagctccccgcggtggcggccgctctagaactagtggatcccccgggctgcaggaattcgtctcacccctagaaaaaatcgctgatcctacataaacagaggctactgacactccacctgctgacgcttatcctagagatacacggaatgcgtacttgacgaggaatgaaggaggagcagtgtgccttgagctctccagtgttgtacaaagacatgtttctttctgaatcccagagggagaaagatgtatgaagcgtgtatataagatctcagctagcagattgttttcatctgcatgagcgatcgaaggctgtacaatatactcaacgtacacaatacgagacgctcgaggtacccatttcgccctatattgagtcgtattacgcgcactcactggccgtcattttacaacgtcttgactgggaaaaccctggggttacccaccttaatcgccttgcagcacatccccctttcaccagctggcgtattagccaacaggcccgcaccgatcgcccttcccaacatgtgcactgcctgaatggcgattggaaattgtaacccttaatattttgttaaaattcgcgttaaatttttgtcaaatcagctcattcttttaaccactaggccgaaat

SEQ ID NO: 68631 - DNA, 840 bp, Zea mays
  misc_feature: Ceres CLONE 1545252
  misc_feature: Encodes the peptide sequence at SEQ ID NO. 68632
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (371)..(371): n is a, c, t, g, unknown, or other
  misc_feature (414)..(414): n is a, c, t, g, unknown, or other
  misc_feature (427)..(427): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (498)..(498): n is a, c, t, g, unknown, or other
  misc_feature (516)..(516): n is a, c, t, g, unknown, or other
  misc_feature (584)..(584): n is a, c, t, g, unknown, or other
nnnnggggttttnaaaattttttttnnnnnnnnnnnnggtcccccnnnnngtgccccacactccccacagtggcggccgctctttactagtggatcccccgggctgcaggaattcgtctcacccctagaaaaatccccccctctccacactgccaactcgctccgaagagggaggaggacgacgccggttgccactgccactgccgcgccgcgccgctccggtctcccctccctccgcgggaactcgacgccaccatgctgtccacccgcaccgccgccgtccgccgcctccgcgtcccccgcctccccttccaacttgcgaggaacgaacctaggttttccccccctggggagggaggccctaacctccngcaactttccttccaaaataaggtccaaccccccccaaggcgnttttttttccccnacctttccccggggggaaagaagggggggtannnnctccacatctataatctcttataccctttcatctcnataacacaaaaacaatancctccccccctccccgcggggggggggcgcgcgcccctcgttcccttgcgcaccacccaccccctctnctcgaccgctccgaccccgcatccctctccgccccgctccctctcacccacccccccccccatctgccccctctctttaccacccgggtcccaccctcccctccccccccccctctaatgttgtccgccctcacctcctccccccccgcacctccactccaccccccccccatttatcccccccctatccccattatctgccccaacgcctctcccccctccctcagcaaccccctcgcgcctcctaccctcagtc

SEQ ID NO: 68632 - protein, 148 aa, Zea mays
  misc_feature: Ceres CLONE 1545252
  misc_feature (39)..(39): Xaa is any aa, unknown, or other
  misc_feature (58)..(58): Xaa is any aa, unknown, or other
  misc_feature (68)..(68): Xaa is any aa, unknown, or other
  misc_feature (69)..(69): Xaa is any aa, unknown, or other
  misc_feature (87)..(87): Xaa is any aa, unknown, or other
  misc_feature (110)..(110): Xaa is any aa, unknown, or other
MLSTRTAAVRRLRVPRLPFQLARNEPRFSPPGEGGPNLXQLSFQNKVQPPPRRFFFPXLSPGGKKGGXXLHIYNLLYPFISITQKQXPPPLPAGGGRAPLVPLRTTHPLXSTAPTPHPSPPRSLSPTPPPICPLSLPPGSHPPLPPPL

SEQ ID NO: 68633 - DNA, 734 bp, Zea mays
  misc_feature: Ceres CLONE 1545256
  misc_feature (408)..(408): n is a, c, t, g, unknown, or other
  misc_feature (606)..(606): n is a, c, t, g, unknown, or other
  misc_feature (610)..(610): n is a, c, t, g, unknown, or other
  misc_feature (734)..(734): n is a, c, t, g, unknown, or other
gagctccccgcggtggcggccgctctagaactagtggatcccccgggctgcaggaattcgtctcacccctagaaaaatcccttattctattcctccacaccgatcactcgctgctcccctctctcgccggagctccgggccggatggcggctgtagcatcagctcctcccgcctccgtgatcgcgtgatggacgcacacaccgccgcgctcctcccatggacgacgccggaaggccaccactcccaccttccgtggcggtgacctcctccgcatccgcctttccccccggcgcgggagggcgctccccaaccctcctttctttttgcagtaccaaaggcctcactcccacccctatttttttttccccccccccccccggggaccgaccgggggggccttctatcttnttttaccccccccgggtgggggcgggggggggcgagggggcgcggctggcggaggggggggggcgggcccacctcccagcaacgtccagtggctaccttctcgcctccaccatagtgtcccctgttcatcaatacccaccccaccgctcatctcttcgcctatattccaccctatctcctcctccctccccccgcctntagngcctcccccacaaactccccgactccccccgccacgccccaccgcttcttcacccccatacctctcccctctaccctgctacacccacataaactacactccaccacaaccaccccccctctan

SEQ ID NO: 68634 - DNA, 650 bp, Zea mays
  misc_feature: Ceres CLONE 1545257
  misc_feature: Encodes the peptide sequence at SEQ ID NO. 68635
  misc_feature (605)..(605): n is a, c, t, g, unknown, or other
  misc_feature (629)..(629): n is a, c, t, g, unknown, or other
ggagctccccgcggtggcggccgctctagaactagtggatcccccgggctgcaggaattcgtctcacccctagaaaaaagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtctacgaccgcttcggcggcctgcctctcgacgtcctcgccttcgtcgacccgcaggtggacgacactgtgcacgaggtggacaagcacctcccgggcgcgctgaaggcggcgtcggcgcatgtctacgcggtggtttcgggcgtgcccgaagtggcncgcgagctggcggccgaagcgcancggtcgggcgtgaggggcgca

SEQ ID NO: 68635 - protein, 147 aa, Zea mays
  misc_feature: Ceres CLONE 1545257
  misc_feature (19)..(147): Pfam Name: REF Pfam Description: Rubber elongation factor protein (REF)
  misc_feature (140)..(140): Xaa is any aa, unknown, or other
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVLAFVDPQVDDTVHEVDKHLPGALKAASAHVYAVVSGVPEVARELAAEAXRSGVRGA

SEQ ID NO: 68636 - DNA, 813 bp, Zea mays
  misc_feature: Ceres CLONE 1545258
  misc_feature (1)..(1): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (813)..(813): n is a, c, t, g, unknown, or other
nttttttcctttcgccccggtatagctatttccccnnccccccaattnnttaaatctgagacccccccnnnnggcggccgctctaaactagtggatcccccgggctgcaggaattcgtctcacccctagaaaaaccatcggcatctcggcaagacgacaacacatgccacagccacacgcgacacacctgtctcggctgtggcgagcgcgatggccgcaaacgtggcgctggtgctgctatcctcctgctcgccctccacttccgccgccgccgcctcgctcctccctcgccgccgcttcctgccctcccgccgaagaagagcaagctcccgagccaccaccatcatgtccggcgttgggcgatgacccgatcagggaaatggattcttacagaaaggaaggccccgcagataaaatgtatccccccccctgggggggggggggggggggggactccccctccacctctatcatcacccgaaggcggggcccccttctcttgatgaagaacccacccccccccccttgggcccccgaaaaatgttccgacaaaggggaagggcttctctggttttgggaaaggccacacgctatggaaaaccaacagtcccaaaaccccccgtgttctctctggcccctaaaccacgcgcttggccacctctaaacactccccggggcgggtttcttctacaatctcaacacaggcaaaactcttttcgccatctctcccaccgcttcaagggccccacccattactcatacccacccccccgccccagtccgccccccgttccacaatcgccgcccacctgn

SEQ ID NO: 68637 - DNA, 656 bp, Zea mays
  misc_feature: Ceres CLONE 1545259
  misc_feature: Translation starting site: 126
  misc_feature: SWISSPROT Homolog: EC 4.1.1.39 Ribulose-bisphosphate carboxylase
ggtggcggccgctctatactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcacgtgtggccggcctacggcaacaacaaattcgagacgctgtcgtacctgccgccgctgtcgacggactattttttccccccccgtggagggggggcgggggggaccactggataccttgccctcgacgttcgcaaaggccggccttcttgtacttggaaaagctccagctcccccggggtattacgacgggcgcttctgggcccatgtggaaaagttgcccaagtttcggattcgcaccgacgcccccccattgtgttaccaaggatgccggcggggagggccaatgaaataaccccacccgtgacacccctttgtcaccccgcgttatttttgcggcctttcgcccaacactccccgcggataacaactttctcgctcttctag

SEQ ID NO: 68638 - DNA, 759 bp, Zea mays
  misc_feature: Ceres CLONE 1545266
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (16)..(16): n is a, c, t, g, unknown, or other
  misc_feature (20)..(20): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ttttttcnnnttttgntggntatcacacaagaaggtggggnaatannnnnnnaaaaactggagctctccgcggtggcggccgctctagaactagtggatcccccgggctgcaggaattcgtctcacccctagaaaaaagggtgccatactctctctagatgtttttaaatgaatttgcagtgatttttttggttccatgttgttgttgccttcataagtcccatcaccttcgctccaaaatgtcatgtgttacgttttgatataagtttaggttgctttgccgattcatggattaaagtgccctcaagaacatttatgctgattccttgatgtaacaccgctggatgatattgtgggcatcaacatgttctcctaacaaataaaaaaataacgagacgctctaggtacccaattccttctatactgcttcgtattaaggggggggattgacccttgtttttacaaagttctcgactggtaaaaactttgtgcgttttttaacttaattggcctttgaggcacatacgcccttttcgccatgctggccgtacttaacgaataaggcccccctcccattcgctcccttcccaaacgatggccgcaagcctgatttgggctaaaagggaaatttgaaatacctataataattttcggtcaaaatcttcccgtaccaatattttctgtgaaaatctggccctacttttttctttatacaccttacggcccgaatactccgggttaaatgcccctttataaaaa

SEQ ID NO: 68639 - DNA, 660 bp, Zea mays
  misc_feature: Ceres CLONE 1545268
  misc_feature: Encodes the peptide sequence at SEQ ID NO. 68640
  misc_feature (449)..(449): n is a, c, t, g, unknown, or other
tggagctccccgcggtggcggccgctctagaactagtggatcccccgggctgcaggaattcgtctcacccctagaaaaaacccacacatccgacgccgaggaagtaggaagcacgagcagcatatgtcacagagggccagcgtcccacactcctcctgcatagccttcgcgctccattcccatctcctggtctccagtgagatgtgccccagctcctattggcagcaatagctattctccgctttccttttttttcccccttcctttcttcccgtctggctttggtttccgtttgatcgagctggctctcagtttccgtttttagttttgttggcatctttgctctcggatccgtctctccctaactccctgaacccaaaagggagagaagaaactgggtcagcaagctaccaagcgagcgatgggtgtcaagggattcgtcgaaggcngcatcgcctccatcgtggacggctgctccacccacccgctggacctcatcaaggtcccccatgtaacttcaagggggaaggccgcgggcccccctgggtcccccacccggggctttggcccgggactttcccttccccgcccgggggccaagcccctttggcttccggaacaaaaacaaccacaaaaatccccggccccacccgggaaaat

SEQ ID NO: 68640 - protein, 79 aa, Zea mays
  misc_feature: Ceres CLONE 1545268
  misc_feature (10)..(10): Xaa is any aa, unknown, or other
MGVKGFVEGXIASIVDGCSTHPLDLIKVPHVTSRGKAAGPPGSPTRGFGPGLSLPRPGAKPLWLPEQKQPQKSPAPPGK

SEQ ID NO: 68641 - DNA, 618 bp, Zea mays
  misc_feature: Ceres CLONE 1545269
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaatcctgcaatatctgaatatacatttggcagatgattccctatgttgtaaatgacactagttcatagcactgacgcagttcaaagcggttcttgttatctggtggtactcaaattagtactgcaaacaatcgatgagctgattttattttgagttttgtattacgaacctttttgactggtgaaacggttattccatttgcttcaagcaatttggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttacccaataggccgaaatcggcaaaat

SEQ ID NO: 68642 - DNA, 657 bp, Zea mays
  misc_feature: Ceres CLONE 1545274
  misc_feature: Encodes the peptide sequence at SEQ ID NO. 68643
agctccccgcggtggcggccgctctagaactagtggatcccccgggctgcaggaattcgtctcacccctagaaaaaatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcctgggcaagaagccagaggacttccgcaagtaccaggcctacgagctgattcatgccaagatgggccatgctcgggtgccgctggcgctgtcatcccagaggcctggcaacaagttccgggcttaactggggccctgaggcttgctgggttcaagaccggcgtcgctgcctcctggaaggggaaacacccttcaactaacttcgggaacaagcatcccccat

SEQ ID NO: 68643 - protein, 143 aa, Zea mays
  misc_feature: Ceres CLONE 1545274
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFRKYQAYELIHAKMGHARVPLALSSQRPGNKFRA

SEQ ID NO: 68644 - DNA, 646 bp, Zea mays
  misc_feature: Ceres CLONE 1545278
  misc_feature: Encodes the peptide sequence at SEQ ID NO. 68645
  misc_feature (646)..(646): n is a, c, t, g, unknown, or other
ggagctccccgcggtggcggccgctctagaactagtggatcccccgggctgcaggaattcgtctcacccctagaaaaaaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatgggtggtggcggctatggtggttggtgggtgggtggctaattggtggcgttgggctatggtggcggctaaatggtggttggtagcggtggctatggcgggcggcggcagtgggtgactatggn

SEQ ID NO: 68645 - protein, 147 aa, Zea mays
  misc_feature: Ceres CLONE 1545278
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGWWRLWWLVGGWLIGGVGLWWRLNGGW

SEQ ID NO: 68646 - DNA, 573 bp, Zea mays
  misc_feature: Ceres CLONE 1545280
  misc_feature: Encodes the peptide sequence at SEQ ID NO. 68647
  misc_feature (435)..(435): n is a, c, t, g, unknown, or other
tgtggatcccccgggctgcaggaattcgtctcacccctagaaaaaactatactttcccactgccgcagttcgccactctcgccatcggggacgagggactgggagccaggatacttctgccgcgcggcgaccggtcgagcgaaatcgatctaccccaggtgcggcgggcgcggctttattctcaagattttttctgtgttctttagagagcagccatggacgagtggattcgccaaaccgaggtgtgggtgcaccaaaccgacagctggatccggcagcagcccccggagcagatctatgtagcggccgcggtggttgccgtcacaatcctgttgcttatcgtagcatcttgtctgaaatcgtctagaccaacaccatagttctatcttggcttagtgccagtggcaaacccactatttactacccgctttcggnatggatcctcccatccagggaactgtttacttcaatggaagaaaaccggggaaactttttgggctgcatttcggaggccggaaagggaaaaacaaagttaaaacgtgggcgaattttttggaagtttccgggccccgg

SEQ ID NO: 68647 - protein, 54 aa, Zea mays
  misc_feature: Ceres CLONE 1545280
MDEWIRQTEVWVHQTDSWIRQQPPEQIYVAAAVVAVTILLLIVASCLKSSRPTP

SEQ ID NO: 68648 - DNA, 656 bp, Zea mays
  misc_feature: Ceres CLONE 1545285
  misc_feature (387)..(387): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (414)..(414): n is a, c, t, g, unknown, or other
  misc_feature (424)..(424): n is a, c, t, g, unknown, or other
  misc_feature (656)..(656): n is a, c, t, g, unknown, or other
agacctggagctccccgcggtggcggccgctctagaactagtggatcccccgggctgcaggaattcgtctcacccctagaaaaactcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaagcgcccttcgtcgtcaggtccaccccccgccctcgagcaagcaaggtgccattgttttctgttggtccccgtccaagaagtcctctttttttttccccccccccctggggaaaaganaaggggttnnannntttnnncctttcncaccctaagntaccaagaacttcctccatcccaaggggcgggcggaggccaactaaatcaccgcccccgcccccctgcctgcccgcggggggggcccctccccccggaaaattctcgggcaaaacgcctcccctccccccgcaatcccacccccccctgggcttcaacgccgccggccaccccggcccccgagcgccgctacccccacactgccccaaagtccctccccgcccccccctccn

SEQ ID NO: 68649 - DNA, 728 bp, Zea mays
  misc_feature: Ceres CLONE 1545286
  misc_feature: Translation starting site: 566
  misc_feature: SWISSPROT Homolog: EC 3.2.1.23 Beta-galactosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (39)..(39): n is a, c, t, g, unknown, or other
  misc_feature (41)..(41): n is a, c, t, g, unknown, or other
  misc_feature (43)..(43): n is a, c, t, g, unknown, or other
  misc_feature (54)..(54): n is a, c, t, g, unknown, or other
  misc_feature (55)..(55): n is a, c, t, g, unknown, or other
nnnnnnnnnnnnnaaagagggggggaaattaaggtaaanananctccttccctnntttcatactggaactctcctcagtggcggccgctctatactagtggatcccccgggctgcaagaattcgtctcacccctagaaaaatacctttctcggccttttggctaagatcaagtgtagtatctgttcttatcagtttaatatctgatatgtgaactatgtgttcacttcgatattaaatttattttttgtgggggagggtccgtatagtagcttgctacttggtcctcgtgtgtcgctcgggcgttgcacttctgcccgagccaggcgcatcccaacaaaaaattgaaaaaaaaaaaaaaaaacgagacgctcgaggtacccaattcgccctatagtgagtcgtattacgcgcgctcactggccgtcgttttacaacgtcgtgactgggaaaaacctggcgttacccaacccaagcgccttgcaacacatccccctttccccagctggcgtaatagcgaagaggcccgcacccgatcgccctttcccaacagttgcgccaccctgaatgggcgaatgggaaattgtaaaccgtttaatattttggttaaaatttccgcggttaaaattttttgttaaaaccaaggtccatttttttttaaccaaactagggcccaaaaatctggccaaaatatgcccctttattaaattcaaaaagagaattatacccg

SEQ ID NO: 68650 - DNA, 627 bp, Zea mays
  misc_feature: Ceres CLONE 1545289
  misc_feature: Encodes the peptide sequence at SEQ ID NO. 68651
  misc_feature (295)..(295): n is a, c, t, g, unknown, or other
  misc_feature (312)..(312): n is a, c, t, g, unknown, or other
  misc_feature (391)..(391): n is a, c, t, g, unknown, or other
  misc_feature (399)..(399): n is a, c, t, g, unknown, or other
  misc_feature (400)..(400): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (418)..(418): n is a, c, t, g, unknown, or other
aatctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgcccgccgccgcaatggcagccccctccgcgacgtcgccgccgccgctgctggnggacggatcaccatggncaacgacctgtggtacggcccggacgcgtcaagtacctgggccccttttccccccccgcccgggggccgaagggggganttccccgnnactacnnntnnaacaccnccggatggcccccgacccggaaggggtggggcggaaaaggcccctgaagtgatccccgggcgggggccaatgctgggtgccctgggctgcttcccccccgaaggggcctggaaaaggggtgcccccgcgaccccagagggcccccggggggtccagggcccgggcccgcaaatttttctcggaaggcgcgggtcgggaatcaccggggg

SEQ ID NO: 68651 - protein, 154 aa, Zea mays
  misc_feature: Ceres CLONE 1545289
  misc_feature (50)..(50): Xaa is any aa, unknown, or other
  misc_feature (76)..(76): Xaa is any aa, unknown, or other
  misc_feature (79)..(79): Xaa is any aa, unknown, or other
  misc_feature (82)..(82): Xaa is any aa, unknown, or other
  misc_feature (83)..(83): Xaa is any aa, unknown, or other
MASTIMAATSRIVAAKTPFLGQGRAAARRRNGSPLRDVAAAAAGGRITMXNDLWYGPDASSTWAPFPPPPGGRRGXFPXTTXXTPPDGPRPGRGGAEKAPEVIPGRGPMLGALGCFPPEGAWKRGAPATPEGPRGVQGPGPQIFLGRRGSGITG

SEQ ID NO: 68652 - DNA, 642 bp, Zea mays
  misc_feature: Ceres CLONE 1545297
  misc_feature (642)..(642): n is a, c, t, g, unknown, or other
tccccgcggtggcggccgctctagaactagtggatcccccgggctgcaggaattcgtctcacccctagaaaaaaaaaaaaactcaccgtttcccctcgcggccactctccttcgagccgtccgccgctcccacccccaccagtgccaccactcgccagctcgccacttcctcccgtctcctcccttgcagaggcggcgcgtaaaccccgatggccgcctctctcctccacgccgccgccgccgccgcctcgctcctgagctccacccacacgccccgcggcgggtgccgccgcctttccccccctcgcgtgtgccccatccctacgccttacgcgctcctcgttctcgaccaatcgccacctcgagatttcactccgggcgatctcggccagtcgccgtttcgcggggaggggggcaccccgggaccgccgcgttgtcgccgccctagcgggggagcaaaccgagggttcagaggtgggggatgacagaaacggggagataaagcccgaggaagctcaggaaatttggaaggtaatgctggagcagttcaaggctgagggcctgcggatgccagccctgtcaatggcaggctaatgaggtctacctccaaaaggaaaagggaagtcttggcttggaagcatn

SEQ ID NO: 68653 - DNA, 618 bp, Zea mays
  misc_feature: Ceres CLONE 1545304
atagctggagctccccgcggtggcggccgctctagaactagtggatcccccgggctgcaggaattcgtctcacccctagaaaaattggtgttttgcaactttctcaggatatgtactgtactcggtgaggattttgttaattattatggctgttagcgtggcctgacaatgcttgtgtgtaaacctgcactttgtttgagcgtagtgacatctaatatggtgctgtttggcttttgctgagggagtggcaatgcaaatgaaatcaactggtggcgttatttgtcagggtttaaataaacctgacaagaaaaaaaaaccaagaggagaaataaggacggatgggtgcgtgcgtttgtgtagagcagagaaatgggcgcgggggaattttgctcgtcctctcctcttcttcggtagaggaggaaccgaggcagggagggtttatttcatctgtggattttttttttgtattattattagtaaattatagtagtaccaagaaaaaaaaaaaaaaaaccgagacgctcgaggtacccaattcgccctatagtgagtcgtattacccgcgctcactggccgtcgttttaacaccgccgtgactgggaaaaaccctggcgttac

SEQ ID NO: 68654 - DNA, 712 bp, Zea mays
  misc_feature: Ceres CLONE 1545305
  misc_feature: Encodes the peptide sequence at SEQ ID NO. 68655
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
ntttttnnnttgtnggtgggaaggccccacggggccagcgtgacacaaccccttcacacaaaactggagctccacgcggtggcggccgctctacaatagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcttggtgcgcgagaccagggtcgaagaggacatcaacacctgcaccggcgaggtccacaaccgcaagaagaacttcctcgccagggctaactgagccgcacgggggccggcatcccaccccgttcgagcttgcctgaattgccttaaagtaaagcccgggggttaactgggttggggagaggtaatccgaacttggccctttcgtaaacggcaacgaaccttcggccttccacggtacctaaatttacgaacacatacagcgttcgcgggacccctggaagtgaaaaacctcttccttccg

SEQ ID NO: 68655 - protein, 93 aa, Zea mays
  misc_feature: Ceres CLONE 1545305
MAYYQEVDYCSEEVRSVAPAGFGRHGGGVQQHVVKEKFEEVDTVSRAGANHHHHHGHHGGHGFLVRETRVEEDINTCTGEVHNRKKNFLARAN

SEQ ID NO: 68656 - DNA, 770 bp, Zea mays
  misc_feature: Ceres CLONE 1545306
  misc_feature: Encodes the peptide sequence at SEQ ID NO. 68657
ttttttcccctcccccccccaaagacaaaccacccagcacgcgatttcgtcttttattaaggggtgaatactggaactccccgcggtggcggccgctctttaactagtggatcccccgggctgcaggaattcgtctcacccctagaaaaataacataggatccatgtccacaggcgcccgtgtactcgccgttaagaacgatcttgccaagctacagctcaccgcgcctgtctgcacgagccgaggagagaaggttgctctgagccgtcgtgttgagaagcattggcgtctcatcggatggggccagatccaggccggtacaacacttgaagtaccaccctgcccgctctaaagcgtcatactcagacgtgagcttaaatttgtgagtgccaaagaaaaagaatgaagtttgttgttagtattgtcctttgagttaactgcataatccaaagcccttaaggcccattcctagtttaaatttttgttttccttccaatttttggaaggccacctttcccatttatgatattcccgtggaacactttagccggggtcaaaaaacccacgtacccggggaaacgtttttgaagaacccaaccttggggggaatcaagaattttgccccaaaggtgtttttggccttttcccaccccataaaaaaaaaaaaaaaaaaaaaaaccaagaagaccccttcccaaagggaaccccacaatttcttccccccattataaaggggaaagatcccctcaattttacccccgcgccgccac

SEQ ID NO: 68657 - protein, 62 aa, Zea mays
  misc_feature: Ceres CLONE 1545306
  misc_feature (1)..(49): Pfam Name: eIF2_C Pfam Description: Initiation factor eIF2 gamma, C terminal
MSTGARVLAVKNDLAKLQLTAPVCTSRGEKVALSRRVEKHWRLIGWGQIQAGTTLEVPPCPL

SEQ ID NO: 68658 - DNA, 670 bp, Zea mays
  misc_feature: Ceres CLONE 1545311
  misc_feature: Encodes the peptide sequence at SEQ ID NO. 68659
agtggatcccccgggctgcaggaattcgtctcacccctagaaaaacttctccaccgctcttgctcgtccaaccttctccatcgtctcaccttaggtttcgctccccgccgccgccgccatgatgccgcagcagcagcagcccggcatggcccctcctcctccacaggccgcccccggagcgccgccacactggggcggcatcccgccgcctatggcccctcagcatcagtacgcgccaccaccgacccatcatgccccgcccccgccgcagatgtggggccaggcgcccccgcccccgcccccgcctcaagccgcgtacggtcaggcgcccccgccgccccaaggcgcgtatgcccaagcgctcccaccaccccaagccgcgtacggccaagcgcctccccccgccaaaagggcgcctaataaaggggcggaaccccccccccgcgggggggggccgcggcacctggtggggccccacaagggtcaggaacacctccggaaccggggaaatcccactaacggggagggaaaaaaaactcacctcttcgggggggcctccccccccccggggggagggggaaaaaatgtggaaattaatattcgggaaaaaaaaatttgggggaaaaattttttggggggagaggggtttttatagaaaataaaaaacccc

SEQ ID NO: 68659 - protein, 178 aa, Zea mays
  misc_feature: Ceres CLONE 1545311
MMPQQQQPGMAPPPPQAAPGAPPHWGGIPPPMAPQHQYAPPPTHHAPPPPQMWGQAPPPPPPPQAAYGQAPPPPQGAYAQALPPPQAAYGQAPPPAKRAPNKGAEPPPRGGGPRHLVGPHKGQEHLRNRGNPTNGEGKKTHLFGGASPPPGGGGKNVEINIREKKIWGKNFLGGEGFL

SEQ ID NO: 68660 - DNA, 537 bp, Zea mays
  misc_feature: Ceres CLONE 1545313
  misc_feature: Encodes the peptide sequence at SEQ ID NO. 68661
  misc_feature (372)..(372): n is a, c, t, g, unknown, or other
  misc_feature (399)..(399): n is a, c, t, g, unknown, or other
  misc_feature (414)..(414): n is a, c, t, g, unknown, or other
  misc_feature (415)..(415): n is a, c, t, g, unknown, or other
  misc_feature (438)..(438): n is a, c, t, g, unknown, or other
ggagctccccgcggtggcggccgctctagaactagtggatcccccgggctgcaggaattcgtctcacccctagaaaaaatccattcccacagcaccaagcaagagcaaagagcaacacaaggcaaggcagcacacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgaacgctgagcctcatgccccgggcgcggacgtccgcgcgagcaggagccngcccgcgcgaggggcaggaaacggccnggtcccgctcacggnnggcgccgctcaccatcttctacngggcaggggtggtcgtgttccaacaatttccccggcggaaaaaggcaccccaaagtcttgggcccttcccaacttggggcccaaaaggccccggggggc

SEQ ID NO: 68661 - protein, 115 aa, Zea mays
  misc_feature: Ceres CLONE 1545313
  misc_feature (61)..(61): Xaa is any aa, unknown, or other
  misc_feature (70)..(70): Xaa is any aa, unknown, or other
  misc_feature (75)..(75): Xaa is any aa, unknown, or other
  misc_feature (83)..(83): Xaa is any aa, unknown, or other
MAMAAAAEGKSRRFALACGVLSQYVKAEQQMAAAGAPAPRAPATNAEPHAPGADVRASRSXPARGAGNGXVPLTXGAAHHLLXGRGGRVPTISPAEKGTPKSWALPNLGPKRPRG

SEQ ID NO: 68662 - DNA, 769 bp, Zea mays
  misc_feature: Ceres CLONE 1545314
  misc_feature: Encodes the peptide sequence at SEQ ID NO. 68663
acccctgcctccccccccactaagagaatagtaaccagaaggagggggagcgtgccgccatagaaaatgataatccccccaagactggaactccccgcggtggcggccgctctagaatagaggatcccccgggctgcaggaattcgtctcacccctagaaaagcctccggcacggcaccacacacacagtctcaagtctcaactatagtctccagtcccccgcctccacgcctccggctccggccagccgcagtaattgcagcgcagcccaagccaccaccaccaggcacccagccaaaggtgcggccctttgaaccccgcgcccggcgcccatggccggcggacgcccaccgctttcccccatcctccttcttaacttccccgccaccgcctcccgaaacctcggcggcccgggaaatccaagggcccccccctccccccgaaaggcccctcccaaggtttgggaccacggcttccccaaggcccgcgggcttcccctccaaaggggccggacaagtgccccccctcccaaaattttccccggggaaaccttatcaccccccggcccccataaaccccgagaaaccccccccccctgttttatcccccgccctggccccccccgggcgctctcccccaagaggacacgggccccccccctgtcccacaaaggagcaccccaaaaaacaaaaaccccccccggggtgtattccccccccttttgtttttttaataaaagaaaacccccctggtgcggcggataaaaaaa

SEQ ID NO: 68663 - protein, 143 aa, Zea mays
  misc_feature: Ceres CLONE 1545314
MAGGRPPLSPILLLNFPATASRNLGGPGNPRAPPSPRKAPPKVWDHGFPKARGLPLQRGRTSAPPPKIFPGETLSPPGPHKPRETPPPCFIPRPGPPRALSPKRTRAPPLSHKGAPQKTKTPPGVYSPPFCFFNKRKPPWCGG

SEQ ID NO: 68664 - DNA, 754 bp, Zea mays
  misc_feature: Ceres CLONE 1545315
  misc_feature (12)..(12): n is a, c, t, g, unknown, or other
  misc_feature (18)..(18): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
aaaaaaaagggngggaangaaaaaacaaaaaacaaccccnnnnnnnnnnnnttcaaactggagctccccgcggtggcggccgctctagactagtggatcccccgggctgcaggaattcgtctcacccctagaaaaacagttgaccacaccatttgggacagcctccactcctacattggcatcaacaccagctcctggatttgggactagcactacatctttgggtggaacatctctattttctacaccatttggaggtggagctacagcttcaggttccagctttggtggtgcatcgaaaggaaggtcgaagccccggggacgacggtagatgtaaatgtggatgctattgattctcttgactgttacttacgtccattttatgcagaaattataactaatccccccccccccccaacccatacccccaaaaaaaaaaaaaaaaacgaaacgcctcttaagtacccaaactcccccctatatatgaaatctaattactggagaatcaaagaggccaccccttttacacaacacccttgtaagggaaaaaaaccccgggcgtaacaccaaatctaattccaatttagcatggaatacccccccctattccccacactgggggtcaacaaagcaaaaaagggacatctccagatatgcccactttcccaaaactctcccattccttagaatggggacaaggaaaattcgaaacggtccaatatttcttctataaaatacagagtaaaaattgtcg

SEQ ID NO: 68665 - DNA, 523 bp, Zea mays
  misc_feature: Ceres CLONE 1545322
  misc_feature: Encodes the peptide sequence at SEQ ID NO. 68666
  misc_feature (66)..(66): n is a, c, t, g, unknown, or other
  misc_feature (67)..(67): n is a, c, t, g, unknown, or other
  misc_feature (237)..(237): n is a, c, t, g, unknown, or other
  misc_feature (238)..(238): n is a, c, t, g, unknown, or other
  misc_feature (253)..(253): n is a, c, t, g, unknown, or other
ggactcccgcggtggcggccgctctagaactagtggatcccccgggctgcaggaattcgtctcacnnccctagaaaaaaagcgaaaggctcaagcaaatacaagctctcagttagacacactcaaaccagcacggacagcctcaaatcccgagcaggagctcgctcgtagccccgagaacccgaaagctctgcagcgagatgtctcccgagctgaccggcaagatggccgccaaggnncgcgccgccgctgcngcggtgaaacccgcggacaagggcgtacgtgacgtttcctgggggggggaacgggggaaattattgggaaaagggggcctggggtgggggcccctttttcccaaaaagaggggcctcttttttcaaaaaaagggggggggggggggattatccccgggggggggggggggggtttttttttttcccccaaaaaaagggggggggggagaaaaaaccccccccccgcggtgttatttttttttttttttttgcggggggggggttttctcc

SEQ ID NO: 68666 - protein, 108 aa, Zea mays
  misc_feature: Ceres CLONE 1545322
  misc_feature (13)..(13): Xaa is any aa, unknown, or other
MSPELTGKMAAKXRAAAAAVKPADKGVRDVSWGGERGKLLGKGGLGWGPLFPKKRGLFFQKKGGGGGLSPGGGGGVFFFPPKKGGGGEKTPPPRCYFFFFFCGGGVFS

SEQ ID NO: 68667 - DNA, 623 bp, Zea mays
  misc_feature: Ceres CLONE 1545330
  misc_feature: Encodes the peptide sequence at SEQ ID NO. 68668
atagctggagctccccgcggtggcggccgctctagaactagtggatcccccgggctgcaggaattcgtctcacccctagaaaaagctccatcccccctctccacactgccaactcgctccgaagagggaggaggacgacgccggttgccactgccactgccgcgccgctcccgtctcccctccctccgcgggaactcggcgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggatacggacactgagaaggagcatgaggatgcggcggccgccagcgatgagctgcccgtcatgccctgagccacctgcgtcgcaagcgtttacccccttttgacggatccacacccaacaaaggtcctcgcttgcccctagcaggaaggggagggaccctaattgctgggaatggttcccccggaaaaactttttcgggaactcccaatgaaaaat

SEQ ID NO: 68668 - protein, 89 aa, Zea mays
  misc_feature: Ceres CLONE 1545330
  misc_feature: SWISSPROT Homolog: EC 1.1.1.40 Malate dehydrogenase (oxaloacetate-decarboxylating) (NADP(+))
MLSTRTAAVAASASPASPWKLGGRSEGGASCDGCRTYRNTLRRRAAPAKVRALPPRRVDAVAMVSNADTDTEKEHEDAAAASDELPVMP

SEQ ID NO: 68669 - DNA, 759 bp, Zea mays
  misc_feature: Ceres CLONE 1545333
  misc_feature (13)..(13): n is a, c, t, g, unknown, or other
  misc_feature (16)..(16): n is a, c, t, g, unknown, or other
taattttattaanaanaaaaatcacacttttgtgtatttacatcctccaaaaacaaaacgggagctccacgcggtggcggccgctctagaactagtggcatcccccgggctgcaggaattcgtctcacccctagaaaaaatcctccaccacaccacacgcgccgcatagcatagcacgggggcctgagagcagagcgccatcagccatcctttgcctgcccacgcagcaagcaacaaccaccaacggcggctggcccgatggctctgtatctctccggcacctccgcccgcttcgccctcgcgtcgctggtcccccgggccagggcctacgcggtgtaggaggcgtccggggccatgaagcgcgcggcggagggcgcggccgcggggcgaggccaaagaggccgggcgcgcggccgccgccactgcccagggctcgtgggtgcccgaccccgccacgggccccttgccgcccccccccaccgggccgccgtccgtcgaacccgccgaaatccgcactgatcccttgacccgcaccctattcccggggtctgaaggggacccaggttccccttttacccggtcaccggcctcaaacaaggaaagaaccaggccccgaaacctcatgcttacaacactcttgggcacccaagcttcaccggctcccgggggcgattctcaagggcacaccaaacccggcccgggtttttaagtcactcatttcgacgccctgaggcgcacaatcacacccgtatatgataa

SEQ ID NO: 68670 - DNA, 1012 bp, Zea mays
  misc_feature: Ceres CLONE 1545335-R2
  misc_feature (1012)..(1012): n is a, c, t, g, unknown, or other
tggggtactcgagcgtctcgtttttttttttttttttcgcgatcttttcagctttattgactttgtcacactatatatacggtatagggcctttccacacaggcgttagcggcaccgttgctacaactacaaaacgacacaaccgtatgactgtctgtacgagtaccgtgccgtgcgcgcgtggcaggaaggcctccaacgaatcaacaaattcccattccctagctaacctagatccggtgcacacaacctgttgtgtgtgcctgcctgtgtgtatactggacgtatctgaattctgaatgcgaaaggggagcgtggaccctacgtatacccccccccggattcttacagcaaggcttcagaacccgccgcccgcacccaaaattggtggaacagggtttccgattccccctcccccagcttttagcctctccccccctgccagaggaaaccgaggtcgaaccaaacaggggcgtccccccgggcttcgcccttttggccccgatttaacccgcccccccgtaaaccctttccttccttcgggcggggttttagaaatttttcccaaggggggggtaggggggcttcccttgtattgaacgaatggagatcccccttcctgggggccccccccgcccccgggggggccccactatttaaatagggcgcccccccgcccgggggaagagcccccaaacaaattgggggggggccgggggggtggcctccccccccctcgggggtttggggggggggtgtccctcccggggtcccccaaaggggtggaacacccccccgggggtgtttgggtgcttttttcccccccctcgataggtggggggggaataaacaggggggcggccccgccctcctcttgggggaataaagagggggctccaacaaagtggttttttccgccccggggggggcgcccccccccccgccgggtatgggacttgttgtgaataattcccccccgcgggttgtgggggtcccccccctccccaccccn

SEQ ID NO: 68671 - DNA, 1077 bp, Zea mays
  misc_feature: Ceres CLONE 1545335-R
  misc_feature (862)..(862): n is a, c, t, g, unknown, or other
gaaagagatcggctttttgactttgtcacctattatacggtattgggcctttcccacaggcgttagcggctccgttgctacaactacaaaacgacacaaccgtatgactgtctgtaccagtaccgtgccgtgcgcgcgtggcaggaaggcctccaacgaatcaacaaattcttattcctagcaaacctagatccggtgctcacaacgtgttgtgtgcgcgtgcgtgtgtgtatactgaacgtgtcgtaattttgaatgtgaaatgaaagttgcagccttcttatacccccgtcgtgtcgtacaggaagggaccaaacactgtagcggcgctgagattgagaggacctagtccggagcgctctgcgcacgttcacatctccatcctttttctgaggaccctagccctagaagaaggacgtttccggcatatcatcccttgtgtcgcgttatccgaggtcgattagcgtgcttgcctctcgtaggcagtgatgatgatgccacaggaatgaaagcgcgacggcgctttctacgcgaatcattgagccctcctcgagggagtccagatatataatatacaactcataaccacgagaactcacgctccgccggatgcctttttattctgcatcgggtttagatcgcatagtaagtgttactgtatatgttaatgtgtgtttcgatagattatcccccgccaatgggttgcgcatctctatctgaactccactctgtattgaatagctagggagaacggcgattataatcccttccccccaactcacttttgtctgcgtagtccgaaccagcctgagaacacgcacttatgcatgtaggagtagaatgcaggctagtctattataanattgttggatagttgttatgaatagattaagagtgagtatatcaggaaccctagatgtccgtattatatatttcatctacgtggtgattactcgtccagatactgtatttacacaggtccttcctacacacgcatattatatgtcccagaccgtcctgatgtgttcagctaccgtgcttggctctggtcattatctctccgctcttctttctttt

SEQ ID NO: 68672 - DNA, 658 bp, Zea mays
  misc_feature: Ceres CLONE 1545337
  misc_feature: Encodes the peptide sequence at SEQ ID NO. 68673
aagctggagctccccgcggtggcggccgctctagaactagtggatcccccgggctgcaggaattcgtctcacccctagaaaaaagactgcctcctccactccagtgtggccgttcgttcccctctgttccgcgccggcgcgccgcccaactctgagcgatggaaggcaccgtgctgtgcgcggccaaccacgcgccgctcacgcccatcagcttcctcgagcgcaccgcgctcgtctaccccgaccgccccgccgtcgtcgccgccggacacgccgccgcgccgccgccgcgcacctggcggcagacccgggaccgctgcctccgcctcgccgcggcgctcgcggggctcggcgtcgcgcgccgtgacgtgtttgcggtgttcgcgcagaacataccggccttctgcgagctccacttcggcattcccatggcgggcgccatgatctgcacgctcaactcgcggctcgacgccggcatggcgtccgtgctgctgcaccactcagaggccaaggtcgtgttcgtggacgccgcgctactgggcgtcgcccgggatgcgctccgcctcatctcccatcaagacggcggagcgagcatggtgccccccctggtactaatccacgatgctctcgacgagccgccgtcagcgacctacagaaa

SEQ ID NO: 68673 - protein, 166 aa, Zea mays
  misc_feature: Ceres CLONE 1545337
MEGTVLCAANHAPLTPISFLERTALVYPDRPAVVAAGHAAAPPPRTWRQTRDRCLRLAAALAGLGVARRDVFAVFAQNIPAFCELHFGIPMAGAMICTLNSRLDAGMASVLLHHSEAKVVFVDAALLGVARDALRLISHQDGGASMVPPLVLIHDALDEPPSATYR

SEQ ID NO: 68674 - DNA, 638 bp, Zea mays
  misc_feature: Ceres CLONE 1545338
  misc_feature: Encodes the peptide sequence at SEQ ID NO. 68675
tccccgcggtggcggccgctctagatctagtggatcccccgggctgcaggaattcgtctcacccctagaaaaagacaaccacaggaaaaaggagacgaccgcgccggcgccgcccattaatttctccccttctatccgcgatcacctctcctcgctgccgcggcatcttcttctgggtcctggcccgtcctcgtcgcaccattccatggccgattcagccgcgctctccacctccctcccccgctctctggcgtccaggaggcccctctcgtcgcctctccacgccagaacccgggcccgctcccagcgccgctgccggctcggatcgcgctcgctccaccggttgcgtgctcgggcccccacacgacgaccgggggagggagcgtctaccggcccctaccccctggggacccagccctttgaatctcaaccgcttggggttccaaaaatttccattgggggggccctgaaaaaaaaaacaaaaactcccccccctattttccccttttccggaaagaggggggcgtgaaacccccaaaaaatggggggggggcggtccccctcgtgggggctaccccccccccccccaaaaaaaacgtggctcccaccatttatcttcccatacaaaaaaaaaaaaa

SEQ ID NO: 68675 - protein, 107 aa, Zea mays
  misc_feature: Ceres CLONE 1545338
MADSAALSTSLPRSLASRRPLSSPLHARTRARSQRRCRLGSRSLHRLRARAPTRRPGEGASTGPYPLGTQPFESQPLGVPKISIGGALKKKTKTPPPIFPFSGKRGA

SEQ ID NO: 68676 - DNA, 611 bp, Zea mays
  misc_feature: Ceres CLONE 1545343
  misc_feature: Encodes the peptide sequence at SEQ ID NO. 68677
  misc_feature (229)..(229): n is a, c, t, g, unknown, or other
aaagctggagctccccgcggtggcggccgctctagaactagtggatcccccgggctgcaggaattcgtctcacccctagaaaaactctcacttctgtacccaatcagaagagcggcggcgcgggcggacaaggagcaggcggaggaagagttgtgccaagccacaatgggtatctcgcgtgactcgatgcacaagcgccgaagcaccggtggaaagcaaaaaggctggnagaagaagcgaaagtatgaccttgggtcgcagccagccacacccaagtgtccaggcataaaacagtgaagagggtccctgttcgggaagtatgtggaaatggaaggtcttcgccttgttactggaactaacttggggaaatgaaaagtttaccccaaaacccttccccccaaagggcttaaaggggcaaaaaaggggttttgaggaccccaaaccctttaaaaaggcccttttggaattgtttctggcccctttttagcgggggggcccccccccctttggggttaaattgggggaaaaaaaaaaaacccccggctaaaaaaaggtatagtggtaggggaaaaaaggtttggaggccccctttgaaaaaaccaaaaaaaccc

SEQ ID NO: 68677 - protein, 43 aa, Zea mays
  misc_feature: Ceres CLONE 1545343
  misc_feature (22)..(22): Xaa is any aa, unknown, or other
MGISRDSMHKRRSTGGKQKGWXKKRKYDLGSQPATPKCPGIKQ

SEQ ID NO: 68678 - DNA, 655 bp, Zea mays
  misc_feature: Ceres CLONE 1545348
  misc_feature: Encodes the peptide sequence at SEQ ID NO. 68679
tggagctccccgcggtggcggccgctctagaactagtggatcccccgggctgcaggaattcgtctcacccctagaaaaaaagaaactccgtttcgaattctagggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgacccaaccattggtgtggaagttcatccgttggatttcaccactaactgtggtaagatcaggttctactgctgggatgccgcagggcaagaaaagtttggtggcctcagggatggatactatatccatggccagtgtgcgatcatcatgtttgatgtaacttcaaggcttacttacaagaatgttcctacgtggcatagggacctgggcagggtctgtgaaaacctccccattgtcctcggcggaataaaggttgattgtaaaaaacaggcaggtcccaagcccagccaggttactttccccagggaaaagaaatcgccgggacctatgaaatttctggccaaaagcaatta

SEQ ID NO: 68679 - protein, 159 aa, Zea mays
  misc_feature: Ceres CLONE 1545348
  misc_feature (15)..(159): Pfam Name: Ras Pfam Description: Ras family
MALPNQGTVDYPSFKLVIVGDGGTGKTTFVKRHLTGEFEKKYDPTIGVEVHPLDFTTNCGKIRFYCWDAAGQEKFGGLRDGYYIHGQCAIIMFDVTSRLTYKNVPTWHRDLGRVCENLPIVLGGIKVDCKKQAGPKPSQVTFPREKKSPGPMKFLAKSN

SEQ ID NO: 68680 - DNA, 692 bp, Zea mays
  misc_feature: Ceres CLONE 1545351
  misc_feature: Translation starting site: 284
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
naaaannnccccnnnggcgggggaacgaaaataaaaactcatctcctcccnnnnnnnnccaaaactggagctccccgcggtggcggccgctctagaactagtggatcccccgggctgcaagaattcgtctcacccctagaaaaactggagaccaacaagattgtggacttcatcaagtttgatgttggctacgtcgtcctggtgactggtgaaaggaacactggccgtgtgggtgttctcgggatctgggagaagcacatgagcagctttgagaccattcacgatggaggactccctgggccaccagtttgccacccgtatgggcaacgtgttcaccatcggcaagggttttaagccgtgggtgagcctgcccaagggcaagggaatcaagctgagcatcatagaagagcaaaggaagcgggatgccgccgcccaggctgctgccaacgcataaatcctctgaatgtgctgtgctgagttttttctagttgctatgcaagagatatataacaatgttccgagactaccatgtgtttaagtcagcctgatgcttataattcatgaacgattttcgcagctaactgtagtgaaactatttatcttatctgcttgttcagaagaaataaacaaaactcagacgctcgaggtacccaattccccctatagggagtagtgttactcccgctcactga

SEQ ID NO: 68681 - DNA, 700 bp, Zea mays
  misc_feature: Ceres CLONE 1545353
  misc_feature: Encodes the peptide sequence at SEQ ID NO. 68682
  misc_feature (6)..(6): n is a, c, t, g, unknown, or other
  misc_feature (22)..(22): n is a, c, t, g, unknown, or other
  misc_feature (47)..(47): n is a, c, t, g, unknown, or other
  misc_feature (48)..(48): n is a, c, t, g, unknown, or other
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
  misc_feature (424)..(424): n is a, c, t, g, unknown, or other
  misc_feature (425)..(425): n is a, c, t, g, unknown, or other
tccccnggttttgtccggtccntcacacacacaagaaacccctcctnnctttatccccccccatactggaactccccgcggtggcggccgctctacaactagtggatcccccgggctgcaagaattcgtctcacccctagaaaaaaaagcgaaaggagagaaggaatccgatccatccaagccaagccaaggcagggaagaagaagaaaggcaagaaaggagatgcagcagaagcagatcccatggaggaggcgacaaacggtgctacaagccaagaataattctgatttttggaattactgccaccagcttttttcttgtttcttcgctgcatctgatggtgttatattacattcagttgtggaaaaattgagtactatttctagcttctaagaaatgaagcatcctattatcgcanannatnncactaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaaaaggcccgcaccgatcgcccttcccaaaagtttgccaccctgaatggcgaatggaaattgtaagcgttaattattttgt

SEQ ID NO: 68682 - protein, 95 aa, Zea mays
  misc_feature: Ceres CLONE 1545353
  misc_feature: SWISSPROT Homolog: EC 3.2.1.23 Beta-galactosidase
  misc_feature (8)..(8): Xaa is any aa, unknown, or other
  misc_feature (9)..(9): Xaa is any aa, unknown, or other
  misc_feature (10)..(10): Xaa is any aa, unknown, or other
MKHPIIAXXXTKKKKKKKKKKKNETLEVPNSPYSESYYARSLAVVLQRRDWENPGVTQLNRLAAHPPFASWRNSEKARTDRPSQKFATLNGEWKL

SEQ ID NO: 68683 - DNA, 767 bp, Zea mays
  misc_feature: Ceres CLONE 1545354
  misc_feature: Encodes the peptide sequence at SEQ ID NO. 68684
  misc_feature (1)..(1): n is a, c, t, g, unknown, or other
  misc_feature (17)..(17): n is a, c, t, g, unknown, or other
ntttttaaaaaaaagcncccttaatgcaaaatcgattttacaacttctacttaaactggagctcaccgcggtggcggccgctctatactagtggatcccccgggctgcaggaattcgtctcacccctagaaaaactcttcctcggacaaagccggggccgttcggcgggaggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcttccacctccacaccgcggaggacgacggcgacgaggaggaggaggacctcgaggaggcccgccgctccttcttcccgcccgatccctgagtactactacgaccggtccggctcctccgcctccgtcgccaagatgtgacctgaccggaaccgcgcctccctccgcccaaaaaaaagcgtggtgataccattccgtctccttgatctaattatgggcccctttgcttgaattccgttggagtcctccagcccctgtaagaatgaacgaccaccaaaagatatataattggtggctggcgttatgccactttgttaccgtaaaaaaaacaataaaagaccccacaacccttgggggggaaccccaattttcccccctataagggggaagtcggtactcaacgcccgcgcggccccatggtggccgggcgctcttttccataaacaagtcctg

SEQ ID NO: 68684 - protein, 69 aa, Zea mays
  misc_feature: Ceres CLONE 1545354
MNGINPNGGFLSYGNMESYAMWVATGVASAFFASLERCSCFHLHTAEDDGDEEEEDLEEARRSFFPPDP

SEQ ID NO: 68685 - DNA, 720 bp, Zea mays
  misc_feature: Ceres CLONE 1545358
  misc_feature: Encodes the peptide sequence at SEQ ID NO. 68686
  misc_feature (11)..(11): n is a, c, t, g, unknown, or other
  misc_feature (32)..(32): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (52)..(52): n is a, c, t, g, unknown, or other
ttttttttttnttgtttgttttttattaagancttcnccnnnttttatcttntaaaactggaactccacgcggtggcggccgctctagaatagtggatcccccgggctgcaggaattcgtctcacccctagaaaatcctctaccccctccttcacccagaccgcccctgtgacaccttcgagggtgtgaagagtgccaccattgccgccgagacaaccgactccgcaaccatgctctcctctgccttcctcgacgaagagccagtggctgaagatcccggtgttcagcaggtagaagttgatgagtatgagctcattgaaggagaagaacaggtggcctaggaggagccgcacaacgaggagttcgacttggtctaggtggcgtctcccagttgactttatggcgccaagcatggccattagttcactttacatttatcttttattttcataagacttccgctatgcaataattacttttatgatattgtgacatttatctctatacattctgttattaaatgtgttgttcctctttggcgtaaaaaaaaaaaaaaaaacaaaaccctcgaggtacccaattcgccctatactaaatccgtattaacacccgcctccactggacctcagttttacaaaacgtcctggactggggaaaacccctggcgtttcccccaacattaatccgccttgacaaaacaatccccccttttagaccaat

SEQ ID NO: 68686 - protein, 50 aa, Zea mays
  misc_feature: Ceres CLONE 1545358
MSMSSLKEKNRWPRRSRTTRSSTWSRWRLPVDFMAPSMAISSLYIYLLFS

SEQ ID NO: 68687 - DNA, 635 bp, Zea mays
  misc_feature: Ceres CLONE 1545360
  misc_feature (48)..(48): n is a, c, t, g, unknown, or other
  misc_feature (53)..(53): n is a, c, t, g, unknown, or other
  misc_feature (74)..(74): n is a, c, t, g, unknown, or other
  misc_feature (75)..(75): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (519)..(519): n is a, c, t, g, unknown, or other
  misc_feature (521)..(521): n is a, c, t, g, unknown, or other
  misc_feature (567)..(567): n is a, c, t, g, unknown, or other
  misc_feature (568)..(568): n is a, c, t, g, unknown, or other
aggagaaaaataaaaaaaaaaaaatattgttttggggctggttagggnggggnatttggggggggggggggggnnggggggnnncccaaactggactccccgcggtggcggccgctctagactagtggatcccccgggctgcaggattcgtctcacccctagaaaaacctggatggttcctgcctgtctgtcgcctcgtgacgtctgtccaagaacactcgctccccacctgttcgctgcttcttctcttgccatctgctccttcatctagctaatcttgaatggacctggggatgacaatggaggtacccaaaatcatcgaagtaatgtaaagtaccccggcagctaaattagtttcaccaggcccagaaaacgaactcccacttttcgtcccaatcaaaaaaaatgcaaaactcttaaaaaaacctgggggaaacccccattctccccagttttgccaaaaaatattaaaaattcccccccccctccccccgcgaaaaaataaattgggggggggtntnaaaaaaaaccccccccccccacagaagaaaaaacaccccccccctnnaaaaaaacccacagggccccaggaaaccccccccttttaaaaaaaaaggcccccccctccccccccc

SEQ ID NO: 68688 - DNA, 641 bp, Zea mays
  misc_feature: Ceres CLONE 1545362
  misc_feature: Encodes the peptide sequence at SEQ ID NO. 68689
ctaagctggagctccccgcggtggcggccgctctagaactagtggatcccccgggctgcaggaattcgtctcacccctagaaaaaaaaccctatgccgccgccagacttgttggttctctcgatcgattcttctatggcgggctggcggcggcggcggcggcgactgggcgagccgcgagcgcgccgcccttcgccaggtcttcgccggccacttcgcgggcgagggcgaccaccgaagagcatccaccaggccgctgaggaataacaaagatgtccgccggcgaagtcctgagggcagagttatcttccatgacgccgccgttcggcctgaggctatggattgagattgaaatctgtatctgggcgctaatcctgttcatcctaggcttcatgtgcttctggtccctacaccggaagaacgcgggcaagccctgcgacaaggttacgctgtcccaaatccccgacgtctccaaggagattgcggtggacgaggagcgggagcaagctgttgtccacagcctccgtgtgctggagagccacacgctggccgtgcaggaaaagaaaccctgcgaaaaggattcggggaaaatgctcgcgctactggttacgagcaagtcaagcgacccagataatctgagcc

SEQ ID NO: 68689 - protein, 123 aa, Zea mays
  misc_feature: Ceres CLONE 1545362
MSAGEVLRAELSSMTPPFGLRLWIEIEICIWALILFILGFMCFWSLHRKNAGKPCDKVTLSQIPDVSKEIAVDEEREQAVVHSLRVLESHTLAVQEKKPCEKDSGKMLALLVTSKSSDPDNLS

SEQ ID NO: 68690 - DNA, 645 bp, Zea mays
  misc_feature: Ceres CLONE 1545372
  misc_feature (333)..(333): n is a, c, t, g, unknown, or other
agctcaccgcggtggcggccgctctagactagtggatcccccgggctgcaggaattcgtctcacccctagaaaaacttggaactgaatttgtcgacaacaaatctccaaatgatccatttccagctgaatggggtgttggttcgatatttggcgcggagtgcgagaagcgtgggatgctcatcagggtggctggggacagcatcatgctgtcacccccgctgatcatgactcccaatgaagtcgaagaaatcataagcaaaattcggcgatgctctgaaggctacagaggaacggattgtagaactgaaatccaggaagaattagccgatgcntgctggttgtaaccgaccatgagggatggtgatgggcagtgtcccaattatacaagtgtatttttccaaactttttttttcagaaaaattgcttggcctggaaatcttggagtccggtttgcttagccaacagttgtcccttggtttggagcaaaaagtgatgggctccgccttaaccccaggttcccccaaaaaaaaaaaaaaaaacgcggaccccccccgggggcccccatttcccccccctataaggggagcccctattatccccccccctccctctgggggccggcttcttttttttccccccccgcc

SEQ ID NO: 68691 - DNA, 647 bp, Zea mays
  misc_feature: Ceres CLONE 1545375
  misc_feature: Encodes the peptide sequence at SEQ ID NO. 68692
ggatcccccgggctgcaggaattcgtctcacccctagaaaaaagcctcctcggctccaggtgacctcccaaacctagacctagttgtccttcctgttcgacctgcatagcggcggcgcgtcctgccttcagagagagatggagagagagcgcttgatctccgtaggcatggcgtgggaggaggaggcggtcgaagaggaggatttcggggaggagatgtcggcttcggactccgatgatgacgtcgtggtggggcagatgccgacggttttggtgccaaagcatatcaataagcggcccctgaacaacatggcgctgtctgttaccctctacaagaaagcgctcagggatttcgtgactgggttccacatgcggaagacaaagagaagaaaggaggcgcataagattttgcaggacaacgtgaggaagaagaaaatacatgaccgccagaaaaaaaaaaaaataaaccgagaccctcgatgtacccccttccaccctataatggagtcttattagcccgcgcatcactggccgaccttttctccaacgtccttgccctgggataaacccctgtgcggttccccaactttaatccccccttcggagcaaaattccccctttttccccccaaggtgggacggtaaatag

SEQ ID NO: 68692 - protein, 125 aa, Zea mays
  misc_feature: Ceres CLONE 1545375
MERERLISVGMAWEEEAVEEEDFGEEMSASDSDDDVVVGQMPTVLVPKHINKRPLNNMALSVTLYKKALRDFVTGFHMRKTKRRKEAHKILQDNVRKKKIHDRQKKKKINRDPRCTPFHPIMESY

SEQ ID NO: 68693 - DNA, 709 bp, Zea mays
  misc_feature: Ceres CLONE 1545377
  misc_feature (297)..(297): n is a, c, t, g, unknown, or other
agctccccgcggtggcggccgctctagaactagtggatcccccgggctgcaggaattcgtctcacccctagaaaaagagtcacaatcatgggagtaacgtgacaagaagataccctactatatcacaattattccagtaatgcgtcgagaagataccgttgtttaagtgcacaaacccaatacagtgacgtgccaagaaagttaccgtattttaaggatgtttaattttcagtattcgtcggggtagtactgtgtcagaaactttatttgtacctaaaaaaggccaaatattgccgntggccttggtgctttatgctatgttatccgccttttggtgaaaaaaaaaaaaaaaaccaagacgcccgaaggtacccatttccccccttatggggagccgtattaccccgccgctcattgggccccccttttaaaacggtcgtggactggaaaaaccccgggcggttaccccaactttaattccccttggcaacaaatccccccttttcgccaggtgggggttaataaacaaaaaaggcccgccaccgaaatcccccttccccaaaaaatttcccccccccttaaatggcgaaatggaaaatttggtaaccccttaaaaaatttttgggtaaaaaattccccgggtaacaattttttggttaacatcacctcttctttttttttataacccaaaaaggcccaaaaagcccgc

SEQ ID NO: 68694 - DNA, 575 bp, Zea mays
  misc_feature: Ceres CLONE 1545380
  misc_feature (485)..(485): n is a, c, t, g, unknown, or other
tggagctccccgcggtggcggccgctctagaactagtggatcccccgggctgcaggaattcgtctcacccctagaaaactagaaaactacggcctgttcctggggcccaaggagctgaaggaggtgggaggaactgaggagctggagaaggagatcaagaagaggatcaggaggagggaggccctagacgccatccaataagacctgattagctatacagtgcttactgctttggctatagaattccactgttttttttgaccttctcctcacattagatcttctagcgtttcgatgtatatacgagtggtagcgtgtgcatgtgtcttctttcctgttaatagagtagaagcgcagatcgaggaataatttcgagttgggcaacaggtagccgcagctagctcttgcacaaaaaaaaaaaaaaacgagacgctcgaggtaccccattcgccctatagtgagtcgtattacgcgcgctcactggncgtcgttttaaacgtcgtgactgggaaaaccctgggcgtacccaacttatcgccttgcagcaatccccctttcgccagctggcgtataag

SEQ ID NO: 68695 - DNA, 673 bp, Zea mays
  misc_feature: Ceres CLONE 1545382
  misc_feature (528)..(528): n is a, c, t, g, unknown, or other
aagctggagctccccgcggtggcggccgctctagaactagtggatcccccgggctgcaggaattcgtctcacccctagaaaaaatctccttcccgagatcaaaatcgctaacaagctgtcttccctgtacatggcggttcccggttgcctttggtgcaatctatgttcacgtaaaaaagaaggcgtctaggcgaatctccaggagttccaggacttcgacgagttcgaggattaggctaacaacctcccccagtcagttgcctgaggtggctttatttacgttggctacatttctgttctgtgtactttgattatattatgtaaatgaactctagactttcggattatcacttaccctttattgttatttgaaaccccatataaaaacgagacgttcaaggtaccaatttccccctatagtgattcctataactcgcccttcctgaccgtctattgaaaactccaagactggaaaaaccctgaaattccccatcttaatcgggttgaaaaactcccccttttcccccnttgggcctaataacaaaaaagccccccaccaatcgcccttcccaaacattttcccccccctaaagtgcccaaccggaaattgaaaaccggttaaatttttgataaaaattcggcgttaaaatgtgtggagagggcgggggcgggg

SEQ ID NO: 68696 - DNA, 818 bp, Zea mays
  misc_feature: Ceres CLONE 1545384
  misc_feature: Pfam Name: Aha1_N Pfam Description: Activator of Hsp90 ATPase, N-terminal
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (87)..(87): n is a, c, t, g, unknown, or other
  misc_feature (420)..(420): n is a, c, t, g, unknown, or other
  misc_feature (433)..(433): n is a, c, t, g, unknown, or other
  misc_feature (818)..(818): n is a, c, t, g, unknown, or other
ataatatattttttttnnncccnnccccnncnnnnnnnttggcaaaaatnnnttaataatggaactcacgncnnggctgccgctctngactagtggatcccccgggctgcaggaattcgtctcacccctaaaaaaaaagcttgagatttaaaggtgaatggttagttaaagaagaaaacaagaagatcaaaggacacttagacattcccgagttctccttcggtgagagcgatgacctgcaggtgcaagtaaggttcagtgacgacaagggcctcccatcccacgacaaggaacggatcttcaaggatctcaagtccttttatggcccccattcacgaaaatatttccccgctagggggaagagcctcatggttacatacctttttttttttcaaaaattcccatttttcaaggggggcncttttttcccctnacaacccccagggggggggggggggggcacttctccctctttttttcccctttccccccccctccacattaaaaacaaaaaaaaaaaaaattcctcctcctccctttctccgctgtctttaaaatcacctatctcctttcctctcaattaaccactaaaaatctcctctttcctttccttccccccccaataatttttctcattccctcataaccaaacccatccactatctccacacatcccccccactccaaccccatttaataatacactcatcccaccatttactcccccccacaaccccactaatatcaaccccatattctctccacaccctcccttctaaatatttcccactcttatcccctcttcctttattcttttn

SEQ ID NO: 68697 - DNA, 603 bp, Zea mays
  misc_feature: Ceres CLONE 1545396
  misc_feature (190)..(190): n is a, c, t, g, unknown, or other
ggatcccccgggctgcaagaattcgtctcacccctagaaaaagtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacgctctncgagacggcgacgaagccgtcagccgcgaaaaacaaaaaaaattaaaccgggacgctcgaggtacccaattcgccctatagtgagtcttattacgcgcgctcactggccgtcgttttacaacgtcgtgactgggaaaaccctggcgttatcccaacttaatcgccttgtggaaaacccccttttcgccagctggggtattaccaaagaggcccgccccgatcgcccttcccaaaagttgccccaccctgaaatggcaaatggaaatttgtaacccgttaatatttttgtaaaaatttcgccgtaaaatttttggttaaaaccaaccccctttttttttaacccattaggcccgaaaaccggggaaaatccccccttaaaaaccccaaaaaaaaaaaaccccaaaaataggggg

SEQ ID NO: 68698 - DNA, 663 bp, Zea mays
  misc_feature: Ceres CLONE 1545397
  misc_feature: Encodes the peptide sequence at SEQ ID NO. 68699
tggagctccccgcggtggcggccgctctagaactagtggatcccccgggctgcaggaattcgtctcacccctagaaaaaagtccatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagcccccgggaaaccaaaaggaaggtgaagagcagcaaaccggcggcggcggccaaaaagtgacgtacagtacgtgtggagtgtaatggagcttcccttaatgcatgagtggatccatgccatgttatgaatctaagccctccctttcttgtatcttccatgggacccggcgggtgcgtcccctccttgtgtgatgatgccagatgaatactacaaataagaccttggtgactgtgcccaaaaaaaaaacaaaaaatgtgaatgcctttttcccccccctaaaaaaaaaaaaacccgaagacccttcgggggtacccccattttccccccatggaggggaggcgtaaattcccgccccgctccccgg

SEQ ID NO: 68699 - protein, 71 aa, Zea mays
  misc_feature: Ceres CLONE 1545397
MASLKAAKPSGVAAQGKEPAPKLSETATKPSAAKSGGVKKAEQKPPGNQKEGEEQQTGGGGQKVTYSTCGV

SEQ ID NO: 68700 - DNA, 660 bp, Zea mays
  misc_feature: Ceres CLONE 1545398
  misc_feature: Encodes the peptide sequence at SEQ ID NO. 68701
  misc_feature (660)..(660): n is a, c, t, g, unknown, or other
aaagctggagctccccgcggtggcggccgctctagaactagtggatcccccgggctgcaggaattcgtctcacccctaaaattttttccatccccatcctacaagtttatatataaatatatttcttcgcccgcgctctggaaagtcaggatcctcatgaacccctctgaaactggcgtttataggagggacgcaagcttttctcctgatggagcaccttgcggtgccttggctctgccttgcttctggggcggctctgctaccagcgctaccgtctggatatgtgatgtgcagcatctcgcgatactgatagcagattactttaaactatcctgctgctccgcttcatctacccccgacaagtactaaacctgcttctcttcggtgcctggtgtgttggtgagcaaagccggcggttctctcttcctcatccccatgctggtcaacgaatactatccgctcgcgctccaatctgttctaatcatcactatagcgaacgatgccaggtgctcctaatacctgcccatggatgtgtccagagactacttcgtgccttacacatatggctagctctcgtgcctcctcttgagatcttgccgcacatcctcttgcctaatacgtgtatacgctggtgcgtgtggaactgcttaggctcctgcn

SEQ ID NO: 68701 - protein, 70 aa, Zea mays
  misc_feature: Ceres CLONE 1545398
MNPSETGVYRRDASFSPDGAPCGALALPCFWGGSATSATVWICDVQHLAILIADYFKLSCCSASSTPDKY

SEQ ID NO: 68702 - DNA, 651 bp, Zea mays
  misc_feature: Ceres CLONE 1545402
  misc_feature: Encodes the peptide sequence at SEQ ID NO. 68703
  misc_feature (530)..(530): n is a, c, t, g, unknown, or other
ctaagctgaagctcaccgcggtggcggccgctctagaactagtggatcccccgggctgcaggaattcgtctcacccctagaaaaattatggctccgcctgagatgtcagcaggccctggcaaaggtagataggctctcacctctcagatcgacggatgcgggtggagtctggcatggagcatgcgatctcctctgttaccccctaattgcctatctcgaactcgaaaaaagcacgagagagagcgagcagaccggcggctcggcagccatggtgtacagacgtaggctgctccctctccgtgcgacgagaaggactacttccgcacggcgcaggtccgggaccctccggccatggaagaagtacatcgacttgaccccttccttgcccgccgtgccacgctcaacgacggcggctccgcgctcctcatcgccgacgagaatggccggctcgtggtgctgtcgaaggacttgtatcacgaggtgccgcccgacgtggtgaatcggcggaaactgacgtcactgatgctcgnggcgatgtacaggaagaccgactgcgcgctgaatctcctgcaggccggctgccagatcctcctgtgcgactccaactgcgggcggacctgcctgtgccacacgatcctacttctgccacct

SEQ ID NO: 68703 - protein, 100 aa, Zea mays
  misc_feature: Ceres CLONE 1545402
  misc_feature (60)..(60): Xaa is any aa, unknown, or other
MEEVHRLDPFLARRATLNDGGSALLIADENGRLVVLSKDLYHEVPPDVVNRRKLTSLMLXAMYRKTDCALNLLQAGCQILLCDSNCGRTCLCHTILLLPP

SEQ ID NO: 68704 - DNA, 667 bp, Zea mays
  misc_feature: Ceres CLONE 1545404
  misc_feature: Encodes the peptide sequence at SEQ ID NO. 68705
  misc_feature (491)..(491): n is a, c, t, g, unknown, or other
aagctggagctccccgcggtggcggccgctctagaactagtggatcccccgggctgcaggaattcgtctcacccctagaaaaaaatcttcctcgcagcgccggcgctccatcttccgctccctccccgactcgcgatcggcacgcaggcgacgttggggcagtcccggactcggcggcggcgtcagcggctccccctcccgccctcgccagtcgcttccggtcctccgcacaccaaccggcgactctgcgtgcgcgcctcctgcttccggtggaccgtcgacggcgcccgggccccggtggccggcgggcagcgagagccagcagcctggcagttttcctcattggaaaggaaggacaatcagagccaagagtttcttcataaacctgaataaaaggacatgcgattacggaatacagacagggcaccacgtagctcaggtcgtcgcaataatgttctttcatggatctctgaagttaaagacacatctanatgtgggcgtaagaaagaaaaggggtagaagagcacctccatctgctaaaagattgcgtgataaaagggtggataaggcgattgaaagtgatggtgctgttgacagtgacagcgatgatacagaatggacaggttgacaagaatcagcctagtgcaccattggaggaacatgttga

SEQ ID NO: 68705 - protein, 58 aa, Zea mays
  misc_feature: Ceres CLONE 1545404
  misc_feature (14)..(14): Xaa is any aa, unknown, or other
MFFHGSLKLKTHLXVGVRKKRGRRAPPSAKRLRDKRVDKAIESDGAVDSDSDDTEWTG

SEQ ID NO: 68706 - DNA, 641 bp, Zea mays
  misc_feature: Ceres CLONE 1545407
  misc_feature: Encodes the peptide sequence at SEQ ID NO. 68707
  misc_feature (530)..(530): n is a, c, t, g, unknown, or other
  misc_feature (572)..(572): n is a, c, t, g, unknown, or other
aaagctggagctccccgcggtggcggccgctctagaactagtggatcccccgggctgcaggaattcgtctcacccctagaaaaacccacacagacacagcctcccaccacaaaccctcctccagtgctcttttcttctagccgccgccgcaaccgcttgctagcgctctgcgctctcatcctcgcgtccgtggaaggtcgtctcgacatggcctccgagacggagacgttcgccttccaggcggagatcaaccagctgctatcgctcatcatcaacaccttctactccaacaaggagatcttccttagggagctcatttcaaactcgtccgatgccttggataagatcagggtcgagaagttgacggacaagagcaagctggatgccccagcgcgagctgtcatccacatcgtgcctggacagggcaacatactctgacgatcactgaacgtggcattggtttgaccaagtcagaacctagtgaacaccctgggtaccattgcccgatctggaacaaaaaagttcatggnagccactggctgctgttgcccaagtgtccatgatttggcaantttgggggcccgttccacccgggataccttgttgctaaaaaggttgtccggacccccagcaaaggagaa

SEQ ID NO: 68707 - protein, 76 aa, Zea mays
  misc_feature: Ceres CLONE 1545407
MASETETFAFQAEINQLLSLIINTFYSNKEIFLRELISNSSDALDKIRVEKLTDKSKLDAPARAVIHIVPGQGNIL

SEQ ID NO: 68708 - DNA, 663 bp, Zea mays
  misc_feature: Ceres CLONE 1545411
  misc_feature: Encodes the peptide sequence at SEQ ID NO. 68709
  misc_feature (552)..(552): n is a, c, t, g, unknown, or other
aaagctggagctcaccgcggtggcggccgctctagaactagtggatcccccgggctgcaggaattcgtctcacccctagaaaaattcccctccaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagaggcggcttggttttctcgaaagatcagcagccactcttgaatcaagactttgtcacacttgatagcatctaggtaataacatctttatccaaaatggcaccgccaaacacttgntcgcttcaaaagggaatgatgccttcctacagggtccaaaatgccccaaattgtttcccaaaattagaggcccgggttaatgtaatcaaaaaaaaattttggaaactgggt

SEQ ID NO: 68709 - protein, 68 aa, Zea mays
  misc_feature: Ceres CLONE 1545411
MSEQSLLYLGLLGEYSCATRKRHKFLLHCMHQEPIRFPCSEVSFASAQRRLGFLERSAATLESRLCHT

SEQ ID NO: 68710 - DNA, 657 bp, Zea mays
  misc_feature: Ceres CLONE 1545419
  misc_feature: Encodes the peptide sequence at SEQ ID NO. 68711
atagctggagctccccgcggtggcggccgctctagaactagtggatcccccgggctgcaggaattcgtctcacccctagaaaaaatgcagctgctctggttttggttctcttccagccagccaccgtagagcgcgcagcaaagctggcgtcagtcagtctgacagctcagctcctcccgacctccctatatctctgctcccccaaaccctaatccctggcataacacaacaatctctctcccctcactccctctctgcagcgcgcagctttcaaagcgttgggagagatggcagaggagacgcaaccagaggccgccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgccgccctcgccgcaggtgagttcaacctgcctcccccgccgccgccgccgaaggccaagtagacaaaggtggaggaagccaaggccgaggagc

SEQ ID NO: 68711 - protein, 112 aa, Zea mays
  misc_feature: Ceres CLONE 1545419
MAEETQPEAAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAK

SEQ ID NO: 68712 - DNA, 632 bp, Zea mays
  misc_feature: Ceres CLONE 1545420
  misc_feature: Encodes the peptide sequence at SEQ ID NO. 68713
  misc_feature (632)..(632): n is a, c, t, g, unknown, or other
aagctggagctccccgcggtggcggccgctctagaactagtggatcccccgggctgcaggaattcgtctcacccctagaaaaaagccgatacagacacaccacgcccgctctccacttctcgtcccccagatccgccccgcccgacgcgagatgctcgtccaggaccgcgcgtccccgcacgcggccgccgcaggccagaagccgtcctcgtcccctcgcggcgcgccgggggcggaccgccggcacccgcggcccttcgccaagaacctcgacttcgccacatgggcgtccgagcactcctccaagctcctgctcctcctcctcgcgatcgcatccgccgccgccgtcttcctcctgcgcggcgcggcccccgacgccgccgcgctgctctgcctcgaccgctccgcccgctcgcgctcgggcgcccccgccaagctcccgtacccggacgtcgcctggtccaaggtcccgcctctcgcgatcgctgcgggtagccccttcgcgtcttccggggcggagcggtggatcgtggtcgctgtctcgtccccacctaccgcggcgctggccgcgctcgcccgcgtcaagggctggcagctcctcgccgtcggcgattcccacacgcccgcagggn

SEQ ID NO: 68713 - protein, 160 aa, Zea mays
  misc_feature: Ceres CLONE 1545420
MLVQDRASPHAAAAGQKPSSSPRGAPGADRRHPRPFAKNLDFATWASEHSSKLLLLLLAIASAAAVFLLRGAAPDAAALLCLDRSARSRSGAPAKLPYPDVAWSKVPPLAIAAGSPFASSGAERWIVVAVSSPPTAALAALARVKGWQLLAVGDSHTPAG

SEQ ID NO: 68714 - DNA, 793 bp, Zea mays
  misc_feature: Ceres CLONE 1545422
  misc_feature: Encodes the peptide sequence at SEQ ID NO. 68715
  misc_feature (1)..(1): n is a, c, t, g, unknown, or other
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (52)..(52): n is a, c, t, g, unknown, or other
  misc_feature (53)..(53): n is a, c, t, g, unknown, or other
  misc_feature (400)..(400): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (465)..(465): n is a, c, t, g, unknown, or other
  misc_feature (793)..(793): n is a, c, t, g, unknown, or other
ntttttttttgaaaanccccnntncattnnnaaannnnnngaattctatttnnatatatttataacttccccccgtgtctgccgctctagactagtggatcccccgggctgcaggaattcgtctcacccctagaaaaatgcgtcgtctctgtcgttcggttttgcttcgggtcaccgtgtaccctttgcttgcttggtttcttctttccttttttcctttttttggcgtcttttccccggccatggttcctttgctttccagcagttctctgctggatgtgatgtatccattgttgcactcctggccttccattggctacctctatacctgctacaaaacttcttgcccccccaatatatacttggcgctgacgaacttttttttttaccatacacccgntttttaaagcaaaaaattttatcttcccccccccccagggggggaagaatgggggggnnnncccntttccccctctttttccattcttataaaacaaaacacaaaataaactcatctctttccctaccggcgtgcaatgtacaaaaacccatccccttttccccttttttaacccctctctcgcttcataccttcccccctctctcccccatccatttacaccaattacccaacattgttccccccactcatacagcctcccttgcacctctcttacctttagttcttctttttttaatcttcattaatcagtaatatcccccccctttcgcttttagtttcccctctccaccccgtccccccttcttaccacactcctctcattccgtacan

SEQ ID NO: 68715 - protein, 89 aa, Zea mays
  misc_feature: Ceres CLONE 1545422
  misc_feature (88)..(88): Xaa is any aa, unknown, or other
MRRLCRSVLLRVTVYPLLAWFLLSFFPFFGVFSPAMVPLLSSSSLLDVMYPLLHSWPSIGYLYTCYKTSCPPNIYLALTNFFFYHTPXF

SEQ ID NO: 68716 - DNA, 848 bp, Zea mays
  misc_feature: Ceres CLONE 1545424
  misc_feature (11)..(11): n is a, c, t, g, unknown, or other
  misc_feature (19)..(19): n is a, c, t, g, unknown, or other
  misc_feature (36)..(36): n is a, c, t, g, unknown, or other
  misc_feature (37)..(37): n is a, c, t, g, unknown, or other
aaaaaaaaaantttccctncaccacaaatttattannggcgggcggcggggctaatctggggtcaccgcggaggcggccgctctagactagtggatcccccgggctgcaggaattcgtctcacccctagaaaaagctcctgttcaagatttcttgtttgacaagaatcatattttagcagttggcgctgaacctctgctctcccgtctcacaataaacgggacagtcctttcacaagtaaagtgtgcccctcagtcggcgttttctgtctccatccactcaaatgggatagaagctgttgctggatacggaggtctggtggatgtgatctcagaatttgggagccatctgtgcacattcggtagccgtggcctattaccagtatatgaccccttgaccatttctttgccaaaaagctcagagcaaaaatcgccaggggctgtaaatcctctttcccactgacaatttggccccaacttttccttgggacccggttattcctcttgaacactggtctttatcttgtaaccacaagaatctctcttagtcgctggtcaagacaaaaaatcccatttttgataaacctaagtttcccaaggcttaaaaccaaacctttctttgctcttccattaatattacatgaattaaatattccgatgcactgttttcaaagggagcccccaatatttctttcctcccaatcacccgtagccccctctactttatccccggctcccatcacatggggacccgcgcgctcttttacaataaatatctccttctaacctgtgggcaaaaacacccccgtggcggctcttcacccgtcatttcaagtttttgactgttttt

SEQ ID NO: 68717 - DNA, 641 bp, Zea mays
  misc_feature: Ceres CLONE 1545428
  misc_feature: Encodes the peptide sequence at SEQ ID NO. 68718
atagctggagctccccgcggtggcggccgctctagaactagtggatcccccgggctgcaggaattcgtctcacccctagaaaaaagtgctttcttttaggtgggttggcttctcctccccctccggttcgggttcgggttcgtgaggttctccggtgttcggtttcgtgggtgagcggatctagatggcggcgtccgatgttgagtaccgctgcttcgtcggcggcctcgcctgtgtcacggacgaccactccctccacaacgccttctgcacctactgtgaggtcctctagtccgagatcatcctcgatcgggagacgcataggtcccgcggcttctgcttcgtcaccttctccacggacgacgcgatgcggaacgccatcgatggtctgaacggcttggagctggacggccgcatcatcaccgtctacgaggcccactcccgcggcgttcgtggaggcggcggtggtgtgtacagtggtggccgtggaggcggctgctacagtgactccgacaggatctgagagatctgatcggtggggcccgcgcggactagttatcctgttcgctaccgcgttgtttaccctactccagatggtttatcttcgttcgtctcatgtttgttgttgaccatctgtgttt

SEQ ID NO: 68718 - protein, 35 aa, Zea mays
  misc_feature: Ceres CLONE 1545428
MAASDVEYRCFVGGLACVTDDHSLHNAFCTYCEVL

SEQ ID NO: 68719 - DNA, 848 bp, Zea mays
  misc_feature: Ceres CLONE 1545433
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
cccacctcccccnncntttttttattgggcaccccgccgcgcgccnnnncccaaccgacacccaaacccatggcgaagctctttactctcccatcccccgggctgcaggaattcctctcacccctagaaaaactctgatagcaccgttaattactgcgtgtggcgttcgcgtacgtgcgcggggcagtcggttactctgttgccgcgcgcggcagctcagtggcgcgttcctggcgtgcatgatgcgggtgacgtgcgggatgggcacgtcgctgcctgagaagctcgcgccgttggcgttcttgtgactgaccaaaagtcgtccttggattgtaattctctctacctaattttgtaaattgacccttacaagctgctgcctcgcaatgctctatcataaaaccaattttttctcctttcatcccccccccccccagagggggggggggggggtggttacccacacttcccctcccttatcccagttagttttatttataaccacggacgacccccatgtgtgcccgatcttttctctcaaccacaatgacccccccttatcctgtacccaaacatctcccccccgtcgctaatacttcacccattttctgccgcgcctctcttgtacgcccacccacgccctcggccttttccccccttttgtgttctccccatataacctatgaacaacaatcttcgccatccaatgtcaagctattctttcccgccctactgcctgcctctatccccccccccttttccacccgctttctacacctccgtaacttatataaactattgtgtttcccactcaatgaacgtgtgtcccctgttcctgttttgtcttg

SEQ ID NO: 68720 - DNA, 745 bp, Zea mays
  misc_feature: Ceres CLONE 1545441
  misc_feature: Encodes the peptide sequence at SEQ ID NO. 68721
  misc_feature (18)..(18): n is a, c, t, g, unknown, or other
  misc_feature (25)..(25): n is a, c, t, g, unknown, or other
  misc_feature (48)..(48): n is a, c, t, g, unknown, or other
  misc_feature (60)..(60): n is a, c, t, g, unknown, or other
tttttttttgtggtgtgnttgtggnttaattcaaatatattagaatgncccccccccccnaaaaactgggactccccgcggtggcggccgctctagactagtggatcccccgggctgcaggaattcgtctcacccctagaaaaaaaaaccctaacactcatcacgccgccactgatctgctctgttgctggtgactaggagcagtagcgagagggattctggatggccaagtcgaagaaccacacggcgcataaccaatcgttcaaggcgcacaagaacggcatcaagaagcccaagcgccaccgccagacctccaccaaggggatggacccgaagtttctgaggaacttgaggtactcaaggaaggggcaacaagaagagtggcgaggctgagtccgaagagaaagatgatggtgattgagtttgtggcgaccaatgcatctcttgtatcgctaagagtcttagctgtgaacttagttctcacttctgtgtgaatgtgatcaaggaaatccctcagttgggtcccaagtgaattttaagccttggtgggtacccggaaatttaaattaaaaccatcagttggtatccctttttgaaaattgggtcaaaaaaaaaaaaaataaacgcgagccccctccgagggtacccccacttcgccccccaaaaaggggaacgccctaaattaaagacccccccttccccttgtggcgcgttcttatattttaacaccccctctctgggaaag

SEQ ID NO: 68721 - protein, 56 aa, Zea mays
  misc_feature: Ceres CLONE 1545441
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGQQEEWRG

SEQ ID NO: 68722 - DNA, 784 bp, Zea mays
  misc_feature: Ceres CLONE 1545447
  misc_feature (15)..(15): n is a, c, t, g, unknown, or other
cccccccccctcccntttttttttttttgtgcatcccgccgccccccttatttcaaaactagaactcaccgcggtggcggccgctctataactagtggatcccccgggctgcaggaattcctctcacccctagaaaaagtctctctccgactctccctcgcccgcgcacctttccgcgccgcctccttcctttcctcgcgtgctctggcgcgcgcaaggatcaaaaggcgccggccactaaaggcgagtgagtcgcatgtaaacgaccaccagctgctgtgatctcaaaagggagcgagagacaaaggagaggcgagcaggtcgtggcggcagcaatcgttgcgaatccgcgcgggattctgtcatctgcaccaatgcttaccgctttccctgcccggcggaagtggtataattatccaaggcggatgactgcattgcccctcgctctcccgtgggcgggggcatggatcacgcaccatatattcacgtggaagatgctccacgaagagggccgatcccgggggagcctaaacggataacctccactcccgtagatattcaccccatccccgagaccacaaccccccgtttcgggtattaccgaacccttcaaaaaactccgggtttgaccaaattcagccagccgcaacccgccctggcccaaggctgtctcgtcatacagtcccactgtgtaaaagcgcgggttgccccccccgggacataagtcacctccactgccccccttcacttagggtatcatcgccctccacggcgactcccgccc

SEQ ID NO: 68723 - DNA, 631 bp, Zea mays
  misc_feature: Ceres CLONE 1545472
  misc_feature (272)..(272): n is a, c, t, g, unknown, or other
  misc_feature (273)..(273): n is a, c, t, g, unknown, or other
aagctggagctccccgcggtggcggccgctctagaactagtggatcccccgggctgcaggaattcgtctcacccctagaaaatctctcctctcgctcgcgtccgcacaaatcccgtgctcccccgtctgaaaaccctccccacctccggcggcggcggcggcgctggcgaacgggtgtcttctccggcgagtctcccccctagtaacagaaaatatggatgtacctggtgatgaccctgtggagaactcactggaagtctagtacccttgcnnatgagagaaacccctacttttgcgtatgtgcaagatccgtccaaggagaaaccaaaaagctttcgaaggacccaagacccatgccaaaacagtttgggaaacccgggcatgtgagcctgaccatggagatgtgtgaaggcccaaacaaatgggaccaactatccccccaaagaccgggaagaaacttggggggtaccccactgtgacgctactttcccgaaaacaaaaaaagtcccgggtgggcctggaaaaagagtggtcccgataaccgggtcctacacaaaggggtggggcgcccctttgcgcgcaaaggggatttctccaggaaaatgtgtgaggaatcaagagcccgcatcaa

SEQ ID NO: 68724 - DNA, 639 bp, Zea mays
  misc_feature: Ceres CLONE 1545474
  misc_feature: Encodes the peptide sequence at SEQ ID NO. 68725
  misc_feature (238)..(238): n is a, c, t, g, unknown, or other
aaagctggagctccccgcggtggcggccgctctagaactagtggatcccccgggctgcaggaattcgtctcacccctagaaaaagcgacgaactcatcactgcactggtggtgcccgtggtgctccacagagtgaagcgatagccaggagaggcgacgatgcgcaagtgggcgctctcctccgcgctcctcctcctctttctgctgcacacactcccccgaccagctaagaagctacnagctgatgcccgagagagcagcgatgacttggcctaccccacgcatgtaaaggaaaagtttggtgctgtccctcatgccctgtcaaccgactctgaaggtgccccgaggggagcgaatctatcctctggaaagaccctccggagtctagccaaaaattttgagtccccagccgaaggttcccgaaccccggggacccttcctttaccccccctctaaggaacccaggatttcttcccgggggggaccccatttccatggccccccggaagcgcttggaaaaaaaaaaagggcccccttcctctcccccgtaaaggaaatttcttggggaaggggacccccgaaaccttggaattccaaaatattgggacaaaaagaaaaaaaccccccccctccgggggag

SEQ ID NO: 68725 - protein, 98 aa, Zea mays
  misc_feature: Ceres CLONE 1545474
  misc_feature (27)..(27): Xaa is any aa, unknown, or other
MRKWALSSALLLLFLLHTLPRPAKKLXADARESSDDLAYPTHVKEKFGAVPHALSTDSEGAPRGANLSSGKTLRSLAKNFESPAEGSRTPGTLPLPPL

SEQ ID NO: 68726 - DNA, 625 bp, Zea mays
  misc_feature: Ceres CLONE 1545482
  misc_feature (192)..(192): n is a, c, t, g, unknown, or other
aagctggagctcaccgcggtggcggccgctctagaactagtggatcccccgggctgcaggaattcgtctcacccctagaaaaacagcatctcaagtcttcacactccctcgcatcacataaaaccagtgcaagcagaagcagcgcaatggcgagcagcaccatggccctctccctccacagccttcgccggnaagcaatgaaagtggccgtcttctctctctccggcaagccccgcttgacaaacccccagaaggcgcgcaaaagcaaaaccggggggaaatccccggaacccgcgggtcagggcccacaccccggttctaccttgggccccttttccgggcccccccccaatacacttaagggggaattccccgggaaaaccagggtggaacccccccggggttgtcggaacacccgaaaaatttccccaaaaacgggggtggggggggcccccccccccccccgggacatcttgggggcctttttttttttttttccccaaaaattctccccccccccggggggttattttttaaaaaaccactttgttttttaccacggcccaaaaaaaaaatttaaggggggggggggggggtcccctccttccaccaccaccaaattatt

SEQ ID NO: 68727 - DNA, 1300 bp, Zea mays
  misc_feature: Ceres CLONE 1545487-R
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (847)..(847): n is a, c, t, g, unknown, or other
  misc_feature (1300)..(1300): n is a, c, t, g, unknown, or other
gggggaggggggggtggggggggttggttttaatatttatnnnaaaggccgggaggggcagagggnnnnnnnnccccggcggggatgcctgaaaataaggtgcctcagatatatagcaaaaaaaggtgggtccggatgtaagataaaattatcgaaagcttcaacgaccaccctgaagtacaaacccatgcccaacatgaatacaacggtggatcatcgtcatcctcttaacatctactacaaattgccaaactagggccttatctttaaatctaaatggacctatgggggaaatacaagcctttccccacaaaaaaataaatcagaaacaaagctgcttcccgggaatgatcgagtcacttcctcttggactctggaaagctctatatggcacccaaaagaactgcatcttactgggcaatattcaccatctccccaggtaactgtcgggttcaaatccaccaggagcaaaaagtgtcttttccccccctaggaggaaccaccaaaaattcttgtcgctatctggtcatttgaactggtttatagattagtatcgtggacaaagctatattggggtgctgtggcgatgcaagatttaaattatttcgaaatgggggggggccagaggcaaaattgggggtgcagaccttttgtgggagtcgcggaatctattaaagagaggtttgcccagttgtgatacaatacctaatctgccaaaatgaggggcaggttagcagacacaaaaccgtgcgggatgcctatataaataaggtctcccgtcttgtgtgcccagggaaggatcaaatatttctatataagaagaatagatacacgggtcgggttttanaattacacgctctctaagatgagaggggggggaaatctttgtttcagaggagagaagaatcttcttccacttattccccccctgtctagttaaaaggtaaacttctcttccggcacgggatgttgtcgctcacttgaagcaagagagaagtgttttgttgcgtggcgcccctccataatcacatggtgtctgtgcaacacgaggggggttaccggggctgtccacgcccataagatacacacctcgggaggaagcggataaaaaaaatgctccgagatagagtgttataggaggaaagattcacaaaatttgtgggtgtcaccgttactagaaatatgatacaaaatgtgcctctttatcagtttgtaataatcagcaccatactctctgtaaatattgtggtgtcgcgaaagagaccatattatcacgcccttctttttgtttgtcttggtn

SEQ ID NO: 68728 - DNA, 614 bp, Zea mays
  misc_feature: Ceres CLONE 1545498
  misc_feature (251)..(251): n is a, c, t, g, unknown, or other
  misc_feature (255)..(255): n is a, c, t, g, unknown, or other
  misc_feature (256)..(256): n is a, c, t, g, unknown, or other
tgtggatcccccgggctgcaggaattcgtctcacccctagaaaaaagacgactgcgatccctgccacacgagcgcaacgcctcttgggtccggcgtgcctgtgtcagcgggagaagctcggacatctccgcgattctccgcgggatcctgctggactggtctgatccctccgtgttggtgtctgcgagcctgccttgaaggatgctaggcgcgtggcgtatctcgcttggggaatcgtcccggaaggtggntggnnccgtggtggagccattcacgctgcgcccccagatgtcccctctccccagggcgatgtaagagcagtgccgcttggctcgcggcgccgaccttcgcccgcttgaagaggcccttctcggcgctccacttggtgtcggcgctggatgccggccaaaagtgtgaagcatgtttcttcgttgcccaaccacccttccacatagggatttcatcacctacttgggaccatgccgccctcaactactttaacagccaagccctcgtcctagcagacctccgccgatggttccgtccctcatccgcggcttttccggagaagccgcatccaaagtcgtaccccgcccgatcaaggggtccgaaga

SEQ ID NO: 68729 - DNA, 641 bp, Zea mays
  misc_feature: Ceres CLONE 1545499
  misc_feature: Encodes the peptide sequence at SEQ ID NO. 68730
  misc_feature (447)..(447): n is a, c, t, g, unknown, or other
  misc_feature (486)..(486): n is a, c, t, g, unknown, or other
aaagctggagctccccgcggtggcggccgctctagaactagtggatcccccgggctgcaggaattcgtctcacccctagaaaaaccctttctcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggnactcacccgctccccccgtcatcgcaaccacctcttccngcacgagcagggggaggcctttgccgcctccggctacgcgcgctcctccgggccgcgtcggcgttctgattcgccacctccgcccccggggccaccaacctagtcttccgcgctccgcgaacccgctgttcaattcccgtccccagggtcgccat

SEQ ID NO: 68730 - protein, 143 aa, Zea mays
  misc_feature: Ceres CLONE 1545499
  misc_feature (65)..(140): Pfam Name: TPP_enzyme_N Pfam Description: Thiamine pyrophosphate enzyme, N-terminal TPP binding domain
  misc_feature: SWISSPROT Homolog: EC 2.2.1.6 Acetolactate synthase
  misc_feature (97)..(97): Xaa is any aa, unknown, or other
  misc_feature (110)..(110): Xaa is any aa, unknown, or other
MATAAAASTALTGATTAAPKARRRAHLLATRRALAAPIRCSAASPAMPMAPPATPLRPWGPTEPRKGADILVESLERCGVRDVFAYPGGASMEIHQXLTRSPRHRNHLFXHEQGEAFAASGYARSSGPRRRSDSPPPPPGPPT

SEQ ID NO: 68731 - DNA, 630 bp, Zea mays
  misc_feature: Ceres CLONE 1545517
  misc_feature: Encodes the peptide sequence at SEQ ID NO. 68732
aaagctggagctccccgcggtggcggccgctctagaactagtggatcccccgggctgcaggaattcgtctcacccctagaaaaaagctagaagtaagcagcaagatcagcagcagcaggaggaggcagcaggaacagaaatatggcggcgagcgagacacctccacacgtctctcccccttccgtttcctcccgtccctgctcacacctctgtagctgcgcccgaccgaacccctcctaccccggaatcctccccccgatgcggcgccgataagggggcgagaccggcggaagagcggggaatggcggggcgcggcgagaagcggcgccggacaggaggggcccacgaggagcccgaggaggaggaccgcatctcggaccttcccgacgtgctgcgcctgcagattctgagcctgctgccgctcaaatcggccatccgcaccggcgcgctctcctcgcgctggcgccgcctctgggcgtaccgctggccggagccgtcctcggtgagcatccgcctcccgccgggcggcggcgccgccgccgccgcggcgaccgctgccgcgctcgcggtgatctaccgccgcgggcggcgccgcgtctaatgcttctcgctcgccttccacggtgggca

SEQ ID NO: 68732 - protein, 99 aa, Zea mays
  misc_feature: Ceres CLONE 1545517
  misc_feature (22)..(69): Pfam Name: F-box Pfam Description: F-box domain
MAGRGEKRRRTGGAHEEPEEEDRISDLPDVLRLQILSLLPLKSAIRTGALSSRWRRLWAYRWPEPSSVSIRLPPGGGAAAAAATAAALAVIYRRGRRRV

SEQ ID NO: 68733 - DNA, 756 bp, Zea mays
  misc_feature: Ceres CLONE 1545534
  misc_feature: Encodes the peptide sequence at SEQ ID NO. 68734
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (756)..(756): n is a, c, t, g, unknown, or other
nccaaattnnnncccccnnnaaatttaattaaagagtttgtnntttttnntttcaaaactggagctccccgcggtggcggccgctctagactagtggatcccccgggctgcaggaattcgtctcacccctagaaaaaaacctcatccctcccaccccaataatacatccagccggcgccatcaggcccggcaacgcgcaagcggggctgaccatcgaaccctagtccccggccgagccgccctccgccgagccttgcggccgctctgcgtcatccctcttagtctccctccgttcgacacggcttggatccgagatggaatcaccgcccctcacagctgaggcaattgcttatacagagaaaaagatggacatggctttggaggatataattaaaatgtcaaagaaaaagaatcctggaggcaagaaacccccgaggcagccgataaaaaagcatccattcaagaatggcaactctaataaagggaatggcaaggttcaaagttttatggagtctagatcaaccataaaacaaagtgttcttgcacaaagaaaggcaaaaccttggtggaaaatcagttcccggcttacaaaacaggctggaaaagaaggctggttggttatgccaaatgcacaaaggggggctaatcccgttggaaacaaacccaaaggtaaaacaaaaggatggtcccttttttattggcccaatgaaaaaaaaggttttacctggaatttccaaggggggttggtttcaaaan

SEQ ID NO: 68734 - protein, 147 aa, Zea mays
  misc_feature: Ceres CLONE 1545534
MESPPLTAEAIAYTEKKMDMALEDIIKMSKKKNPGGKKPPRQPIKKHPFKNGNSNKGNGKVQSFMESRSTIKQSVLAQRKAKPWWKISSRLTKQAGKEGWLVMPNAQRGANPVGNKPKGKTKGWSLFYWPNEKKGFTWNFQGGLVSK

SEQ ID NO: 68735 - DNA, 534 bp, Zea mays
  misc_feature: Ceres CLONE 1545536
  misc_feature: Encodes the peptide sequence at SEQ ID NO. 68736
tggagctccaccgcggtggcggccgctctagaactagtggatcccccgggctgcaggaattcgtctcacccctagaaaaaatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcgaattatcgccctacccgtgtcgcatcttcgtcgacatcgtcgccagacgccccacatcggctgaaaatatataaagctacccgccttttccctttccctgcccccaaaatttgaaattaattttttttccaaggaaaaaccgcggggcggcccaaaaaaaggggtgggggaatttcccccccatttaagaaggggccaaaaaaaaaccgtttt

SEQ ID NO: 68736 - protein, 89 aa, Zea mays
  misc_feature: Ceres CLONE 1545536
  misc_feature (14)..(90): Pfam Name: potato_inhibit Pfam Description: Potato inhibitor I family
MSSTECGGGGGGAKTSWPEVVGLSVEDAKKVILKDKPDADIVVLPVGSVVTANYRPTRVASSSTSSPDAPHRLKIYKATRLFPFPAPKI

SEQ ID NO: 68737 - DNA, 745 bp, Zea mays
  misc_feature: Ceres CLONE 1545544
  misc_feature (16)..(16): n is a, c, t, g, unknown, or other
  misc_feature (19)..(19): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (50)..(50): n is a, c, t, g, unknown, or other
  misc_feature (385)..(385): n is a, c, t, g, unknown, or other
  misc_feature (663)..(663): n is a, c, t, g, unknown, or other
tcgcttggggggtttnttnttattatgaattaaatttnntatttttnttntcaaactggtactccccgcggtggcggccgctctataactagtggatcccccgggctgcaggaattcgtctcacccctagaaaaaccaagtgcggcgtcagcatcccctacaccatcagcacctccaccgactgctccagggtgaactaaaacctagaccacgcgcgacgacggccgcctgatcgatcgaccaaccattccgccgtcgccgccggccggatcatcggtcgtcgtcatgatgatatctatcaatctacgcgtgatgatcgatggctacttgtctactgctatgtactactaaataaaatctctccccgtgtgtgtacacgtacgcnttgcatgtgcaatggtagcatgtacgtacgacgtcgtccatgtataagtgtgtgacgtgtgagacggacagagagagagagagacaggatcgatcgagagacggtcatgtccttttggctgtttgggttattcatatcacaactttttgagtgtatggcccccccccccccctctctcactggccccaagcccatttatatactcccgaagtatatagcaagacagcatatttttattcatcttttatggagccgaagagaataaaatcttctccgtnttccgcgaggcccccccccgaaggggaaacccaccaatttccgccccctataaaaggggaggagcgccgttaaattacacca

SEQ ID NO: 68738 - DNA, 804 bp, Zea mays
  misc_feature: Ceres CLONE 1545551
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttttttttttttttgttgtttttttttannannnngcgcttcctnnntttatatttggaactccaccgcggtggcggccgctctagaatagtggatcccccgggctgcaggaattcgtctcacccctagaaaaacataagactacaaccctattagggcttgtttggttgtgtctgtatcgaagggaattgaaggtgattaattttccttctattctaatagaggggttttaatctcctccaatactcttcaatccacacctaaccgaacaagcccttaatatgatatcttacattaccgtatctgtgtaatatcatgaataaaatttgctattatgtattctaaggtttatgaactaccatacatggcagaattctcacattgtacccacaaaaaaaaaaaaaaaaaaatacgcccattatcccaattctatttgtttagatacgtttaaaccggaaatgctttaaggtcccccaatttctctctaaagggaagtctaattacccgcgccccccgtggcctccccttatacaaacgccgttgacgggaaaaaacccttggttttaccctcacttaactccccatggacaaaaaaaccccacttttaccaataatgggcggtaatcgaccaaaaagggccccccccgaaatcccccctttcccccaaatggtggccccacccctggaaattggccaacggaaaaaattttatatagccgtttaaaacatttcttcctacaaattttgcccgctccagaggttttggataaaagaaccacccccaccataacttttttaaaca

SEQ ID NO: 68739 - DNA, 650 bp, Zea mays
  misc_feature: Ceres CLONE 1545553
  misc_feature: Encodes the peptide sequence at SEQ ID NO. 68740
gcggtggcggccgctctagaactagtggatcccccgggctgcaggaattcgtctcacccctagaaaaatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaatccccacatgttcatagggatgcatttgttgctccaagtgcatcccttattggtgatgttcaagtcgggcaaggagcttccatttggtatgggtgcgtcttaagaggggacgcaaacaacatacaaattggatctgggaccaatatacaagacaattctcttgtgcatgtggctaaatctaatctaagtgggaaagtctttccaacaaaagacagcaacgcgaccgctgccacccctttgcggaatcgcggcttcggcctccggcctcagcggctcagccaaccacgacgccgccgtgcgcgccagcctccgtgggacacggctgccggcttcggtccgctctcggctctcgcccctcaggcctcagccacgccgcacgcggccggcacggcggcgcccg

SEQ ID NO: 68740 - protein, 184 aa, Zea mays
  misc_feature: Ceres CLONE 1545553
MAGLGKAMYAVGFWIRETGQALDRLGCRLQGKYFFHEQISRHRTIMNIFDKSPHVHRDAFVAPSASLIGDVQVGQGASIWYGCVLRGDANNIQIGSGTNIQDNSLVHVAKSNLSGKVFPTKDSNATAATPLRNRGFGLRPQRLSQPRRRRARQPPWDTAAGFGPLSALAPQASATPHAAGTAAP

SEQ ID NO: 68741 - DNA, 625 bp, Zea mays
  misc_feature: Ceres CLONE 1545554
  misc_feature: Encodes the peptide sequence at SEQ ID NO. 68742
tcttaactagtggatcccccgggctgcaggaattcgtctcacccctagaaaaaacaccccggtcggctagtcccaaggctgctgccgccgcctgccgctaggggatcgcttgatttcctcggaccactctgccgaccacatctacaccgcatcaacggtccttccaagtgagctccaatcccctgtctgtagatggagagggtgctaaaggatgacaccgtccaggagaagggcgagcgcgccacgatggcatcgtttgttgggggcatggcaatctcggatttggtgaagaccacattgggcccaaaaggaatggacaagatcctgcaatcaactggcagaggacgtaatgtgactgttacaaatgatggggctaccattttgaagacacttcacattgacaatcctgctgcaaaggtccttgttgacatcttcaaagttctagatgacgaagttggtgatgggacaacttctgttgttgtactaactggcaaacttttgaaggaggctgataagttaattaacatgaaaatccttcccgatgactattttttgccgggtaaccccaatggcttcctgagatgttgccaaaaaattccttttgcttaagaaagaacctttgggc

SEQ ID NO: 68742 - protein, 138 aa, Zea mays
  misc_feature: Ceres CLONE 1545554
MERVLKDDTVQEKGERATMASFVGGMAISDLVKTTLGPKGMDKILQSTGRGRNVTVTNDGATILKTLHIDNPAAKVLVDIFKVLDDEVGDGTTSVVVLTGKLLKEADKLINMKILPDDYFLPGNPNGFLRCCQKIPFA

SEQ ID NO: 68743 - DNA, 668 bp, Zea mays
  misc_feature: Ceres CLONE 1545556
  misc_feature: Encodes the peptide sequence at SEQ ID NO. 68744
cgtggatcccccgggctgcaggaattcgtctcacccctagaaaaagcccgggcccggcgacgaccagctccgttccgcgcggggatttaaacgcgcgaagcgagaaggcacgcatcaggcggcggcggcgagcaacgaacgcgatcgcgcgccgactacgacgcgcggtgccggcgcctggcggtgccttgttgcggactccgctgcatcgtctcggtcggtcgtcttctctatcatgggtgtccggctgccggtggcatggtccgccgtcctcgttctcctcgtgctggcggacgtggcgcgggagtacgcggccatcttcgacttcggggactccctggtggacgccggcaacctggtggtggatggcctcccccggtacctggtcgcggagcgcctgtcctaaggcttgacccacttcggctgccccaccgagcgatgctccgacagccgcctcgtcgttgacttcgtctcgcaggagctggggcttgctcctgctgtctccggtcaaggctaaggaacgcgaactttcatccgcggcgccgatacttctcgaatcactgggccgccacggttgtttggaaacggcccgttcttcccttggaggcttgcgggttgggggaaaaacggttcctggagacattcggggcgtcccttggcactagctc

SEQ ID NO: 68744 - protein, 56 aa, Zea mays
  misc_feature: Ceres CLONE 1545556
MGVRLPVAWSAVLVLLVLADVAREYAAIFDFGDSLVDAGNLVVDGLPRYLVAERLS

SEQ ID NO: 68745 - DNA, 682 bp, Zea mays
  misc_feature: Ceres CLONE 1545567
  misc_feature: Pfam Name: CHORD Pfam Description: CHORD
  misc_feature: SWISSPROT Homolog: EC 3.2.1.23 Beta-galactosidase
  misc_feature (682)..(682): n is a, c, t, g, unknown, or other
tagctggagctccccgcggtggcggccgctctataactagtggatcccccgggctgcaggaattcgtctcacccctagaaaaaggcatttttgtttaggaaattatcaacttctttaagatatatgttttcagcctatgtttcatgacggcatgaaagaatggagctgctgcaagcaaagaagccatgatttcagcttatttttgcagatacctgggtaaggacccctcttcctcccttggtatgtgatgagccattgacaatatttggacttcaatattagtgtgtatgatatactgtgcattggcagtatggctgtctggttgagaattggcgtaaaccaaactaataattggtaatgcaaaaaaaaaaaaaaaaacgagacgctcgaggtacccaattcgccctatagtgacccctattacgcgcgctcactggccgtcgttttacaacgtcgtgactgggaaaaccctggcgttacccaacttaatcgccttgcagcacatccccctttcgccagctggcgtaatagcgaaaaggcccgcaccgatcgccctttcccaacagttgcgcagcctgaatggcgaaagggaaattgtaagccttaaatattttgttaaaattccccgttaaaattttttgtaaaatcacctccatttttttttaacccaaaagggccaaan

SEQ ID NO: 68746 - DNA, 679 bp, Zea mays
  misc_feature: Ceres CLONE 1545570
  misc_feature: Encodes the peptide sequence at SEQ ID NO. 68747
gcggtggcggccgctctagaactagtggatcccccgggctgcaggaattcgtctcacccctagaaaaaaccacacaacgatctagctacttcctctctcaagcccataggtgttgtagaacaactcaactagtaatggcttccaagagcacaatgcgtccccttgtcctcatcatgatggggttgctgctgctctcgtgcagcggcatcagcagcgcggcgcggctgctggaggaggtggcgcccaaggaggagtacccgcaccctgaagtgccagagctgcccaagcctgagctcccgccgcaccctacggtgccggaactccctaaacctgatgagctaccgccacatccggtcgtgccggagctgccaaagcccgaggtgccagtgcacccccccgtgccggagctgccgaagcccgagcttcctcctcaccccaccgtgcctgagctgccgaagcccgaggtgcccgcgcaccccgccgtgccggagctgccgaagcccgagcttcctcctcaccccaccgtgcctgagctacaaagcccgaggtgccggagctgccaaagcctgaagtgcctgagcaccccgctgtgccggaactgccaaagccggagcttcttcctcaccccaccgtggctgagctaccaaagcccgaagtgcccgagctgcccaaacctgaa

SEQ ID NO: 68747 - protein, 181 aa, Zea mays
  misc_feature: Ceres CLONE 1545570
MASKSTMRPLVLIMMGLLLLSCSGISSAARLLEEVAPKEEYPHPEVPELPKPELPPHPTVPELPKPDELPPHPVVPELPKPEVPVHPPVPELPKPELPPHPTVPELPKPEVPAHPAVPELPKPELPPHPTVPELQSPRCRSCQSLKCLSTPLCRNCQSRSFFLTPPWLSYQSPKCPSCPNL

SEQ ID NO: 68748 - DNA, 629 bp, Zea mays
  misc_feature: Ceres CLONE 1545576
  misc_feature: Encodes the peptide sequence at SEQ ID NO. 68749
gctctagaactagtggatcccccgggctgcaggaattcgtctcacccctagaaaaaagggtttttcctgatctcgcctcctacttcccgagccacacacgctgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgttctccaggtttggagcagtagctcgtcttctcagcacaaagccagccgcaacagatgtcataggtatcgatctacgcacaacgaattcctgcgtctccgtcatggaaggaaagacaccacgggtgattgagcaccccgaaggcgcgaggacaacaccctccattgttgccaagaatcagaatggtgacctgttgattggtatcacagctagccggcaggcagtaaccaatgcccagaacacaatccgtgggtcacagcgtctgatcggtaggacttttgatgacccacagacccagaaggagatgaagatggtgccttaacagattgtcaagggcgccaatggtgatgcctgggtcgagatgggtgggcagcattactcccc

SEQ ID NO: 68749 - protein, 141 aa, Zea mays
  misc_feature: Ceres CLONE 1545576
MAFGALVTSRLARSGRTLASAVAQGPVAQRIAPPLFSRFGAVARLLSTKPAATDVIGIDLRTTNSCVSVMEGKTPRVIEHPEGARTTPSIVAKNQNGDLLIGITASRQAVTNAQNTIRGSQRLIGRTFDDPQTQKEMKMVP

SEQ ID NO: 68750 - DNA, 815 bp, Zea mays
  misc_feature: Ceres CLONE 1545578
tacaagcatcttaaattataaacaaaaacccatctttccaccccccactccccaaaagcactactcgcgatggaggccgctctagactagtggatcccccgggctgcaggaattcgtctcacccctagaaaaatcggtttacaaagcctccgccgccgcaagtccactccacccgttgtccaggttagttggttggtttcaatttccagttcgccgagcgacagcttgcgcctgccatttctcggctccgcgtgccggagctcgttcatctctagcttctccagccgttcgtctctctgaaccgacgacagtaccgataacgcccccactcgccatcctccggttactatgtcttcccgaccggattcccactcccttctggtgcgcgccccagtgcatgcccgtacgctgatttggactaccacagcctcttttgtcgaacagcgtgtgtataggtgtcttccacccgtgctgtgaatctgccatcataaccctgttggcccaacccccgttaacgcgttctacctccccctccggcgttagttccgttaaaccttgatttaccacttccttacactggtgcccggcctttgcggcaggggcctatcctaagcagagaggtggttcgtacttatcaatcgcccttagaattagggttggaccgaaacctcttttgcccgcttaacattgcctgtgcgcccttgtccggtcaaactgtagcttcccctcgatctaggagaatctgctgggtaatcgcccccatatcccccctaacttcccattgatccgcggggtaatattggaatctctagtcg

SEQ ID NO: 68751 - DNA, 660 bp, Zea mays
  misc_feature: Ceres CLONE 1545583
  misc_feature: Encodes the peptide sequence at SEQ ID NO. 68752
ctccccgcggtggcggccgctctagaactagtggatcccccgggctgcaggaattcgtctcacccctagaaaaagcaccactcccgcacttccgcgcggcgcgcgctcggcttatcgacaccaccacggcaccgctacagcctacagctcgagagaggaggaaaaaaaaatctcagccaccaccggcagccgcgggagcttcgcgtgcgccgcttgctcactgcccgcacacgtacgccagaacccctcgctccccctccttctgcagccatgctcctccacctgcttccgctctcctgccccgcgccgccgttccacctgcgcaggaccggcggctcgtcgcggacgccgcgggtccgggccggcgacagggccaggacacgggggctccgggggacggacgtggagccggagacagcgccgcgaaggcgccgcggccgcgatggcgacgatcctcaagcggctgggggcggtggagacaccggggcgctgctggcgtcggtcaggaggcttctgctctccgaggcgcctgcggcggcggagggagacagtgaggaggaggagcagggacagttccccaagcgttgggccatcgtcttcctctgcttctccgcatttctactctgcaacatggaccgcgtaaatatgagcattgctatt

SEQ ID NO: 68752 - protein, 130 aa, Zea mays
  misc_feature: Ceres CLONE 1545583
MLLHLLPLSCPAPPFHLRRTGGSSRTPRVRAGDRARTRGLRGTDVEPETAPRRRRGRDGDDPQAAGGGGDTGALLASVRRLLLSEAPAAAEGDSEEEEQGQFPKRWAIVFLCFSAFLLCNMDRVNMSIAI

SEQ ID NO: 68753 - DNA, 746 bp, Zea mays
  misc_feature: Ceres CLONE 1545584
  misc_feature: Encodes the peptide sequence at SEQ ID NO. 68754
tccccgcggtggcggccgctctagaactagtggatcccccgggctgcaggaattcgtctcacccctagaaaaatccccagcgtaacaagtgtccttcctccatcttcctcctccactccactcccaagtccccaccacccccaaccccgtctctccactgcggcgcaggcttcgcttcggctccgctcggctcgagcagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttggaagtctaaaggggaccaccgcctgatgggaccttggcttctggggccccccaaaaggaaaggcgtctatgaccctggtcaattctttggactccccccacaccggggggcctttgggggggtgggcaaaaccgggaaagaaaataaaacaaacccctggggatttgtcccctgaaaaaagaattttcctccggaaaaaacaaagggggtaggggagggggcttcccaattcaaataagggtggggggaacactctgtaccggagaaagaaaaaacaactggctcccagggggaaatcccgccaccccaagggtctcttggagggaaatggggggtttcttggaaaaaaaaaccccgccgccaa

SEQ ID NO: 68754 - protein, 62 aa, Zea mays
  misc_feature: Ceres CLONE 1545584
MQRAVQAVRSHGNVLKYAVLQHISAPKPAMLPAAFSRFMSVSSARLEDRGFETATVADVLEV

SEQ ID NO: 68755 - DNA, 646 bp, Zea mays
  misc_feature: Ceres CLONE 1545585
  misc_feature: Encodes the peptide sequence at SEQ ID NO. 68756
gcggtggcggccgctcttttactagtggatcccccgggctgcaggaattcgtctcacccctagaaaaaagtccgtcaggaatacaaggttatggcaagcagatctaagctccaggcagcggctcgacagagtgagtgagtaactcgacaacctcaatggcttccctgaaggccgcgaagcccatcggagttgcggcgcagggcaaggagccggcgcccaagctcatcgagacggcgactaagccgtcagccgcgaatagcggcggcgttaataagtgctgagcagaagccccgggaaaccaaaatgaaggtgaagagcagcaaaccggcggcggcggccaaaaagtgacgtacagtacgtgtggagagaaatggatcttccatgcatgcttgactggatccatgccatgttatgaatctactccttccttttttgtatcttccatgtggcgcggcgtgtgcgtcccttcatgtgtgatgatgcctgatgaatactaccaatatcacgttgtgactgtgccccaaaaaaaccgcaaacaatcgcccatcccaacaattgcacccgcctgcctcgggggatgccatttgtcccccttaaagattttgttttaatctcgcgccaccggttcttgtttatacaactcaaa

SEQ ID NO: 68756 - protein, 41 aa, Zea mays
  misc_feature: Ceres CLONE 1545585
MASLKAAKPIGVAAQGKEPAPKLIETATKPSAANSGGVNKC

SEQ ID NO: 68757 - DNA, 661 bp, Zea mays
  misc_feature: Ceres CLONE 1545586
  misc_feature: Encodes the peptide sequence at SEQ ID NO. 68758
acgtggatcccccgggctgcaggaattcgtctcacccctagaaaaaagccagcgcccgccctcgtcccttttgtatgtatgtgctccctctctccctccctccctttgccatttgccgatttgggcagcagcaatgacacttccctgcgccggcggctgcgagatccaagccagcggcattaactaccgcatcgccgtctccacccgacctctcaaggtctggagcagatcagacgacgacgtccattcccaagaccaccacagcgtcgtccgccaggtgctccgggacgtctcctgccgcgcgcgccccggcgagctgctcgacatcgtcggccccagcggcgccagcaagtccaccctgctcgagatcgtgccccggcgcctctccccgtccccgccgccccacctgctacgcatcgacagcgccgccgtccacagcggccgacctccgccgcgtctccccctacgtcacccagcaggacgtcctcttccccgctgctcaccgggcgcgagacgctgctcttcagcgcgcgcctccgcttaagcgcgcgcctgccctcccaggacatgcccgccccccttcgaggggctcctccgacgaactcaccctggcgccgcggtgaccgccaccaagaatcaaaggaccctctcccggtgggag

SEQ ID NO: 68758 - protein, 136 aa, Zea mays
  misc_feature: Ceres CLONE 1545586
  misc_feature (50)..(79): SWISSPROT Homolog: EC 3.6.3.28 Phosphonate-transporting ATPase
  misc_feature (50)..(80): SWISSPROT Homolog: EC 3.6.3.25 Sulfate-transporting ATPase
  misc_feature (50)..(80): SWISSPROT Homolog: EC 3.6.3.36 Taurine-transporting ATPase
  misc_feature (50)..(77): SWISSPROT Homolog: EC 3.6.3.33 Vitamin B12-transporting ATPase
MTLPCAGGCEIQASGINYRIAVSTRPLKVWSRSDDDVHSQDHHSVVRQVLRDVSCRARPGELLDIVGPSGASKSTLLEIVPRRLSPSPPPHLLRIDSAAVHSGRPPPRLPLRHPAGRPLPRCSPGARRCSSARASA

SEQ ID NO: 68759 - DNA, 627 bp, Zea mays
  misc_feature: Ceres CLONE 1545595
  misc_feature: Encodes the peptide sequence at SEQ ID NO. 68760
tcagaacttgtggatcccccgggctgcaggaattcgtctcacccctagaaaaagccggacctcttgtcgtcttggtgcgcgcgctcggtttcccttcctttttccctcgcgcgcggccaacctagaaagcgacggcggagccggagagggaaggggaggcgggccggctggtcaagggcggacgatgtgctgcggcggcgacggggagtgccggccgctcgggtggctcctgggcctgcccttcgcgctgctcgccgtcctcgtctccttcgtcggcggcgtcttctggatcatcgggctgccccatctcgtggcttctggccctgctggctctgcgggacggggcttctggaggtggccctggagctcgttaaggggccgctcccctttttgacttggttttcctcccagaaccccggctgggggccccgggtttctggggggggggactggggtcacttttgcttttaccccggagggttgctgtacccctactgacaggtttgtttcctttctccaccccccctggggcccgttcccccccgaagggcccttttggggttttccccccacgtttttttttctctaaaaaaacgcgccgccttttctccgggggggcgggagggg

SEQ ID NO: 68760 - protein, 69 aa, Zea mays
  misc_feature: Ceres CLONE 1545595
MCCGGDGECRPLGWLLGLPFALLAVLVSFVGGVFWIIGLPHLVASGPAGSAGRGFWRWPWSSLRGRSPF

SEQ ID NO: 68761 - DNA, 582 bp, Zea mays
  misc_feature: Ceres CLONE 1545596
  misc_feature: Encodes the peptide sequence at SEQ ID NO. 68762
ctccccgcggtggcggccgctctagaactagtggatcccccgggctgcaggaattcgtctcacccctagaaaaagtccccaacccacgcactgcccaccggtctctctcacacaacacagggatataagcccagtccacgagatctcccgtagaccagtggcgagggaagggaaggaacgaaacagagcccgatcctagcgacagggcagggaagatcgccatgatgatgatgggcgaaggcgtgagcgtgccgccgtggtcccaccacgtccccgtgagcggcgtcgacgtcggcgtcggcggagacgagatgacgcccgtaccttactgggggggctgcgggagtacttgcttgaagaccccgggcccccaagggacaacagaagcggggcatggcccgggctggacgtatcggtcgacaaatccccattcaaatcaaggccgggggggccccccccccaccccaaaggaccatggccccttccaccccgggaaaagggcggggggcacccccccgggggccatatttgggggcccccgcccggattttccaaagggggggggagaacccgggaaacccc

SEQ ID NO: 68762 - protein, 120 aa, Zea mays
  misc_feature: Ceres CLONE 1545596
MMMMGEGVSVPPWSHHVPVSGVDVGVGGDEMTPVPYWGGCGSTCLKTPGPQGTTEAGHGPGWTYRSTNPHSNQGRGGPPPTPKDHGPFHPGKRAGGTPPGAIFGGPRPDFPKGGGEPGKP

SEQ ID NO: 68763 - DNA, 827 bp, Zea mays
  misc_feature: Ceres CLONE 1545600
tacgttactttgaagcttctctataccgttttgtatctacccccccatcccactactggagctccacgcggtggcggccgctctatactagtggatcccccgggctgcaggttttcgtctcacccctagaaaaagaccacaactgtatcttcaagggtccaaaggggtgctatgcctccatgtgcggcggcggtggagctaatggcgtcctccatggtccgcttcgtctccacccctccagatgagctccggcacgacttggacggacaccgcccctttgctcgtcgactacgccactcctccaccgctatcgccctagcgctggatgactctcagcccccccagtggccaaggcagggccgtgctccgctgcggccacctatgaatctcccgagaggccttctccgatcctatctaggactgagctccccgagcttccgacctcaccaaacgggcttccgtttttacccacccacgcacatctaccctatgaaaaattggcatccctgcttcttcctgtgagaattttgtacgaaggtgccgtgagatccaactgtctgggcttctaaaagaactgggcgctgtccgggccacctggaaattccatggtattaaaaggcccaagactctgtttccttggaatggagttttgtcagtttttatcgtcccggggaagggaacgccccaccggggtatcctaggcacacttcaagggacaaacggttccgccatttttggaagggggtatcccaatagaagctctattccacaagcctatttgggttgttgcaaaactcattgcatccacccggccttgattcctttcc

SEQ ID NO: 68764 - DNA, 699 bp, Zea mays
  misc_feature: Ceres CLONE 1545605
  misc_feature: Encodes the peptide sequence at SEQ ID NO. 68765
tacccgcggtggcggccgctctagaactagtggatcccccgggctgcaggaattcgtctcacccctagaaaaaaagctcaggcaagcggcagcaaggcgttggcaatcccagtccagtcgtcggagcactcgcaatttcccgtcacagctggccaccgccccaccctcacggcctcacctcctcccgctacacgcacgcgcccacctacccaaaacgaccgcgcgcggcgccctcctcccgcggtgccaccaccaccaccacctcgtcggaccatcaccacaccgatcggcagctaagcagctcccgcctccagcaccgcgagcggcgatggcaatggacgcggccgtggccgtgaagagcggcggtggcggcgccggatcgaccggggtcaccgcgcccgcctcgcagtccccgcaggcggcgactaacggcggcgagcggcggtcccggttccagcgcatctgcgtgtactgcggcagcgccaaggggccggaagcctatctaccaggacgccgtcgtcgagctgggcaaggagctggtgggagaggggcatagacctgggtctacgggggcgggtttcatcgggcctcactggggctggggctccgcatggcaggtccatggacggaaggggcgcccatgttgattggggggaccaaaccccgaaaatcctttgaattgccccagaagagagtccc

SEQ ID NO: 68765 - protein, 75 aa, Zea mays
  misc_feature: Ceres CLONE 1545605
MAMDAAVAVKSGGGGAGSTGVTAPASQSPQAATNGGERRSRFQRICVYCGSAKGPEAYLPGRRRRAGQGAGGRGA

SEQ ID NO: 68766 - DNA, 700 bp, Zea mays
  misc_feature: Ceres CLONE 1545607
  misc_feature: Encodes the peptide sequence at SEQ ID NO. 68767
aaagctggagctccccgcggtggcggccgctcttccaactagtggatcccccgggctgcaggaatctcgtctcacccctagaaaaagtcgtccgctcctctcctctcccctacccgtctccttgtcgtccttgcctgcggattggggcggcacagcctctcgcttctcccgcgcgcgagccctttctccgcggccgcggcatgacgatgccggaggcgaatgcctctgcgacggcgcataggaagaagaactcaccagagatggagttcttcagcgagtacggcgatgccaacaggtacaagatccacgagatcattggcaaatggagctaccgggttgtctgttcggctatcgaccaacatacgggcgagaatgtagccctcaagaagatacagagcatgctcaaccccccgtccgatgctggctaggatcctccgcgagatcaagcttctccggttgctgaggaaccccagtttctcgagatcaaaacccgttatcctgcctccccccagggggggactccgcccctttttaccttggggtttaaccctgaggaaacccaatctttcgccattgtttccgggggaagagatgtctttgcctaaggaaacccccccctgtttctttccctcttgaaaagggcgggggcgcttgaaaaatttttccaacccgggccacccgttttaaccccccgagaatg

SEQ ID NO: 68767 - protein, 73 aa, Zea mays
  misc_feature: Ceres CLONE 1545607
  misc_feature: SWISSPROT Homolog: EC 2.7.11.24 Mitogen-activated protein kinase
MPEANASATAHRKKNSPEMEFFSEYGDANRYKIHEIIGKWSYRVVCSAIDQHTGENVALKKIQSMLNPPSDAG

SEQ ID NO: 68768 - DNA, 650 bp, Zea mays
  misc_feature: Ceres CLONE 1545613
  misc_feature: Encodes the peptide sequence at SEQ ID NO. 68769
  misc_feature (402)..(402): n is a, c, t, g, unknown, or other
ccccgcggtggcggccgctctattctagtggatcccccgggctgcaggaattcgtctcacccctagaaaaaaagattaatattattgatactccaggtcacgtggatttcaccattgaggttgaaagggcactccgtgttcttgatggagctatacttgtactatgtagtgttggtggagtacaaagtcaatcgataactgttgatcggcaaatgagaagatatgaaatccccagggttgcttttattaacaagttggaccgtatgggagctgatccatggaaggttcttaaccaggcgcgatccaagctccgtcaccacaatgcagctgtacaagtacccataagattaaaagaggagtttgagggccttgttaaccttgtagaaatgaaggcttatcacnccgagggatctagtggccataatgtaactgcttatgatgttccattgaatatggatgatttagtcactgagaagcgtcctgaacttattgaagttgtttctgaagtagatgaccagcttgctgaaccttttctcaatgatgagccaataacagctaatctgcttaatgcggctattcgaagagcaacagtggcacgaaagttcataccagtatacatgggaagtgcattcaaaaataagggtgttcag

SEQ ID NO: 68769 - protein, 216 aa, Zea mays
  misc_feature: Ceres CLONE 1545613
  misc_feature (4)..(216): Pfam Name: GTP_EFTU Pfam Description: Elongation factor Tu GTP binding domain
  misc_feature (134)..(134): Xaa is any aa, unknown, or other
PRWRPLYSSGSPGLQEFVSPLEKKINIIDTPGHVDFTIEVERALRVLDGAILVLCSVGGVQSQSITVDRQMRRYEIPRVAFINKLDRMGADPWKVLNQARSKLRHHNAAVQVPIRLKEEFEGLVNLVEMKAYHXEGSSGHNVTAYDVPLNMDDLVTEKRPELIEVVSEVDDQLAEPFLNDEPITANLLNAAIRRATVARKFIPVYMGSAFKNKGVQ

SEQ ID NO: 68770 - DNA, 751 bp, Zea mays
  misc_feature: Ceres CLONE 1545615
  misc_feature: Encodes the peptide sequence at SEQ ID NO. 68771
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttgttttttttttnnnttgcnccgtggtcttctctnttttttttnnnnnntaaagctggagctccccgcggtggcggccgctctagactagtggatcccccgggctgcaggaattcgtctcacccctagaaaaagtcttcatttccaggacgcgtcgaattcctccatctaccgcgccggccgccgaggcccgagggggaggaggatgctgggcgccgcgaggaggcagcttggatccggtcccatgctgggacaggttttgcgaaggctccgcccggcggcggcggctgaggtggcgaggggctactccgctgcggcgaaggaggtgaggggccgctttaccgaaacctaccgtttcatttaaccgtggaggcgaggaggttgcgtccgtattagatgttggcatgtaaattgtaatcgtgttatttttttatggactggcggctaaaatgtacattggggcccccccggtttaagcggtgagagacatgtggtttgcgagtttagtttattgtagtagatcgccctgaaacccacggaaaccgaggttgtttcaaaaaaaaattcacgcgcggttacgccctaaacgccttttcaataggatttaaattttattttttccccgggccccttccggagggtaccccactttttcccccctataagagggaagacccaaatttaatcagccgccctcctctgggcacgttctcttatttttaaatacgttccgtagtcccgggggaaaaaa

SEQ ID NO: 68771 - protein, 52 aa, Zea mays
  misc_feature: Ceres CLONE 1545615
MLGAARRQLGSGPMLGQVLRRLRPAAAAEVARGYSAAAKEVRGRFTETYRFI

SEQ ID NO: 68772 - DNA, 651 bp, Zea mays
  misc_feature: Ceres CLONE 1545616
  misc_feature: Encodes the peptide sequence at SEQ ID NO. 68773
ccccgcggtggcggccgctctataactagtggatcccccgggctgcaggaattcgtctcacccctagaaaaaacaccccaccctccctttgcctccacatccaccaccatccaatccgcgcgggtgcttcgccaccctatcccgattgctacctcctcgtggtgggcgccgctccgatccgcccgatccgcgctgctcctgaggctccggcgcgcggcggcgagcggcggaggcggcgcatgaatggaatccgaggacgatatgcacgacgcaaacgactccgccgaagatgacttctacagcggcggggaggctggtctcgccgccagcgacgacggagacgcagactacgacttctcggaccacgactccgacgactccgcggagctcctctcccacagacagcagcaaaattacagtatattgagtgaagttgatattctgcggcgccaagaggatgacataaatagggtttcaactgttcttatcatttccacaccagaggcatgtgttcttctccgcaactataactggagtgttaataaagtgcatgactaatgggttgctggacgaacaccttgtttcggaagggggttgggtttaccaaacaggaatattgaaaatgccaaaatgacctagaagtaacctttt

SEQ ID NO: 68773 - protein, 104 aa, Zea mays
  misc_feature: Ceres CLONE 1545616
MESEDDMHDANDSAEDDFYSGGEAGLAASDDGDADYDFSDHDSDDSAELLSHRQQQNYSILSEVDILRRQEDDINRVSTVLIISTPEACVLLRNYNWSVNKVHD

SEQ ID NO: 68774 - DNA, 662 bp, Zea mays
  misc_feature: Ceres CLONE 1545620
  misc_feature: Encodes the peptide sequence at SEQ ID NO. 68775
ctccccgcggtggcggccgctctagaactagtggatcccccgggctgcaggaattcgtctcacccctagaaaaaaccttgccatttatcagccccccgtgcgccgccgagcggacgagccgatccggagacgcatcagcacacgcggttagccgccctcaagctcgctcgacgctcgttcccctgacccgcgtccgccccgcgtcccgaaaattccccctctttttcctacttcccgtcccacggctcctacgccccgcgggcccaaaaccctagccggctaatccaatcctgcttcccgcccatggcctccgcggacgctgccaagcccgcgtccccgcccgccgcggatccgcccgtcgacgaccccatggacgccgaccccgcgccccacgcacgggaggaggagcaggccacgccgcacaagcagcagccggagaagaagcggggcggccggaggaagaatggcgaggcggcggagaagacgccgccgtcatccaagaagtcggcgggccccacggtggagcgcccgtccaggcagaggaagacggtcgagaggtacgcggggcttgcgccgcgcggcacacccgccaaaaagtcccccgctattctccagggttctgggaacgaaggtcaaggacatacccaatggttccatttaaa

SEQ ID NO: 68775 - protein, 119 aa, Zea mays
  misc_feature: Ceres CLONE 1545620
MASADAAKPASPPAADPPVDDPMDADPAPHAREEEQATPHKQQPEKKRGGRRKNGEAAEKTPPSSKKSAGPTVERPSRQRKTVERYAGLAPRGTPAKKSPAILQGSGNEGQGHTQWFHL

SEQ ID NO: 68776 - DNA, 2809 bp, Zea mays
  misc_feature: Ceres CLONE 1545621
  misc_feature: Encodes the peptide sequence at SEQ ID NO. 68777
gccagcatctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccgtacggtgctcaccggcgtgccggacaacgtgtcggcggcgcacgcggccggggcggggctcttcgacggggccttcgtcggcgcccacgccggcgaggccaagagccaccacgtcttcaccttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcagcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaaacacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggcgacggcgacggcgagcaggcgccgggcgggctgaagcgactggtggccgagaccaaggacgcgcacggcgtgaagcaggtgtacgtgtggcacgccatggccgggtactggggcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcgcagcttcccggacaacggctgcatctcctgcatgtgccacaactccgacatgctctacagcgccaggcagactgccgtcgtgcgcgcctccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggcaccgtgctacgcgcgcagcttcccggccggcccacacgggactgcctcttctccgacccggcgcgcgacggcgcgagtttgctcaagatttggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctggtgacggcggcgggtgggacggcgagaccgtggtgtatgcgcaccgcacgcgggagctagtgcgactgccccggggcgtcgcgctgcctgtgacgctaggcccgctccagtatgaggtgttccatgtgtgcccgctccgcgccgtcgtgccggggttctcgttcgcgcccgtcgggctgctcgatatgttcaacgctgggggcgccgttgaggagtgcgacgtgatcagcaatgtcggcggcaaggccatggctctcagggttcgcgggtgcggtcggttcggcgcttactgctcgcgggagccggcgaggtgtctattggactcggcggaagtggagttcagctacgatgccgacaccggcctcgtgtccgtcgacctgcccgtgccggagcaggagctatatcggtggacgctggagattatggtctaggccgtgacgctgtgcgctgacgccattctgagccggacgacattgtcatttgctatgtgcacgagagatagatgtattgtggtgttgttgtataattggtatggagagagtatgcttttgttatgtctgtatctgcataccctgcgtgctttgaatgttatataatacttgatagataataaaggatggtgttcctgaaaaaaaaaaaaaaaaaaaagaaaaaaaaaaaaaaaacgagac

SEQ ID NO: 68777 - protein, 756 aa, Zea mays
  misc_feature: Ceres CLONE 1545621
  misc_feature (7)..(740): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
MTVTPRITVSDGRLTVRGRTVLTGVPDNVSAAHAAGAGLFDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKHGLQSLSKGGAPPRFLIIDDGWQQIASENKPDPNVAVQEGAQFASRLTGIKENTKFQTKPDGDGDGEQAPGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVARSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGTVLRAQLPGRPTRDCLFSDPARDGASLLKIWNLNKCGGVVGVFNCQGAGWCRVTKRTRVHDASPGTLTGTVRADDVDAIARVAGDGGGWDGETVVYAHRTRELVRLPRGVALPVTLGPLQYEVFHVCPLRAVVPGFSFAPVGLLDMFNAGGAVEECDVISNVGGKAMALRVRGCGRFGAYCSREPARCLLDSAEVEFSYDADTGLVSVDLPVPEQELYRWTLEIMV

SEQ ID NO: 68778 - DNA, 662 bp, Zea mays
  misc_feature: Ceres CLONE 1545624
gcggtggcggccgctctagaactagtggatcccccgggctgcaggaattcgtctcacccctagaaaaaggttattgacattaacccgtctttggtcccggagggaaaaggacaaatcactcacacagagggaagaaaagggcacaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgaggttcagttgatgcagtggtgaaaacatcttctccaaaaactgctggctgcaagttgcaaaaatttgtctttcccttgttgtgttgttgcttccttctctggtggagtacacgggagaagtttgcagatacaggcagctcctttcaaatctcctatgtccagggatttggactgtcctgttcagacacagatggctgtggcagtcctggaccggagctttagcagcgaatatcctggaggtagcagaattgaggggaggcaactgagctggaagagagtatttgtccaaactgacaatggctctgtccttggcatccagctggag

SEQ ID NO: 68779 - DNA, 659 bp, Zea mays
  misc_feature: Ceres CLONE 1545629
  misc_feature: Encodes the peptide sequence at SEQ ID NO. 68780
ccccgcggtggcggccgctctagaactagtggatcccccgggctgcaggaattcgtctcacccctagaaaaaggattcagcttgcacctctccagtgagctagtcaccgccagtccacgccatggcttgtcgcgccactctcctgccgctcttcctcttcctcttcctcctcgtggcgcccgcgcctgcgctcgccacatccggcaccatcgtcttcaccacgctgggccggagccgctacgcctttgacgtcatcgcgctcccgatcgccccgctctccgccgcctccgcggagctgcgcctcacggacggcacctccgtcaactacaacggcaacttcgcgccctcctcctccggaccgccctccctcctcttcgtctccgagcgcaacggctagatcaacctctacatcactcccgtccccacatccgcctccgcccgacaccgcgacgcgctggaggaggaggacgtcacggcgccgcccacgccgctgctcccgtgggacaccatcgcgatcaatgaacggggcttcgatcacccccaacagcgcccacctggtgtacgtctccactgcggaagccgccgggggcgcccctcccggaactgggcaggacgttgtactccaccaacctgggccccggggggggacacggccccgc

SEQ ID NO: 68780 - protein, 91 aa, Zea mays
  misc_feature: Ceres CLONE 1545629
MACRATLLPLFLFLFLLVAPAPALATSGTIVFTTLGRSRYAFDVIALPIAPLSAASAELRLTDGTSVNYNGNFAPSSSGPPSLLFVSERNG

SEQ ID NO: 68781 - DNA, 762 bp, Zea mays
  misc_feature: Ceres CLONE 1545631
  misc_feature: Encodes the peptide sequence at SEQ ID NO. 68782
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
ttttttttttttttttttttttaatttaaaaaaannnncggctcttctttcaaagcgggagctccccgcggtggcggccgctctagactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggagcggaaggatgacggcatcggtttccagggccatcggcgtacagaagccgggctcaaaatgcaccggggacagggaagcgacctccttcgcccgccgatcgggcgcagcgccgaggcccccgcacgccaaagcggccggcgtcatccgctccgactccggcgcgggacggggccagcattgctcgccgctgaggggcgtcgttgacgccgcgccgatacagactaccaaaaagagggtgttccacttccggcaaggggaaggagcgaggggcaaccaagaccctgaaaagaacttgctggggcggccaggggcgaccaaacctgggcggaataatggccaaagcattcggggtttggtcgtgggccccccccaggggtttcaaaggggggtccaacgggaagggggtggccccacaaaaacccag

SEQ ID NO: 68782 - protein, 163 aa, Zea mays
  misc_feature: Ceres CLONE 1545631
  misc_feature: SWISSPROT Homolog: EC 2.7.9.1 Pyruvate, phosphate dikinase
MIVQPIELRAWTAFPGSAQEGSGRMTASVSRAIGVQKPGSKCTGDREATSFARRSGAAPRPPHAKAAGVIRSDSGAGRGQHCSPLRGVVDAAPIQTTKKRVFHFRQGEGARGNQDPEKNLLGRPGATKPGRNNGQSIRGLVVGPPQGFQRGVQREGGGPTKTQ

SEQ ID NO: 68783 - DNA, 1878 bp, Zea mays
  misc_feature: Ceres CLONE 1545632
  misc_feature: Encodes the peptide sequence at SEQ ID NO. 68784
ccctgccttcctttctcccactgtcccacagctacggcacggccacggcgccacacactcggtgggtggcgtctgctcgtgctcgaatacgcggcggcagcgaggacgtcggaacttgcagccatggacgcggcggcgacggccgtgtcgtcgagcggcgacgctcccgttctcctccttgccctcgccgtctccctgctcctcctcgcggcggccgtctggtcctcgaggcggcgtggtcaggggcacggcaacggcaacggcgcgccgagcccgccgtcgcggccgctgctgggccacctgcacctgctcggcaagccgctgcaccgctcgctggcggcgctggctgccgcgcacggcgcggggggccagctggcgccgctcctgtccctgcggctgggcgcgcggcgggcgctggtggtgtcggagcgcggcgtggccgaggagtgcttcaccgcgcacgacgccgcgctggcgggccggccgcgggtgctggccggcgaccggctcgggtacgggtacacgatgctggtgtgggcgtcccacggggaccactggcgcgcgctccgccggctcctggccgccgagatcttctcggcggcccgcgtggccgcgcgcgccgccgaccgccgctccgaggtcgccgcgctcgtcaccagcctggcggcgctccacctccactgcggcggcggcgcggtgagtctccgacccaggctcttcgagctggtgctcggcgtcatgctgcgggcgctcacgggagagcgcgcgcacggcggcgacgtgcgcacgttccagggcatcgtggaggagacgttcgccgtgagcggcgcgcccagcgtcggggacttcttcccggcgctgcggtgggtggaccgcctacgcggcgtcgacgcggcgctcgtgcgtcttcaggccaggcgcgacgcgttcgtcggcggcctcgtccaggaccaacggcggcgaaggcgcgacgccggtgatggccgaggccgacacgcggcggagaagcagagcatcgttgacgagctcctgtcgctgcaagaaactgatcccgagtactacacggacacgatcatcaaaggcgtcgtcttgatgctactcactgccggcaccgacacgtcggcgctgaccaccgagtgggcaatggcgctgctgctgacacacccggaagcaatgcggaaggctagagccgagatagagactagcgtcggcaccgcgcggctcgtggaggagtcggacatcgcgaacctcccgtacctccaatgcgtggtgaaggagaccctgcgcctgcgccccgtcgggccggtcatcccggcgcacgaggccatggaggactgcaccgttggcgggttccatgtcgaacgcggcacgatggtcctcgtgaacgcctgggcaatccaccaggatcccaagctctgggacgcgccagaggagttcaggccggagaggttcctggacgccgccggtacggtgaccgcggtcaccacgcccatgctgccgtttgggcttggacggcggcgctgccctggggaggggttggcgttgcgtctgattagcttgacgctggcggcgctcgttcagtgcttcgagtgggatgttggtgaaggcggtgtcgttgacatgaccgaaggcgttgggctgacaatgccgatggccatgcccttggctgctgtctgccggccccgggagtttgtcaagggcatgctctctacttgaagtcttgaacatgatgagttaaacaatggttttttttataaacaaaaacaaaaagttatgctatcagtatttgattgttcagtattctgtaatcagtatgctatcagcacyactaagaacaaaaaaatgtttatatgtatataaaaaaaaaaaaaaaaaaaa

SEQ ID NO: 68784 - protein, 530 aa, Zea mays
  misc_feature: Ceres CLONE 1545632
  misc_feature (49)..(515): Pfam Name: p450 Pfam Description: Cytochrome P450
  misc_feature: SWISSPROT Homolog: EC 1.14.13.89 Isoflavone 2'-hydroxylase
MDAAATAVSSSGDAPVLLLALAVSLLLLAAAVWSSRRRGQGHGNGNGAPSPPSRPLLGHLHLLGKPLHRSLAALAAAHGAGGQLAPLLSLRLGARRALVVSERGVAEECFTAHDAALAGRPRVLAGDRLGYGYTMLVWASHGDHWRALRRLLAAEIFSAARVAARAADRRSEVAALVTSLAALHLHCGGGAVSLRPRLFELVLGVMLRALTGERAHGGDVRTFQGIVEETFAVSGAPSVGDFFPALRWVDRLRGVDAALVRLQARRDAFVGGLVQDQRRRRRDAGDGRGRHAAEKQSIVDELLSLQETDPEYYTDTIIKGVVLMLLTAGTDTSALTTEWAMALLLTHPEAMRKARAEIETSVGTARLVEESDIANLPYLQCVVKETLRLRPVGPVIPAHEAMEDCTVGGFHVERGTMVLVNAWAIHQDPKLWDAPEEFRPERFLDAAGTVTAVTTPMLPFGLGRRRCPGEGLALRLISLTLAALVQCFEWDVGEGGVVDMTEGVGLTMPMAMPLAAVCRPREFVKGMLST

SEQ ID NO: 68785 - DNA, 680 bp, Zea mays
  misc_feature: Ceres CLONE 1545636
  misc_feature: Encodes the peptide sequence at SEQ ID NO. 68786
  misc_feature (474)..(474): n is a, c, t, g, unknown, or other
ggatcccccgggctgcaggaattcgtctcacccctagaaaaagagtctggagaggcgtcctcagcgacggaccgggccccagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagagaccgatagcgaacaagtaccgcgagggaaagatgataaggactttgaaaagagagtcaaagagtgcttgaaattgccccggagggaagcggatggggggctggccaacccgcaccgggccgtttgcggaacggcctcctgcttggtccccccaatcggttcggggggtgggaacccttgtcccccccgcctccggcggggaaaagccccggggggcccttaaggggtcccccggcatacctttngacagggtcggaacggtatccccccccgcctttttgggcgcccccccttggggcgcctgcccttacaacgcgcctgtgaaaattctccccattgaagacccgtttttgttaacaccggacaccagaggggatctcaaaaatctcccctcccaaaccccccggcggttctccaaaaaacccccggtaatcccgcccaaagggaaccg

SEQ ID NO: 68786 - protein, 99 aa, Zea mays
  misc_feature: Ceres CLONE 1545636
GSPGLQEFVSPLEKESGEASSATDRAPVLWKGTPGRVRAPSGPDPVAPRGAVNESGCLGMQPKSGGKLRPRLNTGERPIANKYREGKMIRTLKRESKSA

SEQ ID NO: 68787 - DNA, 647 bp, Zea mays
  misc_feature: Ceres CLONE 1545638
  misc_feature (647)..(647): n is a, c, t, g, unknown, or other
tcccccgggctgcaggaattcgtctcacccctagaaaaaaggcagccgacgacttccccacgcggaggcgttgcttcccggtcgtccaacgcctggcatcccttccttctcctcacccagcagcagccggtcggcctcggctagatctcgccggccgcctccaattggttgtccactgtggccgggccgaggggtacttatctataggcccgcagatctgcgcctgcgcccgtgggaatctccgcacctcgctatccgtctcttggatagatcgatcttccgtcgctggttccccttcgccccacacgagtacttccaaggaactgggaacttccagccggcacggggattcgagcttctgctctatcagcaactccactgggcgctgaggggtctgtagcatagcggtgcgatcggggcagaggggagccatgatgagggggcatgcgtggcttgcgctgctggtcgtggtggcgctggccttggcggacccggcggcaggggaggtttcctggtggaaaaaaaccacccttcaaggtgaccttcccccgaacaaacttcaggggcaagtaccaagtggcgcccatccggaaacttccggggtggccgcaaattacggggcgcaccccttgcaccggatggggttn

SEQ ID NO: 68788 - DNA, 728 bp, Zea mays
  misc_feature: Ceres CLONE 1545643
  misc_feature: Encodes the peptide sequence at SEQ ID NO. 68789
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
ccccccccccnnngggaggcggcgcccgcccccaaaaaaaatccctnnntnccaaactggggctccccgcggtggcggccgctctatactagtggatcccccgggctgcaggaattcgtctcacccctagaaacgataagatctccgagaaccgcgccgactacaacatctagcacacgcccgcgccggcctgggccgcttgctcctcctccgccaccaccctcgctgcctgggacgatctagaggagtacacggtcggcctggacaagtacagcgacatgcttaaggagcagctcctcgacgactccgtccccgcgcgcgcgctcgtggccatcgccggcgagagcagcattggcaagacgacgctcgcgcggaaggtgtaccagagcctcgaggtccgcaaccacttcgagatccgcacgtggacggtgctcccgcacaagtgccgcgccgccgacgttctcccccacatccacgagcagatgacctcccagctgcggcggaccccgtccgcgtccaactccaagcaggccgtggaagacgcctgcgatgacaaagccttctggccgggaaaggacatcagcaaccagctgtacaggagcatgacgggggaggcgggacctccgtggtcatcgaccggcagcgttgccggtcacgggactgggaaccggcctaccgagctttcccttcccccgacgagggggcaacggggcagcaggggtggcttt

SEQ ID NO: 68789 - protein, 150 aa, Zea mays
  misc_feature: Ceres CLONE 1545643
MLKEQLLDDSVPARALVAIAGESSIGKTTLARKVYQSLEVRNHFEIRTWTVLPHKCRAADVLPHIHEQMTSQLRRTPSASNSKQAVEDACDDKAFWPGKDISNQLYRSMTGEAGPPWSSTGSVAGHGTGNRPTELSLPPTRGQRGSRGGF

SEQ ID NO: 68790 - DNA, 659 bp, Zea mays
  misc_feature: Ceres CLONE 1545645
  misc_feature: Encodes the peptide sequence at SEQ ID NO. 68791
tccccgcggtggcggccgctctagaactagtggatcccccgggctgcaggaattcgtctcacccctagaaaaaaccgtcgcattctgcagcgccagctcgctcctcgccccgcccccttctctcagcggcgacgcctcgggcgttcctaccctgccccctctccggaccccccacgccgtcggcgaagcagccgggcaagagcccgatccagaccccgcgagcaatccttgatatacctgatggctatgattgatgagcctctgtacccaattgctgtactgattgatgagcttaagaatgaggacatccagttgcgtctaaactccattagaagactttcgacaattgcacgggctcttggagaagaaagaaccaggaaggagctgattccctttcttagtgaaaacaatgacgatgaagatgaggtgcttcttgcaatggctgaggaattgggtgtgttcattccttatgttgggggtgtagaacatgctcatgttttgcttccccctttggaaacattgtgtacagtagaagaaacttgtgtccgtgataaggcagttgaatctctgtgccgtattggtgcacaaatgaaggaaactgacatagtcgactggttcattccagtagtaaagaggctagcagctggtgagtggtttac

SEQ ID NO: 68791 - protein, 139 aa, Zea mays
  misc_feature: Ceres CLONE 1545645
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWF

SEQ ID NO: 68792 - DNA, 647 bp, Zea mays
  misc_feature: Ceres CLONE 1545647
  misc_feature: Encodes the peptide sequence at SEQ ID NO. 68793
acccgcggtggcggccgctctataactagtggatcccccgggctgcaggaattcgtctcacccctagaaaaaatctcccattctctttcatatttgcatgcatctcggttctcggatctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgattaccaggactacaccccctgcaccgaccccaagcgctggcggaggtacggcaactaccgcctgagcttcatggagcggcactgcccgccgccgcccgaccggcagcagtgcctggtgccgccgcccaaggggtacaagccgcccatccggtggcccaagagcaaggaccagtgctggtaccggaacgtcccctacgact

SEQ ID NO: 68793 - protein, 161 aa, Zea mays
  misc_feature: Ceres CLONE 1545647
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPKGYKPPIRWPKSKDQCWYRNVPYD

SEQ ID NO: 68794 - DNA, 658 bp, Zea mays
  misc_feature: Ceres CLONE 1545651
  misc_feature: Encodes the peptide sequence at SEQ ID NO. 68795
ccccgcggtggcggccgctctagaactagtggatcccccgggctgcaggaattcgtctcacccctagaaaaaacttacctggacggggtcgacgtgggatcaagaagccccgtggcctagatcagtggcctgcattgcacttggctggtgcgctggtctaccatctccgcaagtgggagagtggacgtcataatttgtggcagagggggtacgcgaccacctcactcttcactagcctctgctcctctgaaatggcggcggcgacttcctcgtccacctacctcgccatcggccgcaaaaccctaagccccgccccctccgtagccacagccgccgcctccgtctccttccccgccacgcagcacccatgcgtcgtcgccgcctccgcggaccggcgccgcgccgtggctgcgaaggtctcgtcgccgtcggtcatcggcaccgccatgccgtcgctcgacttcgagacctccgtcttcaagaaggaaaaggtgtccctggccggccatgaagagtatattgtgaggggttgggagggatctgttcccgctggttaccggaggccttcaaggaatcaaaccagatcggtggtatccggctgggggctccccaaggcccctgcccaacctcagaccttgaaaaactccccttgtttaaa

SEQ ID NO: 68795 - protein, 70 aa, Zea mays
  misc_feature: Ceres CLONE 1545651
  misc_feature: SWISSPROT Homolog: EC 1.1.1.86 Ketol-acid reductoisomerase
MPSLDFETSVFKKEKVSLAGHEEYIVRGWEGSVPAGYRRPSRNQTRSVVSGWGLPKAPAQPQTLKNSPCL

SEQ ID NO: 68796 - DNA, 640 bp, Zea mays
  misc_feature: Ceres CLONE 1545654
  misc_feature: Encodes the peptide sequence at SEQ ID NO. 68797
ggcggccgctctagaactagtggatcccccgggctgcaggaattcgtctcacccctagaaaaattctacccaaattccccactccacgccgccgccgccgccgccatgggaagaaaagacagctcgtcctcctccgcggccaccggcggcgggaaaaaggagaaacctatgtcggtgtccgccatgctcgcctccatggacactcccgcggccaaggccaagccttccaaggccaaggccaaggcctccaaggcgccggcgtcctcctacatgggcgacatcgacctgcccccctccgacgacgaggacgaggaggaggcccggctcgccgccgccgccaagcccaagccggcccgcgccgccgtcgtcgatctcagcgccggcgccgcgccgtcgcacaaggacgccaagaagaaggacaagcgcgaggccgtggcggccgcggccgccgaggccgccaggcaggaggcgctccgggacgaccgcgacgccttctccgtcgtgatcggcgcgcgcgtcccgggctcctccgccgacgacggcgccgtcgacgacaacgtcagggacgtcgtgctcgagaacttctccgtctccgcgcgcggcaaggagctgctcaagggcgcctcccctccggatctcg

SEQ ID NO: 68797 - protein, 178 aa, Zea mays
  misc_feature: Ceres CLONE 1545654
MGRKDSSSSSAATGGGKKEKPMSVSAMLASMDTPAAKAKPSKAKAKASKAPASSYMGDIDLPPSDDEDEEEARLAAAAKPKPARAAVVDLSAGAAPSHKDAKKKDKREAVAAAAAEAARQEALRDDRDAFSVVIGARVPGSSADDGAVDDNVRDVVLENFSVSARGKELLKGASPPDL

SEQ ID NO: 68798 - DNA, 590 bp, Zea mays
  misc_feature: Ceres CLONE 1545656
  misc_feature: Encodes the peptide sequence at SEQ ID NO. 68799
ggatcccccgggctgcaggaattcgtctcacccctagaaaaaaaggccgatccccgccccaaaccccaaaccctcgtcgccgcccggcggccgtcgcccaagcgcacccgcggaagatgtcgctgtcgaagccggtctcggcacgccgcctcgtgccggcgctcttcccgctcgcgcacgcggacgccgcctgcggccacggcttcccgccgcgagcgccgtagggacacgttcgtcgcgacgcccccgatccccagcgccttccccgcgggcagtgcgcctcgcggagccgctccccacgctggcgccgtcacgcctcgcgttccacaaccggatcctcgggctcctgtcggggccccaggccgacctccccgaggcggtgctcctcacccgccacgcgctccactccaactgccgcccctcgtccttcacctgcgccgccgtcctcggcgggctcctccggggcgcgccgccctcaaaaattctttcgcgctggaccgcttccgcgctccaaggcggccgttcccggcctaccggccgccagggcacgtgctctaacttatcccgggctcgcgggggggggcggttta

SEQ ID NO: 68799 - protein, 35 aa, Zea mays
  misc_feature: Ceres CLONE 1545656
MSLSKPVSARRLVPALFPLAHADAACGHGFPPRAP

SEQ ID NO: 68800 - DNA, 638 bp, Zea mays
  misc_feature: Ceres CLONE 1545661
  misc_feature: Encodes the peptide sequence at SEQ ID NO. 68801
gcggtggcggccgctctataactagtggatcccccgggctgcaggaattcgtctcacccctagaaaaaaagtcgtcgcctcggctcggcccccgcttcgctcctctcggcgcgacgacctctgcccccatcctccccctttctcaatccccgcgcgacgaggccgcttcatggcgagtcggggctggcctcggccggactcgctccaggccctcgctgccgcctccatcgccatccttctcctggccgccgcgtctggggctgccgctggatcccccgatcggcccgtgccgcggccgccgctgttcctcccgctcacgcgctcgtaccccaacgccagccggctcgctgcctcgttgcggcgcggcctcggcgacggggcgcaccccaacgcgcgcatgcgcctccacgacgatctccctcaccacgggtactacacgacgaggctctacatcgggaactcccccgccagaagtccgcgctgatcggtgactccggggagcactgtcaacctactgccctggggcctcctgggagcagtgggggaacccccagaatccccgattgccacccggtttccccccgtccaatttcccacgaaaatgcaacgttaatttgactttgggaaaggaaaaaaaa

SEQ ID NO: 68801 - protein, 104 aa, Zea mays
  misc_feature: Ceres CLONE 1545661
MASRGWPRPDSLQALAAASIAILLLAAASGAAAGSPDRPVPRPPLFLPLTRSYPNASRLAASLRRGLGDGAHPNARMRLHDDLPHHGYYTTRLYIGNSPARSPR

SEQ ID NO: 68802 - DNA, 667 bp, Zea mays
  misc_feature: Ceres CLONE 1545662
  misc_feature: Translation starting site: 374
  misc_feature (404)..(404): n is a, c, t, g, unknown, or other
gcggtggcggccgctctagaactagtggatcccccgggctgcaggaattcgtctcacccctagaaaaactagaaaaagagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctaggggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcnggctcagcaacaacctgctggggtggatcctcctggggggtcttcggcctcatctgggccctctacaccatctacacctctgacctcgacgaggacgaggagtccggtggcctctcgctctagatccaccctctcctgttaatgatctgaatgtaaccatggtggcggtcatcggtgtaaattttagaccttggctatttgcatcttaagatccatcctccccgggtaaaaaaggtttggaaaccacctacccccggaaacag

SEQ ID NO: 68803 - DNA, 855 bp, Zea mays
  misc_feature: Ceres CLONE 1545665-R
ccgattgggtacctcgagcgtctcgttatatttttttttgttgccagaaagatccactagttctagggcgggcgccatgttgaattagctcccgcttttgttccataaataaaaacttaattaccccttactaacaccatccatcttcagatgcaaacagcgtcatcttgggggagtgcgataaaacccccgggagggagtactgctcactttacagcacaaagatacacaaaccccctttccccaactaaacaaaaacccccccctgtaaatccggatttttaaggcacttacttgcctgtaactttccccaaatcaatcaaaaaatctttgaccttcagttctgctttcccgcttttcccaaccggggatcggagggaatccggctttggcactggggttgctaaaacacaatcaagctcaccccgacatcaggttcagcccctccactccgggaactggtccgccggccgcgtgttctgaaacccggccttgatcgggcacggcgcgtacaccgggggccccatgcagttttacttcaggcaaacccaaacggtggaggggagcgacaattacggccatttcccgatgcccctcagaaatttgggctaaaggaacaacaccttcgggccccccggaccccccatgtccctgcaccagccgggggggggaccccccccggtgaaaaccggttttttttaagtaacaagttgcccaaaccccccccaagaagtggggaaaaaacttggcccccaaaaacctgtggtgtagcccaagggcccccccacccgggaattcttcccccgccttttcaaaagggtgggcacaccgcccccttaaaaaaaaaattttccc

SEQ ID NO: 68804 - DNA, 657 bp, Zea mays
  misc_feature: Ceres CLONE 1545665
  misc_feature: Encodes the peptide sequence at SEQ ID NO. 68805
  misc_feature (657)..(657): n is a, c, t, g, unknown, or other
gcggtggcggccgctctataactagtggatcccccgggctgcaggaattcgtctcacccctagaaaaaagtggtcgagctcgcggcggagcagagaccagagagtgagagcgagcagagcaaccaaagcgtaggcgatctcaacgcgaagcggaattgattgcgcccaccaccacgtcttctccccctccgtccgacccgtcctcaagtcaccaggccaccatcattgccgccatcccgccgcccggccgcgggagcccagctacgcattcataactgtttctctcttggcttctcggcgaagtgttgcggttgcgggtactggagtgcggagagcagcgcggcgcgagggaggaagccaccacccaccaccacctccattaaaggcgctcacgcgccgcctccgcctccacgagagagctaggcgagaggggcgtacgagacctcagctggctcctgtcgtcaaggacatcgatctctcccctcctcacttcctcccctcacggggggcagcacgtacaagggcaggcagctcgccaacgcccaagaccctgtggccgtgccacccaaggggggtggcctttaaaaaaaagcgcaccaaaaggttttaaggggtccaaaggcggcccttttgcctttgttttgggccccacaaccn

SEQ ID NO: 68805 - protein, 34 aa, Zea mays
  misc_feature: Ceres CLONE 1545665
GGGRSITSGSPGLQEFVSPLEKSGRARGGAETRE

SEQ ID NO: 68806 - DNA, 589 bp, Zea mays
  misc_feature: Ceres CLONE 1545667
  misc_feature: Encodes the peptide sequence at SEQ ID NO. 68807
  misc_feature (485)..(485): n is a, c, t, g, unknown, or other
  misc_feature (559)..(559): n is a, c, t, g, unknown, or other
tccccgcggtggcggccgctctatactagtggatcccccgggctgcaggaattcgtctcacccctagaaaaaagtggtcgagctcgcggcggagcagagaccagagagtgagagcgagcagagcaaccaaagcgtaggcgatctcaacgcgaagcggaattgattgcgcccaccaccacgtcttctccccctccgtccgacccgtcctcaagtcaccaggccaccatcattgccgccatcccgccgcccggccgcgggagcccagctacgcattcataactgtttctctcttggcttctcggcgaagtgttgcggttgcgggtactggagtgcggagagcagcgcggcgcgagggaggaagccaccacccaccaccacctccattaaaggcgctcacgcgccgcctccgcctccacgagagagctaggcgagaggggcgtacgagacctcagctggctcctgtcgtcaaggacatcgatctctcncctcctcacttcctcccctcacgggggcagcccacgtaaaagggcaggggcagctcggcaacgcccaagaaccnttttggccgggcaacccaagggcgtggggc

SEQ ID NO: 68807 - protein, 36 aa, Zea mays
  misc_feature: Ceres CLONE 1545667
SPRWRPLYTSGSPGLQEFVSPLEKSGRARGGAETRE

SEQ ID NO: 68808 - DNA, 636 bp, Zea mays
  misc_feature: Ceres CLONE 1545671
  misc_feature: Encodes the peptide sequence at SEQ ID NO. 68809
cgctctagaactagtggatcccccgggctgcaggaattcgtctcacccctagaaaaaacccactcgacatttttgaacccaaacccctcacttccccttccctcgacctccccgaacccgaactcctctcaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtcttctcgcgcgtcctcagcgcctacccggacccaccgctcgaggctgtctggttcttctccgcgctctccttccacgaccgtcgcgacgacctccgctccctgctccagatcctctccgccttcaccagctcctcggccgagaccgcaatgcgcttgcccttctcgccactgtcgtttccgagctcttccacgccgactagccgcgcacggagaccgagaccctcgttgagggcgtcctcagctacatcagcatctgcagtaaccgctctg

SEQ ID NO: 68809 - protein, 144 aa, Zea mays
  misc_feature: Ceres CLONE 1545671
MAAGSIVVDFPSMGAALCFPSLDSLLRDSASGFLAAVSNAPAPGAADLTNFHRVFSRVLSAYPDPPLEAVWFFSALSFHDRRDDLRSLLQILSAFTSSSAETAMRLPFSPLSFPSSSTPTSRARRPRPSLRASSATSASAVTAL

SEQ ID NO: 68810 - DNA, 766 bp, Zea mays
  misc_feature: Ceres CLONE 1545675
  misc_feature (42)..(42): n is a, c, t, g, unknown, or other
tgaatcataagaatcgaacatgcaggccggtgcagagtctantacacgtccctggcccacactcgaactccccgcggtggcggccgctctatactagtggatcccccgggctgcaggaattcgtctcacccctagaaaaaagtaaccttgggggcatcagatgcttgcactggattgacaggagcagagaggattgagtgccaggcaagatcagtgctgcaacatggaaagttgaaattccgatgactttggagactcattgatgaagaccaaattattgagttttatatgcactcgggtcacatgacaaattcttgataccatgtatctgtatatggtggggtggctgatgttattggaccacctaatttgctgtactggtagaggcaaatctaatagttagggttgagcttgtggaaacgggtatactggggtaggcccatattgttcttttaccttggtgtgagaaaaacatcatggcggttgtaatttctaccaggacatattgagattgggccgcccttgagaccctcgccccagtttaatgcgaaaccatgctacccttgaagtaccgtttaagaccatcagctactcctatcacgcagcgtggcctaaaagaacgaataaacggagatatcctccaaacgttaccccaaatctcacccccttttacgctgaatccccccaatcgacctacccgagctctctaccgggtcacctacccttttttctcatatagatttcttttgcaactctgcggaaccaa

SEQ ID NO: 68811 - DNA, 536 bp, Zea mays
  misc_feature: Ceres CLONE 1545682
  misc_feature (77)..(77): n is a, c, t, g, unknown, or other
  misc_feature (209)..(209): n is a, c, t, g, unknown, or other
  misc_feature (210)..(210): n is a, c, t, g, unknown, or other
  misc_feature (253)..(253): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
tctgaactagtggatcccccgggctgcaggaattcgtctcacccctagaaaaatgtgaccccaagttcgcgaagctntgaaatcttgatgcgctcgttgcgcatgtatatttgcacctttggttattaatcactagaggtagatgattgaaactaatctgcttaaccaatgtgcactgctgggcgctggcgtggttagctatatcagtnntaggcagttcgacagaggtcaaagagattgagattttgtcttncnnntgcatgtcacagcttttgtgaatctgggtctcatcataactggccgcctagtttatcccatgatccatggtggaatcatcatagcaacctggggtggagggacctttgcttttgccctaaaaataaacacttcccgttttggggaaaaaaaaaaaaaaaaaaaaaccctcgggggccccaatttcccccaaaaggaaccgatttacccccccccccgggccccctttttaaaaccccgggaatgggaaaaacccgggggttcccccaatttataccccc

SEQ ID NO: 68812 - DNA, 640 bp, Zea mays
  misc_feature: Ceres CLONE 1545691
  misc_feature: Encodes the peptide sequence at SEQ ID NO. 68813
ccccgcggtggcggccgctctataactagtggatcccccgggctgcaggaattcgtctcacccctagaaaaaatacctttctcggccttttggctaagatcaagtgtagtatctgttcttatcagtttaatatctgatatgtggaccatgtgttcacttcgatattaaatttattttttgtgggggagggctcactacagtagcttgctactggggtcctcacgtgtcgcttgggcgttgcactatagctcaagcctggcgcaccccaacgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttcca

SEQ ID NO: 68813 - protein, 55 aa, Zea mays
  misc_feature: Ceres CLONE 1545691
PRGGGRSITSGSPGLQEFVSPLEKIPFSAFWLRSSVVSVLISLISDMWTMCSLRY

SEQ ID NO: 68814 - DNA, 614 bp, Zea mays
  misc_feature: Ceres CLONE 1545696
  misc_feature: SWISSPROT Homolog: EC 3.2.1.23 Beta-galactosidase
ggcggccgctctagaactagtggatcccccgggctgcaggaattcgtctcacccctagaaaaatacatccacttcttagcacatttgcctgtctgcccctttccataaaatttccctctgtatgtgagagtgcaaaacaatctctgtaaccatggagtattgaattgacctgattgtgtgctttcagatattcctgtgatcctcttttcatgtatgcattcgatttgctcacatatgtataaaaggtgtattatcttaagaaaagctgatttatctaaaatgtaatttatcgacatatttatatgtattttgttgcagataatttgaatagtatgatcaaaggtgagtatttggggtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaa

SEQ ID NO: 68815 - DNA, 657 bp, Zea mays
  misc_feature: Ceres CLONE 1545700
  misc_feature: Encodes the peptide sequence at SEQ ID NO. 68816
  misc_feature (454)..(454): n is a, c, t, g, unknown, or other
ctccccgcggtggcggccgctctagaactagtggatcccccgggctgcaggaattcgtctcacccctagaaaaaacaaccgtagcctgtagcttcatccgttgcgctgctcccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacngcgaagaagtgacggaagactgcgtggcgttctggaaggccgccgggctgtacacggacgccgagggcgtcgccgtggagaagttcagggaggtgttcaagccagagactttcgcgccggggcgcttccatcctctttaaggaatcggccggcggaatcctcacggtcccctcctccaaggactcctcggtgccagcgggccg

SEQ ID NO: 68816 - protein, 150 aa, Zea mays
  misc_feature: Ceres CLONE 1545700
  misc_feature (1)..(151): Pfam Name: Chalcone Pfam Description: Chalcone-flavanone isomerase
  misc_feature: SWISSPROT Homolog: EC 5.5.1.6 Chalcone isomerase
  misc_feature (105)..(105): Xaa is any aa, unknown, or other
MAVPEVVVDGVVFPPVARPPGSAGSHFLGGAGVRGLEIGGNFIKFTAIGVYLEDAAVPALAKKWGGKTADELASDAAFFRDVVTGDFEKFTRVTMILPLTGEQYXEEVTEDCVAFWKAAGLYTDAEGVAVEKFREVFKPETFAPGRFHPL

SEQ ID NO: 68817 - DNA, 803 bp, Zea mays
  misc_feature: Ceres CLONE 1545707
ggcccccgccccttccctcccccgagaccgtgtctcaaactcccccttgcaacgccggactccccgcggtggcggccgctttacactagtggatcccccgggctgcaggaattcgtctcacccctagaaaaatcgctcatcacggatgaatcttttttcccctccatttcttttcagcgtcccgaaaaatggtagtcgttgatccgaaagccgttcgcctcggcgcaccagttcaccgtggtaatcgacggcgtcaagacgaccttccacaagggcgtgctccggcgcaacggcggcacggtggccgtggtcggcccgggcgtcctcgaggtgagccgtctccatcacgtggtggtgcgcggcgggggcgggggcgacgtgcgcttctcccggtgcctgtacgcggccgcccgagactgcggggcggcgtccttccaccgagtgcgatgcggggccccccccaagggcgaccgcgccgtggacgatgccccgctacctcctcggccgacttggaagcgccgcgggctcccatgaccccccctcccccttgcaagggtgtccaaggcccttccgccagcgtcatggtaaatttcttctttggcccccgctgctctgttagagcccaaccctcgggggagcttcggccggaacctcccccctttgacccattttgtaattttgccctcggtttctccacatactgtgcggcgcgtatcccaccctggtccccttctgaaccgtggcgaggagattccccccccacgcaaatactttcccgatttagtagacctctctacttggag

SEQ ID NO: 68818 - DNA, 605 bp, Zea mays
  misc_feature: Ceres CLONE 1545709
  misc_feature: Encodes the peptide sequence at SEQ ID NO. 68819
gctctagaactagtggatcccccgggctgcaggaattcgtctcacccctagaaaaactagaaaaaagtttacagagccaaggagatgcttggcacgttcagcccccagccggagccctacacgtacgtgacgccggaggacaccaccccgtcgggaatgttcgcccgggggtcctactccgccaggacgaagttcctcgacgacgaccggaagtgctacctggagatcaactacgccttcgacatccgccgggagtggccgtcggcgagctgaccgatcggccttcgccggggcgccggagcagatcgataatcgtttcgctgctctgtgtcttcgcttctctgtgttggctcgtcttgtcctgtcctgttctatgcctaggtttcgttcaccatgttgctgcgcgcgcgcgcgtgtgtgtgtgaatacacccccgttccacgtgacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccag

SEQ ID NO: 68819 - protein, 62 aa, Zea mays
  misc_feature: Ceres CLONE 1545709
MLGTFSPQPEPYTYVTPEDTTPSGMFARGSYSARTKFLDDDRKCYLEINYAFDIRREWPSAS

SEQ ID NO: 68820 - DNA, 749 bp, Zea mays
  misc_feature: Ceres CLONE 1545710
  misc_feature: Encodes the peptide sequence at SEQ ID NO. 68821
ccgcctctacgatgcgcccacacccccctctatatttcttctcccccccaaattggagctccccgcgggggcggccgctctacactagtggatcccccgggctgcaggaattcgtctcacccctagaaaagcgtcaagcagaccaaacccgcccggcctggttgtggtcgaggaggagactggactggaggaggacgggatagcagacgagaggagaggacgcgcacgccatgtcaggtccaccgccaaagccttgggagcgatctggaactgaaggaacttcaggtccagcacctttcaagcccccatctggtggaagcaccagtgatgttgttgaagcctctggtaccgctaaacccagcgaaaatgttactgcgatggaggggaatgccgctcccaatgtaaatagcactatttcaaggcctatgccacagcggccttggcagcagacacgcccccggaaacacctatggagggtatggtggatccaacatgtatagttcatatggcggatttggcaacacttatggtaccggtggactcggaaatagcatgtactcgagttaccgaggaggttatggtggtggcatgtacggtggtggcatgtatggaggcggcatgtttggtgggatgggaggttattgttggttatggcatgggccggtaatggcctcggtactcgaactgcgaatcccgcctcccaccccattataataatttctgatgaaccacaaccacatacagctcct

SEQ ID NO: 68821 - protein, 89 aa, Zea mays
  misc_feature: Ceres CLONE 1545710
MSGPPPKPWERSGTEGTSGPAPFKPPSGGSTSDVVEASGTAKPSENVTAMEGNAAPNVNSTISRPMPQRPWQQTRPRKHLWRVWWIQHV

SEQ ID NO: 68822 - DNA, 735 bp, Zea mays
  misc_feature: Ceres CLONE 1545714
  misc_feature: Encodes the peptide sequence at SEQ ID NO. 68823
taaccgtatcttactccaccctcaatacggggacattttcgacactcacaatactacaaaactggagctccaccgcggtggcggccgctctagaactagtggatcccccgggctgcaggagttcgtctcacccctagaaaaatctctcccaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcgcagactgagattgataacttcatggttcaacaacttgatgggaccaaaaatgagtggggatggtgcaagccaaagccttggtgctaatgcgattctggctgtgtcattagctgtttgcaaagctggggctagcatcaagaggattcctttataccagcaccattgcccaccttacctggtgaaacaagcagttaaggggttgcctggtcccctgcaattcagatgccgttcaaacgggtgcgttcccccatgacttggcaaaccaaggccctggcctagtg

SEQ ID NO: 68823 - protein, 114 aa, Zea mays
  misc_feature: Ceres CLONE 1545714
  misc_feature (4)..(108): Pfam Name: Enolase_N Pfam Description: Enolase, N-terminal domain
  misc_feature: SWISSPROT Homolog: EC 4.2.1.11 Phosphopyruvate hydratase
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKPKPWC

SEQ ID NO: 68824 - DNA, 521 bp, Zea mays
  misc_feature: Ceres CLONE 1545717
  misc_feature: Encodes the peptide sequence at SEQ ID NO. 68825
  misc_feature (190)..(190): n is a, c, t, g, unknown, or other
  misc_feature (192)..(192): n is a, c, t, g, unknown, or other
  misc_feature (193)..(193): n is a, c, t, g, unknown, or other
  misc_feature (201)..(201): n is a, c, t, g, unknown, or other
  misc_feature (205)..(205): n is a, c, t, g, unknown, or other
  misc_feature (208)..(208): n is a, c, t, g, unknown, or other
  misc_feature (209)..(209): n is a, c, t, g, unknown, or other
  misc_feature (223)..(223): n is a, c, t, g, unknown, or other
  misc_feature (425)..(425): n is a, c, t, g, unknown, or other
  misc_feature (426)..(426): n is a, c, t, g, unknown, or other
  misc_feature (429)..(429): n is a, c, t, g, unknown, or other
cgctctgtatagtggtcccccgggctgcaggattcgtctcacccctagaaaacttccatgaacataacgtgctgcgcgaaccagacgcagacggcgcagcgcaagtcgtatttcggggacgacctctccgccgtcagggttcagttgaaagagggtgaagcgagctcgacacggggcgtcggtttcgcgntnncgtcgggnagcnganngagaagcgcgcgcncaccaactctccgggggggttcatcccccttcggggccgcctgccccggatttcctcaagggtttcaaagggaccttcaaaacgggccccggaggacggggggggttcaaaaaaggggtgggccccaataaattcccccctctttttccgggggggggggggttgaaaatttttgggggaaaaaaaaaaaaaaacaattttnnttntcggggggcctcctcccaccccccgtgttgtttttgggaaaaaaaaaaaaaaaaaaaaggaaggggggggggggggcctccccctccttttt

SEQ ID NO: 68825 - protein, 98 aa, Zea mays
  misc_feature: Ceres CLONE 1545717
  misc_feature (45)..(45): Xaa is any aa, unknown, or other
  misc_feature (46)..(46): Xaa is any aa, unknown, or other
  misc_feature (50)..(50): Xaa is any aa, unknown, or other
  misc_feature (51)..(51): Xaa is any aa, unknown, or other
  misc_feature (56)..(56): Xaa is any aa, unknown, or other
MNITCCANQTQTAQRKSYFGDDLSAVRVQLKEGEASSTRGVGFAXXSGSXXRSARXPTLRGGSSPFGAACPGFPQGFQRDLQNGPRRTGGVQKRGGPQ

SEQ ID NO: 68826 - DNA, 881 bp, Zea mays
  misc_feature: Ceres CLONE 1545720
  misc_feature (881)..(881): n is a, c, t, g, unknown, or other
gcaactgtatccaaccgcctctccccccggtttgattctatcctcgtcctccgccctaaaaccgtcctccccccggtggcggccgctctataactagtggatcccccgggctgcacgaattcgtctcacccctagaaaaagctcgtcgctcccaagtcccaccaagctgtcccccgaccactccgccgcccgctccaatggcggcgccggccagctcctcatgcttccacccacgcgcgaccgccagcccgccgtcttctctcagcgcaagaacccaggtcttcgtcacgctctggacccaaaccaagccccgtccatcagacacggtcagcctaaaatgccaacgctgtggcctccccactgccggtcaaattcgacccctcccctcccatgtttttccaaaccctatttcccacccttagccctcttaatttacatagaggtggcgcccacgtctcctccacacttttttatgtcctagaaggaagagcgggggcccccccgcacagcgttcggggtggccccccccacagcactccacacaggcccttggtgggcgcgttaacccgaaattatatacacaatctcacctattgtgggccccccacccctttcggtatcacatttgtgttcacacattttgttgttgtgtctgtgaccggcttagaccttcctttaccatcacgaccccgccccgcccatcatgtcagcacaaagtggtgatacatgccgctcatcctattttgatccggctcgttcggccatctcaccatcgtttatcgtcccactatgtatcatagaaacctatcccatgaacgtacctaacaacacaattgacaatgaagtgtgttgcacattaaacaaaaacaatatagctgatn

SEQ ID NO: 68827 - DNA, 724 bp, Zea mays
  misc_feature: Ceres CLONE 1545721
  misc_feature: Encodes the peptide sequence at SEQ ID NO. 68828
ccccgcggtggcggccgctctagaactagtggatcccccgggctgcaggaattcgtctcacccctagaaaaataccgcgtggattgattaccaacgttgatttggcgaggcaatcgcgggggatggaggggttcgatcgctgcgccgccgattctcccggtccttaggttcattgtgaagttgaggtgggtggtataagcatcgaagagagcatgagcactgccagtggtacaaggcgtgcaccaagaagacagtcgcaagatgggtctgctgataaagtagtggtgatcatcgaagcaacctccccggtggtggggagccgtcgtggaccaccgacccctgttcctggcgcccaaaactccccccttgatgtggaggccatcgaagatgaagttctccccccctcctcccttcgtgagtgccccctccgaaggaggggacaggaaaaccccggaagggaaccttaaaacagtggttgaacttggaaggttgacccctgcccagaaagggaaacaaccccccgaaggtttgtggcaataaaatccccccctctcccccaattgggggaaccagggtcctacctttgcacccccaaagggcccacaaaccccggacaaaaaaaccctggttaagggagggttctccatggggaacccctcttttttaccctgcccaaaattttttggaaaaaaaataaggggaggggcccctttccccccgccct

SEQ ID NO: 68828 - protein, 84 aa, Zea mays
  misc_feature: Ceres CLONE 1545721
MSTASGTRRAPRRQSQDGSADKVVVIIEATSPVVGSRRGPPTPVPGAQNSPLDVEAIEDEVLPPSSLRECPLRRRGQENPGREP

SEQ ID NO: 68829 - DNA, 792 bp, Zea mays
  misc_feature: Ceres CLONE 1545726
  misc_feature: Encodes the peptide sequence at SEQ ID NO. 68830
ccacgttatttctccccctctccccccctgttctgtcctttcccccccgtcttttaccaccccggcgcccccaccgcgcggtcgccgctttataactagtggatcccccgggctgcaggagttcgtctcatccctagaaaaacagcgagtaccgagtaggagcaaccgcttgcgtcagacgcacactgacggagagtgatcactgatttctggtcatggcaaccgtaactgaggaagttgctcaggtcgttcccgtctccgacgagccggagcctgaagcggataaagacgtggtggtacaccccgaggaaggcaacaagccctacatacatggtgactacgacgaaaaaggctaaccctcccccctacaaggaaaaaaaaggcgaggaagtctcgtaaccaggaaagccaaattccgccggggcttgaaccactccccccatattttgagcaagaatcaaggaggggcattctgtaccccacgacatccgagaaaggcctgggccaaaccccgtttatccaaatccccctattatcatgtcgtgataaaacccccccgggacagtgcccaaccgccacaattaacagccatggcaggctggcaactgataaaataagaccgcgattcccccatctaaggggaggcctcttttcacaaaggggaagaggtctcccttttcaaatacacccgctcctttcccaccaatttaatggaaaacccctcttagccgaagccccaccaaggggagaaataaaaataatgtggcttcaccggccggaaatattgcccct

SEQ ID NO: 68830 - protein, 46 aa, Zea mays
  misc_feature: Ceres CLONE 1545726
MATVTEEVAQVVPVSDEPEPEADKDVVVHPEEGNKPYIHGDYDEKG

SEQ ID NO: 68831 - DNA, 795 bp, Zea mays
  misc_feature: Ceres CLONE 1545727
  misc_feature: Encodes the peptide sequence at SEQ ID NO. 68832
ccacaacaatcctttcccatactctcccccacctacccccccaacaccccacccccgaactcacccccgcgccggccgctctataactagtggatcccccgggctgcaggagttcgtctcacccctagaaaaatgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcacggagtcgtcggagtacgggaccgagggcgcggagcagcaggacggggagttcttcgaggacctcaagctgtccgtcggtaacctgccgttcaactggcgacctcgcccagctgggccgggctcttcgagcaggcgggctcccgtcaaaatgggcgaggcttgtatacccataaaaatgactggggcgggacccttggattctggattccgtgacaatggtttttcaacttaataaaacccggggcttccttgtccaagcaattcaacccggttttaccatttccagggaaaacctccttgaggagggaaacttggggggccatccgccctcccaaaagaatggatcccccacccaaagagcaccccaaggggttggctggaccccggaggggtatgtttggtccgctaccccttttcaccaattcttgcggaa

SEQ ID NO: 68832 - protein, 132 aa, Zea mays
  misc_feature: Ceres CLONE 1545727
MAAALFSTSLSPRFLALSSPKPAAPAASAFLPFTLPLRSVSAPAPARRVFEPVAVTESSEYGTEGAEQQDGEFFEDLKLSVGNLPFNWRPRPAGPGSSSRRAPVKMGEACIPIKMTGAGPLDSGFRDNGFST

SEQ ID NO: 68833 - DNA, 680 bp, Zea mays
  misc_feature: Ceres CLONE 1545730
  misc_feature: Encodes the peptide sequence at SEQ ID NO. 68834
tcacaactagtggatcccccgggctgcattattcgtctcacccctagaaaaaatgggcaagtcattgaagctaggaattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacggtggtggtggaggatatggtggtggtggcggtggctaatggtggtcggtggaaatcatttttttttcttccaatttgtgttttcatcctctcttttccacccccctttttctttttcccccccccacggatcctacccctaatactctgaaaattatatccatctcctgtattatttccaacccatagtacctcatgatcttagcgcctgcctctgcgataattatcttatccaccattcttaacctctttatatccactaaaaaaccgcttatatcactatctggcaccctatattcttttacacgacgaccatgtgtactaacattctttttttccccctttcaactcccctatacacctccaatataactgggaaatattcacccccgctaccatatatcgccccatc

SEQ ID NO: 68834 - protein, 84 aa, Zea mays
  misc_feature: Ceres CLONE 1545730
  misc_feature (2)..(51): Pfam Name: RRM_1 Pfam Description: RNA recognition motif. (a.k.a. RRM, RBD, or RNP domain)
MGKSLKLGIIIDRESGRSRGFGFVTYTSSEEASAAITALDGKTLDGRSIRVNHANEKTGGFRGGGGYGGGGYGGGGGYGGGGGG

SEQ ID NO: 68835 - DNA, 759 bp, Zea mays
  misc_feature: Ceres CLONE 1545732
  misc_feature: Encodes the peptide sequence at SEQ ID NO. 68836
gcggtggcggccgctctagaactagtggatcccccgggctgcaggaattcgtctcacccctagaaaaaaatcagtttgtctgctccgcccgttgcccgtggcccgtcggtctctcttgcagtctcgccgctccccttcctcccccgcaggaatccgaatcagtaagtccggcgacctaggtctctcggcttgtccgcagcccgccggtcagtaatggcgcacgatgatccggttgtttctgctcagtggctgcacgagcacctagggatgcctgatgttaaggttttggatgcttcctggtacatgccggtagaaaaacgggatccatgtaaaaaaatataagggggcacaaatcccccggggcgcttttccttcgactttaaagggcattatttgcccccccccccccggattttcccgccacaatgcttgaccttccagaaaaagggctttttgtccccccccccaatttctcgaagcctggggatatttaaaaaaaccccgggaaaaaaggtttcttttgccctctttagaagggaaagggggttttctttccgggggccccccccccgttttggggcggaatattttaaaaagtgtgttgggcccccaaaaaaaaaccttggtgtactaaaaacgggggggttttccccccaagcgggagacctcttggggttttccacctggaaaaaaggcaccccctctgaaaaacacacccattcttaaaaataaatcccccgctaacaagagggtgtttca

SEQ ID NO: 68836 - protein, 42 aa, Zea mays
  misc_feature: Ceres CLONE 1545732
MAHDDPVVSAQWLHEHLGMPDVKVLDASWYMPVEKRDPCKKI

SEQ ID NO: 68837 - DNA, 690 bp, Zea mays
  misc_feature: Ceres CLONE 1545734
  misc_feature: Encodes the peptide sequence at SEQ ID NO. 68838
  misc_feature (410)..(410): n is a, c, t, g, unknown, or other
  misc_feature (413)..(413): n is a, c, t, g, unknown, or other
ctccccgcggtggcggccgctctataactagtggatcccccgggctgcaggaattcgtctcacccctagaaaaagtctgacggcaagtatcacccccttcccctcttctcctgccacacctccgccagcgctagggttttatttttgcattgctgttgctggtggtggttaccttcttctctctctcagtcgtctccctcgcagctgcagtcgtcgtagcagatcttatctcaaaccctaccgaccaacagctgcttgctcgggacgggaaccggagttggattgcgatggcgctgcagtacgtggaggcgcagcggcaggcgcgcccggacctcgccgactggtatgcttccctcgccgacctctaccagcagaagctatggcaccagctcaccctcaagctcgacaanttnctacagctcccagccgcacagacccgagacactatcattcagctctacaacaattccatcactgattttgagaccagaataatctgctcaagcttgcccattttgcggtgaaaccttctcggcagtacccctgaaaaggagcttcaattaacttctttaaagggggtgaatccaaaacttccgtgaaacaaaaaaattcccgattaatgaacccaatttcctttgggaaaaagcaaaattcgccttttaaactttaaaaaagaacacaaaaaaaggg

SEQ ID NO: 68838 - protein, 78 aa, Zea mays
  misc_feature: Ceres CLONE 1545734
  misc_feature (41)..(41): Xaa is any aa, unknown, or other
  misc_feature (42)..(42): Xaa is any aa, unknown, or other
MALQYVEAQRQARPDLADWYASLADLYQQKLWHQLTLKLDXXLQLPAAQTRDTIIQLYNNSITDFETRIICSSLPILR

SEQ ID NO: 68839 - DNA, 818 bp, Zea mays
  misc_feature: Ceres CLONE 1545736
  misc_feature: Encodes the peptide sequence at SEQ ID NO. 68840
  misc_feature (818)..(818): n is a, c, t, g, unknown, or other
agacaaccccgaacaccccataccaaccccattcctcccgacaaatagaaaaaaaccaaccaccgctgcggcggccgcccgattttcaaaggacccccgggctgcaggaatgtatctcacccctagaaaaacgatgatcagttcctcatggggagcccctgcagcctttttgacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctgtaacaagcaacatggtgagatttttcaagaccgcggatggctcgtggaaccacgaagctgctatttctgtgaaaacaccgaagggccccaactatgattctgcccggaaaagccacccacccccaacgggaatgtgaaaatgtctcctagagaaccccccccccccaccctcaaaaaactggccttcacgggcggataaaaggggagttacagccaactgaaggactccccaccaaacccttttccccgcgtggaaacaagcaatagggtagggcgggccttccttcaagaaagggccagcggaaaccccacccatcgcgaccatgaacaataggccacgtacccaggctatcgtccacggggtcctcccgggccccggcgggactattctaacgctcaaacgccccgggtgtcgcaacccgacaaatcccgagaacttaaacccctctgtgacccataccccgcacn

SEQ ID NO: 68840 - protein, 125 aa, Zea mays
  misc_feature: Ceres CLONE 1545736
  misc_feature (1)..(126): Pfam Name: SBP56 Pfam Description: 56kDa selenium binding protein (SBP56)
MYLTPRKTMISSSWGAPAAFLTGFDLQHVQDGLYGRHLHVYDWPGGELKQTLDLGDTGLLPLEVRFLHDPSKDTGYVGCAVTSNMVRFFKTADGSWNHEAAISVKTPKGPNYDSARKSHPPPTGM

SEQ ID NO: 68841 - DNA, 662 bp, Zea mays
  misc_feature: Ceres CLONE 1545739
  misc_feature: Encodes the peptide sequence at SEQ ID NO. 68842
tccccgcggtggcggccgctctagaactagtggatcccccgggctgcaggaattcgtctcacccctagaaaaacccatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggccgtctggttcaagaccggcgccctgctcctggacggcaacaccctcagctatttcggcaacagcatccccatcaacctggtggtcgccggac

SEQ ID NO: 68842 - protein, 178 aa, Zea mays
  misc_feature: Ceres CLONE 1545739
  misc_feature (83)..(178): Pfam Name: Chloroa_b-bind Pfam Description: Chlorophyll A-B binding protein
MAALAPSKILGTKLNFAGSSRYATAAPTAGAQKIVSLFSKKPAQKPKPSAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLSYFGNSIPINLVVAG

SEQ ID NO: 68843 - DNA, 691 bp, Zea mays
  misc_feature: Ceres CLONE 1545740
  misc_feature: Encodes the peptide sequence at SEQ ID NO. 68844
caccgcggtggcggccgctcttgactagtggatcccccgggctgcaggaattcgtctcacccctagaaaaactcttccgttcccaacccattacatttgcaagcccttttacattgcagagcctcgctcgctctcggaacagagctaggcagctaacagacgaagaagaagcaagccaagcagcaagcgaagcgagagagaggcgaggacgtggcgacgacggcagccgcgatggcgacaacgacggacctggggttcgaggcgacggagctccgcctgggcctgcccggcggcagcggcgggggagggggaggggagctggcgctcatcggcgaggggaggagctcgtcctccgcctccggcaagaggggcttcgccgagaccattgaacttgcccccccattttggagccagcggccgtctttgaggcggaggaggacgaggaggaacacggcgttgctgttgcccttaaaaagcaggaggagccccggaaaaaaaaccggtcccccagcaaaagtattgtccccccccccccccgggctggatgcccccccccaaaaagccccgccccccccaaggctcaggggggggggcggggaaaccggcgcccgggtattccccggaaaaaaccaactggtcccgcctccattcccaaaatggggccccccgcgccaaaatatcccgcccgccg

SEQ ID NO: 68844 - protein, 153 aa, Zea mays
  misc_feature: Ceres CLONE 1545740
MATTTDLGFEATELRLGLPGGSGGGGGGELALIGEGRSSSSASGKRGFAETIELAPPFWSQRPSLRRRRTRRNTALLLPLKSRRSPGKKTGPPAKVLSPPPPGLDAPPQKAPPPPRLRGGGGETGARVFPGKNQLVPPPFPKWGPPRQNIPPA

SEQ ID NO: 68845 - DNA, 687 bp, Zea mays
  misc_feature: Ceres CLONE 1545741
gcggtggcggccgctctatactagtggatcccccgggctgcaggaattcgtctcacccctagaaaaagagacgccgcgaccgcgatcaccctctcggggtttctcggacgcgccgccatcgccactccgccactcgcgggttcgttggatcgacgccaccgtcacctcgcgccgcccagaggaggacgcctgcttctcccccgacgccgacgacccccgccaccgtcttccgcgccaacgccgccgtcgccatcacctcgcgtcgcgccatacgcccaggtctccgccgacactgtcacacgccaggagctcgagtcttcgtcggtccctttgccagaatcttcatcgtgccctttcacagcgacgagcactcaacagagaggagaggattcgacaacatggaggcgtttggcgttggtttctctgttctggagacgcagcgacagccaaacttccaaaacggaatgaaacagcgcttggagctgcgtttaacagaagaaggccagggctgaggtgacagttgggcatctatgtggccattctttttttttctttgtctagagacttggtattaaaccgaaaagtcatgtgcagtcatatgggttgtcttgccatttgcaaaccagatttgtcttccttgcttaacatccatttgtggtcttgtccagaacccagaatcaatccatt

SEQ ID NO: 68846 - DNA, 816 bp, Zea mays
  misc_feature: Ceres CLONE 1545742
  misc_feature: Encodes the peptide sequence at SEQ ID NO. 68847
  misc_feature (36)..(36): n is a, c, t, g, unknown, or other
  misc_feature (37)..(37): n is a, c, t, g, unknown, or other
tacctacccctacgccctccaccgcaaccaatatgnnggggaccattatttccaaaatctgagctccccgcggtggcggccgctctataactagtggatcccccgggctgcaggaattcgtctcacccctagaaaaagcagcgcgcgaaaacgcaggagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggtccgccggggacgggaaagaccaccaccgcactagccatcgcccactggctctacggtctagagatgtgtaaggaaagggattcgggagctcaatggcaacgtgattgatcgctggaacaacccggggtggaggaattaatatcaacgaaccttctgcttcctcttggctggttgagcaactgtacggggaaagcccgggagagtcatcttgccgcatcttatcccggacgtcttcatagcctagattaaagtccggaccccgagcgacattgaagaatgcctaccaaatggcttccggatgccccatctcccaggaatattttactctccatgcggataaacacatttccttctttccgctgtccgcttccctatataccgcggaccccccgaaatatatcttatgcagacgaacaccgttattaccctaacccttgtaaattcccacctattccttccccccg

SEQ ID NO: 68847 - protein, 84 aa, Zea mays
  misc_feature: Ceres CLONE 1545742
  misc_feature: SWISSPROT Homolog: EC 2.7.7.7 DNA-directed DNA polymerase
MAPLVPMSQPWVEKYRPRQVKDVAHQEEVIRVLNNTLQTADLPHMLFYGPPGTGKTTTALAIAHWLYGLEMCKERDSGAQWQRD

SEQ ID NO: 68848 - DNA, 649 bp, Zea mays
  misc_feature: Ceres CLONE 1545743
  misc_feature: Translation starting site: 178
ccccgcggtggcggccgctctagaactagtggatcccccgggctgcaggaattcgtctcacccctagaaaaaacggcgagggaggggaggaagacacaaggcgagtgtccctactccgagggcagtcccggtgtgcaagcgcatagcatagagcaggagccacaacaaaaaaggcccatggcctccttctcaccgagtggccggatgacacggacggcggcatcatctctggcagcgcgcgtggtcctcgcgctcctcctcatcgtggtatccggttccggagccacccaggcagcgtctccccagacccaccacagtcggcagctggatgtgaaccacaaggagccagtgcagacgtttcggcccatcaacattgcccaccgagggtcaaatggcgaactgccccaagagacagcggccgcctacctggtactggtagagctaaattcttccttttttttgtactgtatatatcgcctacttggatttgcacaaacaaaaggctaaaacaaatcgagagagaaaaaaacatttaattttgcagagggcgatcgaagaaggcgcggacttcatcgagacggacgtactcgcgtccaaggacgggcatctcgtctgcttccacgacgtgacgctggacgcgaccaccgac

SEQ ID NO: 68849 - DNA, 664 bp, Zea mays
  misc_feature: Ceres CLONE 1545744
  misc_feature: Encodes the peptide sequence at SEQ ID NO. 68850
tccccgcggtggcggccgctctataactagtggatcccccgggctgcaggaattcgtctcacccctagaaaaaaactccctccccagctttttccccagaggaagcaaccgcagaggaggagaagctgcgcagaaggggaagcggcggcggcggcggcggcggcgtgtaggctgcgcagagagagagagagagagaggccggcagggagggagcgtaagctttttggcagtggtggttctggaatgcagcagcaacacctgatgcagatgaaccagaacatgatggggggctacacctcgcctgccgccgtgaccaccgatctcatccagcagtacctggacgagaacaagcagctgatcctggccatcctcgacaaccagaacaatggcaaggttgtacccaccccccaacggcaccaagctaagctccagcacaacctcatgtacctggccgccatcgctgacagccagccgccacagaccgcgccactatcacagtacccgtccaacctgatgatgcagccgggccctcggtacatgccaccgcagtccgggcagatgatgaacccgcagtcgctgatggcggcgcggtcctccatgatgtacgcgcacccgtccctgtcgccactccagcagcagcaggcggcgcacggacagctgggtt

SEQ ID NO: 68850 - protein, 134 aa, Zea mays
  misc_feature: Ceres CLONE 1545744
  misc_feature (4)..(81): Pfam Name: SSXT Pfam Description: SSXT protein (N-terminal region)
MQMNQNMMGGYTSPAAVTTDLIQQYLDENKQLILAILDNQNNGKVVPTPQRHQAKLQHNLMYLAAIADSQPPQTAPLSQYPSNLMMQPGPRYMPPQSGQMMNPQSLMAARSSMMYAHPSLSPLQQQQAAHGQLG

SEQ ID NO: 68851 - DNA, 666 bp, Zea mays
  misc_feature: Ceres CLONE 1545745
  misc_feature: Encodes the peptide sequence at SEQ ID NO. 68852
ccccgcggtggcggccgctctagaactagtggatcccccgggctgcaggaattcgtctcacccctagaaaaaattcttgtccgccccggctccaggctgctagtctgcaaccccccatccacccgcgaagtctcccaccaccgcgccgatccgggggcgggcggcgggggggcctcttgctctctactccacccactcgcggcctcacccgtggatctacgcggtggccggcgggcgcgatggcggaggcggagcgggagcagcgcccgctgccggaggtggagcaatctgtcacgtccataccggaagatcatgaagcaacatgttggggctgtgggcttcggcttgtctttgcgagctactcacctatctacaagtgtgggtggtgtggagccgtcacgcacaccaacaaccagactgcaaggaaacctgatagtatatggttttcccactggaggcgcctacgggacaggctcttcgtggctgtgctcgtcctcttcatgctcttcgttatatgtggtggggtctgggcggtatatcctggttgttttctcagtcagcaagttctgtggcgtatttcactggccggtagcacctgtgttggctgtatgtaccgtcccaaggctattgcttgccctctttgaaatgggcagggcgccccaacag

SEQ ID NO: 68852 - protein, 134 aa, Zea mays
  misc_feature: Ceres CLONE 1545745
MAEAEREQRPLPEVEQSVTSIPEDHEATCWGCGLRLVFASYSPIYKCGWCGAVTHTNNQTARKPDSIWFSHWRRLRDRLFVAVLVLFMLFVICGGVWAVYPGCFLSQQVLWRISLAGSTCVGCMYRPKAIACPL

SEQ ID NO: 68853 - DNA, 654 bp, Zea mays
  misc_feature: Ceres CLONE 1545747
  misc_feature: Translation starting site: 141
  misc_feature: SWISSPROT Homolog: EC 3.6.1.1 Inorganic diphosphatase
  misc_feature (654)..(654): n is a, c, t, g, unknown, or other
gtggatcccccgggctgcaggaattcgtctcacccctagaaaaaatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtgccaccccgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcgggccttatgccgatgattgattcggggaaaggcagatgaacagatcatttgcagtggtgcgctggatgatccccgaagttcaggcctttacaatggatatctagggagcctccccccctcaacggctttggctggan

SEQ ID NO: 68854 - DNA, 665 bp, Zea mays
  misc_feature: Ceres CLONE 1545748
  misc_feature: Translation starting site: 228
  misc_feature: SWISSPROT Homolog: EC 2.8.1.2 3-mercaptopyruvate sulfurtransferase
gcggtggcggccgctctagaactagtggatcccccgggctgcaggaattcgtctcacccctagaaaaaacctcacaagtccaaatcagtttgtctgctccgcccgttgcccgtggcccgtcggtctctcttgcagtctcgccgctccccttcctcccccgcaggaatccgaatcagtaagtccggcgacctaggtctctcggcttgtccgcagcccgccggtcagtaatggcgcaggatgatccggttgtttctgctcagtggctgcacgagcacctagggatgcctgatgttaaggtaaaaaaaaaacatctagtttgcgtgttcatattcacttcagagacacttcagtaatgcttccttcatcgaagaagaaagttcagagatatacttcttctatcccctgcgttactggttttggatgcttcctggtacatgccggtagagaacagggatccatggaaagaatatcaggttttcagcatcaactataacgtgtctcatcttcctttttgagataatttttggagctaaggtgttctaatatccgcaggtggcacacatccccggtgcgctattcttcgacttagatggcatagttgatcggacaactgatttaccgcacatgctgccatcagaagaggcttttgcagcagcaatttctga

SEQ ID NO: 68855 - DNA, 603 bp, Zea mays
  misc_feature: Ceres CLONE 1545752
acccgcggtggcggccgctctagaactagtggatcccccgggctgcaggaattcgtctcacccctagaaaaaacaccaacccggtgcacggttctgctttcgcttcgatcccggttggtcgcgctttcgtcgccgccatcaacggtggtcgctatcccctccctatccggcgtccgtgatgctcgccgcccctgctcccccacgcgtcggacgctcgtctccctcccctctggcccgcctcgctccccttcagcccttccgtcgcgcgcgcttggaaaaaggtccagcagccccaaactccccagcgggggcgagcctgggatgaagagccatctcgcccacctcttcctgcatgccggatccccgccgtccccaccatcgcctgtgttgggtccgacccaggccgctcatgcctcgccgcgcagttctcacacaccgtccgcggcggcgtctgcctcgcgccggtctcgcacaccgtcccgcagcggatccaatcacacctcctcaccctgcgttgcctcctcccatcccctctcccatcgaatccgtgattccgcgtcccggtgtccacgccctcgtcttcaacattctgcccagtttatt

SEQ ID NO: 68856 - DNA, 690 bp, Zea mays
  misc_feature: Ceres CLONE 1545756
  misc_feature: Encodes the peptide sequence at SEQ ID NO. 68857
  misc_feature (487)..(487): n is a, c, t, g, unknown, or other
  misc_feature (525)..(525): n is a, c, t, g, unknown, or other
gctggagctcaccgcggtggcggccgctctagaactagtggatcccccgggctgcaggaattcgtctcacccctagaaaaataatccctttgttactcagatggatgtaacttgtttcgacaagattgagcgtgtccgcactcatactactataaatttgtattctaaaacaaatattttatcatcgttagcaagattatctactatataccataatcctctgtattcatatgtactctatatctcaccactataccaaatatcatatattatatattttttttcacttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagccccgcacgatcgcccttnccaacagttgcgcagcctgaatggcgaaatgaaaattngtagcgtaatattttgtaaaaatcgcgtttaaatttttgtaaatcagctcatttttttaacaataaggccgaatcggcaaatcccttaaaatcaaaagataaacggagatagggttgattgttgttccgtttggaacaggagtccctattaaagaacgggactcc

SEQ ID NO: 68857 - protein, 108 aa, Zea mays
  misc_feature: Ceres CLONE 1545756
  misc_feature: SWISSPROT Homolog: EC 3.2.1.23 Beta-galactosidase
  misc_feature (86)..(86): Xaa is any aa, unknown, or other
  misc_feature (99)..(99): Xaa is any aa, unknown, or other
MYSISHHYTKYHILYIFFHFKKKKKNETLEVPNSPYSESYYARSLAVVLQRRDWENPGVTQLNRLAAHPPFASWRNSEEAPHDRPXQQLRSLNGEMKIXSVIFCKNRV

SEQ ID NO: 68858 - DNA, 662 bp, Zea mays
  misc_feature: Ceres CLONE 1545759
  misc_feature: Translation starting site: 168
  misc_feature (325)..(325): n is a, c, t, g, unknown, or other
  misc_feature (397)..(397): n is a, c, t, g, unknown, or other
  misc_feature (398)..(398): n is a, c, t, g, unknown, or other
aaacgctggggctccccgccggtggcggccgcttttgaaattgtggatcccccgggctgcaggaaattcgtcttacccctagaaaaaacggtaaagagagagaaggtgggagtggaatcgacaggggaaaaccaagcctgcgtttcagagacaactcaggcggcgcgatggcgatggcggcgctgcgacgcgaggggaggcgcctcctcctctcccccaccgtccccaacccgtcttcggcggccgcttccgctgcggtgacgcgatcctccgccatgtcgcaaccggagatggctccacttggtgcacgttctatttcaactcnagttgtgaggaaccggatgaagagtatcaaaaacatctagaagatcacaaggctagtgaggatgggttgcanncatcaagcttcgggctgttcagacgaggactgaaaaatcccgcggcctgtgggcagcgttccacgcccttcttggggacccttctagtggtgatgtcaagaagaaatgtgattgggccctttacctctgataagggactcctgtgggggtatccaatcaacccccgggaaaatttaccggggccctttccaaactgacctttgggtcccaaaaaaaaaaaaaaaaaaccgagccccttcgggggcccccatttcccccctaagc

SEQ ID NO: 68859 - DNA, 674 bp, Zea mays
  misc_feature: Ceres CLONE 1545760
ctcaccgcggtggcggccgctctagaactagtggatcccccgggctgcaggaattcgtctcacccctagaaaaaaccacccacagcgtccccccttttgccgatccagttgtgccgatcggtattttcgcgcgtccaccaaaacccgttagccgcgttttttttcagtcgccgcacggaccaggatcgtacgggtgccgaagaagccagccggatgaaaccggatgccccgggccccggaaaaaggcggctcccccaaagggctgggaataacaccctgaattctccccaaaggggccgggggcccccaaaacaaacccgggaataaaggctggcgcaatcggggaggcccctcccccaaattttccaaaaacccaccttgtgggtagaaggggtgttccccacaaaatatcccccccgtttgaaaaagaaaaaacacccttgaccgaaggaaagaaagacccccaaaaaaggggttggattgggaaggaaagaaattcttccccccctcccccccgggggagaggcccaagggggggggaaatcctggggaaatttccccccggctgttgtggccccggggaaaaaaaaaaatccccaaaagggggggggggaaaaatagttaacccccaacacccctggggggggatgacccacccaagtagttcatcaaac

SEQ ID NO: 68860 - DNA, 714 bp, Zea mays
  misc_feature: Ceres CLONE 1545762
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (330)..(330): n is a, c, t, g, unknown, or other
ctggagctccccgcggtggcggccgctctagaactagtggatcccccgggctgcaggaattcgtctcacccctagaaaaacctagaaaaagtacatgttcttgcagttgtggtgatgcatggatgatctagctaggttcagtagagcattgagacgcagtattgttgttgcatcgtgatacaggagaccacaccacagttttgttccagggaattggttggttggtggtaagccgttgtggtctgccgttcaagtgcannnnnnnnnnnnnnnnnnnnnnnnnnnnnnnnnnnnnnnnnnnnnnnnnnnnnnnnnnnnnnggaaaaaaanaaaaaaaaccgggacgctcgagggtacccattccgcccctataggtgagtcggtattacgccgcgctcactggccgtcgtttttacaacggtctggcctgggaaaaacctgggggttacccaaatttaatccgcctgtgaagaatatcccccttttcccaagttggggtaaataacgaaaaggccccgcacccaaatgcccctttcccaacatttgccccccctgaatgggccaagggaaatttttaaacccttaaaatttttgttaaaatatccccggtaaaattttttggtaaaaaccaccctttttttttaaccacaagggccgaaaatcgggaaaaaaccttttataattcaaaaaaaaaacccccgaaatggggttttg

SEQ ID NO: 68861 - DNA, 647 bp, Zea mays
  misc_feature: Ceres CLONE 1545763
ctggagctccccgcggtggcggccgctctagaactagtggatcccccgggctgcaggaattcgtctcacccctagaaaaaaccagcaagaccaaccaacccacttctgactgaccactgtgccgcgccgtgctcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccgtccgtcgagtgaacagtgtggtcttccctgtactctacttgttcagatcgtaggcgtgtagtagttgcaccagccggcgtatgctcatgatcgatgtgtgtgctcatcaatcaatgtcaatggctgcctgctgtaagcggtcgatgtaaactaagcacagacgcatgtatcgtcatcagtggatgaatcaatctatcgatggcctgtgccattcattttaaaaaaaaaaaaaaaaacgagacgctcgaggtacccaattcccccctatagggaggtcgattacgccgcgctccctggccgtcgtttttacaacgtcttgacggggaaaaacctggggttacccaacttaatccgccttgg

SEQ ID NO: 68862 - DNA, 598 bp, Zea mays
  misc_feature: Ceres CLONE 1545767
  misc_feature: Encodes the peptide sequence at SEQ ID NO. 68863
  misc_feature (385)..(385): n is a, c, t, g, unknown, or other
ctccccgcggtggcggccgctctagaactagtggatcccccgggctgcaggaattcgtctcacccctagaaaaaacaatccatgcggcggcatatggcgcccatcaaggagcaaaaacacacgacaagcgcagaacagcaggtgatgctggatgccgagctccagctgtggaacacaccttcggctacgtcaagtccatggcgctcaaggccgcgatcgacctcggcatacccgaagccatcccacagcacggctgcacggccaccctcccacaaatagtcaccagggtcacgctccaccccgtccagacaacatgcctgccgcgcctcatgcccgtgctcaccctctaccgggtccttccgcgcgcaagaagcgcacgaagacnaacagcggctgtgacgaacaaattcgtctaaccgctcacgccgggaatcccgtcttcctcgtcggctcaccgggggaaaaacgtggggccctttcttgacccggatgctccgccccatcttttaatgggggccttcctcgaccccccggggggtgggtccaaccagaaaaacccggaacccgtcccctttaaagatgaagcacgggcgggacc

SEQ ID NO: 68863 - protein, 137 aa, Zea mays
  misc_feature: Ceres CLONE 1545767
  misc_feature (66)..(114): Pfam Name: Dimerisation Pfam Description: Dimerisation domain
  misc_feature: SWISSPROT Homolog: EC 2.1.1.146 (Iso)eugenol O-methyltransferase
  misc_feature (128)..(128): Xaa is any aa, unknown, or other
PRGGGRSRTSGSPGLQEFVSPLEKTIHAAAYGAHQGAKTHDKRRTAGDAGCRAPAVEHTFGYVKSMALKAAIDLGIPEAIPQHGCTATLPQIVTRVTLHPVQTTCLPRLMPVLTLYRVLPRARSARRXTAAVTNKFV

SEQ ID NO: 68864 - DNA, 538 bp, Zea mays
  misc_feature: Ceres CLONE 1545769
  misc_feature (136)..(136): n is a, c, t, g, unknown, or other
  misc_feature (158)..(158): n is a, c, t, g, unknown, or other
  misc_feature (277)..(277): n is a, c, t, g, unknown, or other
  misc_feature (278)..(278): n is a, c, t, g, unknown, or other
  misc_feature (422)..(422): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
gctccccgcggtggcggccgctctagaactagtggatcccccgggctgcaggaattcgtctccccctagaaaaattttactgaatgttcctccggggaggagaaaagagagagatggtggaatctgcgttcggcgnaggagggttccaagaggcactngctacgaaagtttgacgggtgggaagattctcatattacccttctttcatccctggggatgggcaaccttggttatcctccactagggctgatgaccatttgttgtgacaatcccaatnntggacaggctaggttccttttttatccctcccccccgttttttccaattgccttttaacctaagaacttttttttttggccctaaacccccccctgatggcctgccttttttttttcccccccccccccccccaaaaaaaaaanaggggaaaaaaannnnnngggaaccccggggggccccctccccccctaaagggggtttttttttccccccctcttggggcggtgttttttaaacaccccccgcgggggggaaaaac

SEQ ID NO: 68865 - DNA, 667 bp, Zea mays
  misc_feature: Ceres CLONE 1545770
  misc_feature: Encodes the peptide sequence at SEQ ID NO. 68866
cgcggtggcggccgctctagactagtggatcccccgggctgcaggaattcgtctcacccctagaaaaaacctgccacccggccaggcggccaccacaaccacggtcctgcgcccggcggtctttcactccccatgtgttccagcttgcgtacggccagtgcggcggtgccactgccgttccctgcaggtgatctggtcgtagctcagatctgtgcgatcgtgcaccgccgccggcttcttagttcgcacacaccactggcgatcgactgtcctcgtgcatctccattctcccgcagctactcgctacctctccacgtcaagcactgcgcatgaagatcggtcttctccacgtgaccatggttgagcactacgtcagacattggcagctcgccccagcaggtctaattttatattgctcgctgtatgccttaaggcatgtgttaaatttgatttggtggacaaattttggatggttggaatgtttaaccaaatttaaaatttgtgggaaaaattttgctggaccaaaattttgaatttttgggggattcttaaaaaaaaaaaaaaaaaccaaaccccttaggggtcccccaattcccccctaatagggggtccaatttaccccgccccccatggggcgcgcttttttaaaacggcctgggactgggaa

SEQ ID NO: 68866 - protein, 66 aa, Zea mays
  misc_feature: Ceres CLONE 1545770
MCSSLRTASAAVPLPFPAGDLVVAQICAIVHRRRLLSSHTPLAIDCPRASPFSRSYSLPLHVKHCA

SEQ ID NO: 68867 - DNA, 601 bp, Zea mays
  misc_feature: Ceres CLONE 1545772
  misc_feature: Encodes the peptide sequence at SEQ ID NO. 68868
ctccccgcggtggcggccgctctagaactagtggatcccccgggctgcaggaattcgtctcacccctagaaaaatcccttcccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgcccggcggggggggggggggccgcgcgcccggcggctcttttccccggctttgccacctccgttctggagacattctccgcccgcacgggggggggcgcctcccgcatctcccagatccgagattctcattttgagccccgcggagcgcgtgtcaaatacacaaaatacaacctctcccagctgcctgagaatggtgtaaatgtccctaaagaattttaaaaatccagccagagaatgggtggttagaccttccggggtgagaacaaaaatctgggtccccaagggattcaacgtgttcaaggacaagcacaagctcaaacacaa

SEQ ID NO: 68868 - protein, 83 aa, Zea mays
  misc_feature: Ceres CLONE 1545772
MQPDQPVISLRPAGGGGAARPAALFPGFATSVLETFSARTGGGASRISQIRDSHFEPRGARVKYTKYNLSQLPENGVNVPKEF

SEQ ID NO: 68869 - DNA, 628 bp, Zea mays
  misc_feature: Ceres CLONE 1545775
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (535)..(535): n is a, c, t, g, unknown, or other
ctggagctccccgcggtggcggccgctctagaactagtggatcccccgggctgcaggaattcgtctcacccctagaaaaaacccgagaagattgggcatggccggaattacagttcagatgttgagatcacgccggaggacgacgaggcaaaccacggcaacgttgcagtggacgaaccgaaacagcgggagcctgccaggggaaagccggcatcggtcagaacaaagtggggattttagcggcatccagatcgcaacggaggagatggtttcttcgtcttgtcaatatattggcatggaagttgttttttttcactgtagtagtatgtaattaacgacggttaccaaaaaaacacatgaagcgatttgatttatttgcaacagtttgcacactagtacactatgcctgtactatgctatgttctgtaatgtgtagcgttattgtagtacatggtctttgggagaaaaatatgatgttgcattcaaannnnnnnnnnnnnnnnnnnnnnnnnnnnnnnnnnnnnnnnnnnnaaangggaaaaaaaaaaaaccggggcccccgaggtccccaattccccctaaggggttcgatttccccccctcctgggccgtcgtttaaaaacgtcgg

SEQ ID NO: 68870 - DNA, 727 bp, Zea mays
  misc_feature: Ceres CLONE 1545776
  misc_feature: Translation starting site: 135
  misc_feature (201)..(201): n is a, c, t, g, unknown, or other
  misc_feature (206)..(206): n is a, c, t, g, unknown, or other
  misc_feature (218)..(218): n is a, c, t, g, unknown, or other
  misc_feature (219)..(219): n is a, c, t, g, unknown, or other
  misc_feature (225)..(225): n is a, c, t, g, unknown, or other
  misc_feature (226)..(226): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (238)..(238): n is a, c, t, g, unknown, or other
  misc_feature (239)..(239): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (254)..(254): n is a, c, t, g, unknown, or other
gctctagaactagtggatcccccgggctgcaggaattcgtctcacccctagaaaaaaggcgcgcggtttccaggcggttcctcctccagactctagagaaagaaggcgcatcgtgagcgagagagagagaggcaatggcgtcggcgacgttcctggaggtgctcctcgccatcttcctcccgccggtcggcgtcttacctnttcgncgtaaacccggnngggggnncnnntttttggnngtnnnttnnnggggnggttgtggttgtggtataatttatgttttggtaggagttgttagatattgtgatgagggtttggatagaggtgtttttgtgtttttttttttgtgaatatgtttctgttgttttttttttttactgttttactatttttataatatgtaagtacgaaccattcccgtattcagcattattatactggttggcctttttttgtggtacatctccttccttgcgctcctgtatttcccccgctttctctgtctacccttctatttcacggtttgctgcttcgtatgggttactcctccgatcatatctttttaaattaggcgatgctacttcttcgtgtttccccgcgcttcctagcaccgcttcgttgtcgggcgtgtagattgcagttgtgcatacgccgggacctagccatggatgttacaacaacatattcctacgtatgttattttgccttctcctctttgcctttcctg

SEQ ID NO: 68871 - DNA, 671 bp, Zea mays
  misc_feature: Ceres CLONE 1545788
  misc_feature: Encodes the peptide sequence at SEQ ID NO. 68872
  misc_feature (566)..(566): n is a, c, t, g, unknown, or other
  misc_feature (648)..(648): n is a, c, t, g, unknown, or other
agctccccgcggtggcggccgctctagaacagtggatcccccgggctgcaggaattcgtctcacccctagaaaaactcccgactctctggcctctcctgactctgccccgcctcatcactcccattccaccgacacgcggaacgcggcgtgtcgcgcgcctccgctaaaaccgtagcccgaggcccgatggccgccccgccgcaaccgcacccacaggcagcggaagaaaaggccgccgccggcggttcccctgcccactgccccggcgggtccgccgccctacgacgtggcggtcgcggcggcggatctcccgccggtagactgcaacctcgccgcgctctgtgaccacgtccaggcggaggggttccgggttgggggccttctccgacctctcctgggaggccgcgggcgccacctaccgcctccatcgcctcatcctctctcgtagcgcctatttcaggaatatgctacatggtcccttggagagaggcgggagcaccccacagtggttttgcacatagatgatgccaatgttgattcagaagcaattgcaattgcgcttgcnatatctttatgggcaagcccccaagcttaatgatacaatgccatttccgggttcttgcagctgcatcaattttctagatccntccaagacttgtggcacgatatt

SEQ ID NO: 68872 - protein, 49 aa, Zea mays
  misc_feature: Ceres CLONE 1545788
  misc_feature (15)..(15): Xaa is any aa, unknown, or other
MMPMLIQKQLQLRLXYLYGQAPKLNDTMPFPGSCSCINFLDPSKTCGTI

SEQ ID NO: 68873 - DNA, 623 bp, Zea mays
  misc_feature: Ceres CLONE 1545791
  misc_feature: Encodes the peptide sequence at SEQ ID NO. 68874
  misc_feature (506)..(506): n is a, c, t, g, unknown, or other
ctccccgcggtggcggccgctctagaactagtggatcccccgggctgcaggaattcgtctcacccctagaaaaaatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtgaatccatgccatgttatgaatctagtccttcctttcttgtatcttccatgtgacgcggcgtgtgcgtcccctcatgtgtgatgatgccagatgaatacacaaataagacngttgttgtgactgtgtgccagaaaaaaaaaaaaaaaacgagacgctcgaggtacccaattcgccctatagtgagtcgtattacgcgcgctcactggccgtcgttttacaacgtcgtg

SEQ ID NO: 68874 - protein, 63 aa, Zea mays; identical to SEQ ID NO: 8705
  misc_feature: Ceres CLONE 1545791

SEQ ID NO: 68875 - DNA, 660 bp, Zea mays
  misc_feature: Ceres CLONE 1545801
  misc_feature: Encodes the peptide sequence at SEQ ID NO. 68876
  misc_feature (477)..(477): n is a, c, t, g, unknown, or other
  misc_feature (619)..(619): n is a, c, t, g, unknown, or other
ctccccgcggtggcggccgctctagaactagtggatcccccgggctgcaggaattcgtctcacccctagaaaaattctcgccaaaggggaagccctgcccgtacttccgttgcggcgctacgagcttcgacgggcctcgatctccacctctgaagtgactacttgtgatctagatctgaagctgtagtggtcagcagcttagtgtgaatcgaagatgagcgtggtggggttcgacctcggcaatgagagctgtatcgtggcggttgcgcggcagcgtggcatcgacgtggttctcaacgaggagtccaagcgcgagacacccgccatcgtttgcttcggggacaagcagcggttcatcggcaccgccggcgccgcgtcctccaccatgaaccccaaaaactcatctctcaaattaagcgcctgctcggccgcaggtctcagatccgagctgcagcgggatctcccctcttcccattncgagtcccggagggccccgatgggttttcccctgggccctgtacgggacctgggcaagaaaggaaatttcccctcccccaggtggttgccagggggggttccatttttaaggggttttccaaagggaccccaaagccccacntttttatttgtgccttgggatcccccgggtctttcaaaaac

SEQ ID NO: 68876 - protein, 148 aa, Zea mays
  misc_feature: Ceres CLONE 1545801
  misc_feature (88)..(88): Xaa is any aa, unknown, or other
MSVVGFDLGNESCIVAVARQRGIDVVLNEESKRETPAIVCFGDKQRFIGTAGAASSTMNPKNSSLKLSACSAAGLRSELQRDLPSSHXESRRAPMGFPLGPVRDLGKKGNFPSPRWLPGGVPFLRGFPKGPQSPTFLFVPWDPPGLSK

SEQ ID NO: 68877 - DNA, 649 bp, Zea mays
  misc_feature: Ceres CLONE 1545805
  misc_feature: Encodes the peptide sequence at SEQ ID NO. 68878
  misc_feature (246)..(246): n is a, c, t, g, unknown, or other
  misc_feature (263)..(263): n is a, c, t, g, unknown, or other
  misc_feature (312)..(312): n is a, c, t, g, unknown, or other
cggtggcggccgctctagaactagtggatcccccgggctgcaggaattcgtctcacccctagaaaaaaccgctaggtttttcctcctgccgccgcctcccagaccgtctcctccgccccagccgggatgccgacggtgagcgtcggccgggatcgtctcttggctgccattggtcgaacctacacacaggaggagttcgaggcgctctgcttcgagttcggcatcgagctggacgatgtgacgacngagaaggctattatcanggaaggaggagcacctcgaagacgacagtgtagtggacgaagatgacgnagtcatctaccagatagaagtggccgcccacaaatatgatttgctatgtttttgaaggactagcagagaaccttcccggttttccctgggactgaaaccagccccttgtttccaaggttcatcaatccccccgggggtcaaagggtccaaaagccgttttaaaccccagaccttaaaattttacccggccaaaggttttggccgttcccaaaagggggaaactttttgttgaaacaaaaatacaacgccttccttttgttttttaaaaacaacttcccccaaaatttctgcccgaaaaagaaacctcctttggccttttggccccctttgatctggt

SEQ ID NO: 68878 - protein, 60 aa, Zea mays
  misc_feature: Ceres CLONE 1545805
  misc_feature: SWISSPROT Homolog: EC 6.1.1.20 Phenylalanine--tRNA ligase
  misc_feature (46)..(46): Xaa is any aa, unknown, or other
MPTVSVGRDRLLAAIGRTYTQEEFEALCFEFGIELDDVTTEKAIIXEGGAPRRRQCSGRR

SEQ ID NO: 68879 - DNA, 652 bp, Zea mays
  misc_feature: Ceres CLONE 1545819
  misc_feature: Encodes the peptide sequence at SEQ ID NO. 68880
  misc_feature (395)..(395): n is a, c, t, g, unknown, or other
  misc_feature (403)..(403): n is a, c, t, g, unknown, or other
gctggagctccccgcggtggcggccgctctagactagtggatcccccgggctgcaggaattcgtctcacccctagaaaaagcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgattccccatttgcgggggcggggggccggcttgntttcctcnaaggatcaccatctactcttgattgtggactttgtcgcatctgatatcaacttcataaatctttatccaagatggcgctgcaaaacattggtgcttcaaaccgggatgatgcctcctacccgtaacaaatgcccagaatgattcccaagataaaaggccgtggaattgtttccgaaacataggtgttgaactgggttgacttagccaaagcctttgccgggccagtttttcttcccaaccaagactctg

SEQ ID NO: 68880 - protein, 68 aa, Zea mays
  misc_feature: Ceres CLONE 1545819
  misc_feature (52)..(52): Xaa is any aa, unknown, or other
  misc_feature (55)..(55): Xaa is any aa, unknown, or other
MSEQSLLYLGLLGEYSRATRKRHKVPSHCMRQETVWFSCSDSPFAGAGGRLXFLXGSPSTLDCGLCRI

SEQ ID NO: 68881 - DNA, 576 bp, Zea mays
  misc_feature: Ceres CLONE 1545832
  misc_feature (161)..(161): n is a, c, t, g, unknown, or other
ggagctccccgcggtggcggccgctctagaactagtggatcccccgggctgcaggaattcgtctcacccctagaaaaagcgatgtggtgtccacttctagtgaaactactgtctgctgttaaaacctggttggtttcagaacgatgattttcgtgtgcaanacagattactggtccgtgggagttgggccagtttgcattgtctcagacaaagaacacaacgagacgctcgaggtacccaaatcgccctatactgagtcgtaatacgcgcgctcactggccgtcgtattacaacgtcgtgactgggaaaccctgacgtaccccactaaatcgccttgagcacatcccctttcgccagctggcgaataacgaaaaagcctgtaccatcgcctttccaacagttgcccaccctgatggcaaatggaattgtaaccgttataatttgtcaaaatcccgttaaattttggtaaaccccctcctttttttaaacccatgggccaaaaaccggcaaatcccctttaatcccaaaaataaccccgaaaaggggtggaagttttttcccctttgtaaaaaaaaa

SEQ ID NO: 68882 - DNA, 673 bp, Zea mays
  misc_feature: Ceres CLONE 1545836
  misc_feature: SWISSPROT Homolog: EC 3.2.1.23 Beta-galactosidase
  misc_feature (673)..(673): n is a, c, t, g, unknown, or other
ggcggccgctctagaactagtggatcccccgggctgcaggaattcgtctcacccctagaaaaaaaaaaaaaaaatgtaaccttgctgtaccaagttttgtagccggatggtttgggagcatggtccggtcttctatgttttgtctatgttttgtctatgttttgtgctattttggttgtttaatgccccaatcattacatatagattccaattgttttgttgtttgatgatcaatataactatttatactaaggccatgtttgatttctttagtctaaaaaaaaaaaaaaaaacgagacgctcaaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgtttgtccagtttgaaacaagagtccactattaaaan

SEQ ID NO: 68883 - DNA, 608 bp, Zea mays
  misc_feature: Ceres CLONE 1545847
ggagctccccgcggtggcggccgctctagaactagtggatcccccgggctgcaggaattcgtctcacccctagaaaaagcctccgacttccctcctcgcctcgcctcgccacgccgcatttgcatttccggatgacctcctctcgcactccccattcccctccgacgccgtctctcgcgcccgcgacccacccggactcccgcttcgatctcgccacgattcccccgctcgcacccccaaccgaattcgtccctctcacgcgcgcgctggtggaaagacaacgatggcttggggcgggggcctctctccccgcctcgcgtgatctcgtcctcgcgcggggagccctcccgcgtgcccacgcggaggatctcgtcgcggttggtgcactacgacttcctctccattcgacactcctccgtgctctctcgagcgtccactcgacattagatagggtttgctccctgcctgcctcaccgcccgagtgagtcctcgacccttccgggctcttgatagttcgctccgagtctactcgtacaccatgttctcgcacggcgcttgagccgctcactacgcgggacctgtggattcaacaacagcgatttgcccac

SEQ ID NO: 68884 - DNA, 635 bp, Zea mays
  misc_feature: Ceres CLONE 1545872
  misc_feature: Translation starting site: 195
  misc_feature (214)..(214): n is a, c, t, g, unknown, or other
  misc_feature (248)..(248): n is a, c, t, g, unknown, or other
  misc_feature (255)..(255): n is a, c, t, g, unknown, or other
  misc_feature (256)..(256): n is a, c, t, g, unknown, or other
  misc_feature (258)..(258): n is a, c, t, g, unknown, or other
  misc_feature (272)..(272): n is a, c, t, g, unknown, or other
  misc_feature (288)..(288): n is a, c, t, g, unknown, or other
  misc_feature (299)..(299): n is a, c, t, g, unknown, or other
  misc_feature (306)..(306): n is a, c, t, g, unknown, or other
  misc_feature (313)..(313): n is a, c, t, g, unknown, or other
  misc_feature (337)..(337): n is a, c, t, g, unknown, or other
  misc_feature (347)..(347): n is a, c, t, g, unknown, or other
  misc_feature (427)..(427): n is a, c, t, g, unknown, or other
ccccgcggtggcggccgctctagtcctagtggatcccccgggctgcaggaattcgtctcacccctagaaaaaatcctcctctttccattccactctctcactctctctctaatcacactttcgacactgatcggtactctagtgtcggactcgtcacgattttcgcgagaacgaacgagcgagcgagggagaggatgggttccacaggaccggngagcgggttcgcgtggccggagggggacatcgangatctgnngnggaacgacgccaantacacggggttcaagnggttctggttnctcgagngcgcggngttggggcattcgggaagggcctntgtcgtgganggtcgcgtgcgctacgcctcgcgccctcacacctatcgccgctgccgccgcctcgcataagtaatctagagactatgagncagccacggaagccccgttgctgtgataccccctcatgtccccgctgtctatgaagctcacttcggcgccccaatgtccggtgctgttgtgaactgcgtcaatattcaggtaaacgcccagacaatagcgttcctccttgaacactccgtggcggaatttgtgatggtggaccaagaattcttcaccctagccgaaggatcgctgaaa

SEQ ID NO: 68885 - DNA, 3070 bp, Zea mays
  misc_feature: Ceres CLONE 1545891
  misc_feature: Encodes the peptide sequence at SEQ ID NO. 68886
acgtttcagcatctagagctgcaggctgcagccgtcagccgcacccgaggccgagcgccggcccgagaggcgatttgggcggctgtgctggccggccatggcgaagccaggcggcagcgatgagtcgtgggagtacagtctgcgcaagtatctcctgctgctggccacgctggtggccacggtgacgtacggtgcggggttcaaccccccaggcggcgtctggcagactgccgaccccgccgccgaccgcatcgccggcgaccccatcatccgcgacacgaactacgcccgctacctgtccttcttctacagcaacgccaccgccttcgcctcgtcgctcgtggtcatcgtcctcgtcctcatcctgtccgtgctgcacgacaacgggggaatcaccatgctcgcgccgctgctcggcgtcctccgggccgtcatggtgctggacctgctcagcctcatgggcgcctacgcggcggggacgttccgggacacgctcacggcggtctactccctggtgctgtcggccggcgtcgtcgcctacctcgtggcccacctggccctggcctcgagggcgccggcggccgaggacaagagggggcagagcgcgccggagcggctccgcaaggtgctcatgctcctcgccacgttcgccgcgagcgtcacgtacgtcgccggcctcagcgcgccgggcggcttctgggaccaccccgaggacggccaccgcccgggcgacgcgatcctcaagggagggccccacgacgcgcgcctcaaggccttcttcgtctgcaacaccacggcgttcgtcgcgtccctgctcatcctcatcatgctcctggagaagaagctctgcttcagccagaaggtgcgctcctatgagatctacggcttcatcgccgtcacgctcatcagcctcctgggggcgtatgctgccggcagcagccgccagatcgacacgaccatctatgtgagcgctcttgttggtgccgttgccgtgtgcattctcatccaagtggttttcgtcttgctcttccaaacaaattcgagccaggggcaacaaacaccaactcaaggtcccctaacaaataatggcaatggcagtgatgagcatcagcagactcaaggtccgcagaccagtatggacagtaaagacagggatgagcagcagcaacaaacccacggtctgcaaactagtgatgacaatgtcagtgaccaccagcagcagcagcagcaacaaactcagagtcctcaaactagcaatggcaatggcaatgccagcgatgagcatgagaagcaacaaaatccagcgctggagaaggctcgctctcttgtcctgctgctcgctactctcgcagcggcaatcacctaccaagcgggcctgaacccgccgggtggcctctggcagagcaacggccgcctctacaagatcggtgatccgatcctcttgaccacgaaccccagacggtacaaggcattctactactgcaactccgtcgccttcgtcgcctccttggtcgccgttatgctggttaggaagaagacactgcaccaccacaacgcgctggaggccgccatggtactggacctgttcggcctcatcggcgcttacgccgccgggagctgccgggacgtcagcacgtccatctacgccatggcccttgcaggcgccgtgctggtctacgtggtcatccatgtcgtcttcttgacgctggacgaaaaggacggcagcagcgcgagaaggaatgatgacgcttccttcgaggagagagagaaaaaggaggcgggcctggtggagaagaggcgcaaacgactgctcctattcgccatcttggccgcgaccatcacctaccaagccgggctgacaccgccgggcggctttctggtccaggacgataaccgtaccggccgccatgccggcgacgcggtcctgctcaacaactacccgcgccgttacacggctttcttctactgcaactcggtgagcttcatgctgtccatcgccctcatcatcctcctcgtgaaccccaacctgtaccgccctgccattcggagcaatgcgctgtctgtctgcacggcggccgggttgattggaatcatgggcggctacgcggccggctgcacgcagcatctgaagacatccatctatatcttcgtgttggcggccgtggttctgtccactgtggtctttctggctgcggtgttccttgtgatccatctgagaaaaaaagacgataatgctaacagcaccaacagagcagcagcaagagaggcacctggggaagaacaagaagccaatgctggtgctggggtgccaaatgccatggggggcgagcaaagaggtccccaaggagccaaagctcgccgaaaagaaaagagggcacacgccaagcgcaagtatctgatgctgcttggaatcctcgtggcgagcgtgacctaccaggccgggctggcgccgccgggcggggcgtggcagtccaacgacggcacccacaccgcgggcgaccctgtgatgcacgactaccggagggcccggtaccttgccttcttctacagcaactccacctccttcgtggcgtccgtggtcgtcgtcgtgcttctgctgccggagtcgctgcacaagaagtggtggtggctcggggtcatgaacgcgacgatcgtgctggacctgctgggcctcttgatcgcctatgccgccgggtccagcaggacgtggaagacttctgtggttgtttccgctctcgttctcgctgtgctcgcctatttcgccatacatgtgctgctgtcaagctgcgtcaggagagggaagaagacagcccccgactctccgtctccgccccaggaccaggagaacagagaggaaaacgaagcggcaacgaaagaggtcgagctccagggtccagcttgctgaaactggagtgtacagtgcggagctgaatgtgtgtgcagtccagtacttgtagatttttttttcacgaccgtgttgtcgcatttttttttttgtcaagaggtgtagtgtttttgttgatccacgtagcgggcgggaacgattgatgtgcaaaaaaaaaaaaaaaaa

SEQ ID NO: 68886 - protein, 935 aa, Zea mays
  misc_feature: Ceres CLONE 1545891
MAKPGGSDESWEYSLRKYLLLLATLVATVTYGAGFNPPGGVWQTADPAADRIAGDPIIRDTNYARYLSFFYSNATAFASSLVVIVLVLILSVLHDNGGITMLAPLLGVLRAVMVLDLLSLMGAYAAGTFRDTLTAVYSLVLSAGVVAYLVAHLALASRAPAAEDKRGQSAPERLRKVLMLLATFAASVTYVAGLSAPGGFWDHPEDGHRPGDAILKGGPHDARLKAFFVCNTTAFVASLLILIMLLEKKLCFSQKVRSYEIYGFIAVTLISLLGAYAAGSSRQIDTTIYVSALVGAVAVCILIQVVFVLLFQTNSSQGQQTPTQGPLTNNGNGSDEHQQTQGPQTSMDSKDRDEQQQQTHGLQTSDDNVSDHQQQQQQQTQSPQTSNGNGNASDEHEKQQNPALEKARSLVLLLATLAAAITYQAGLNPPGGLWQSNGRLYKIGDPILLTTNPRRYKAFYYCNSVAFVASLVAVMLVRKKTLHHHNALEAAMVLDLFGLIGAYAAGSCRDVSTSIYAMALAGAVLVYVVIHVVFLTLDEKDGSSARRNDDASFEEREKKEAGLVEKRRKRLLLFAILAATITYQAGLTPPGGFLVQDDNRTGRHAGDAVLLNNYPRRYTAFFYCNSVSFMLSIALIILLVNPNLYRPAIRSNALSVCTAAGLIGIMGGYAAGCTQHLKTSIYIFVLAAVVLSTVVFLAAVFLVIHLRKKDDNANSTNRAAAREAPGEEQEANAGAGVPNAMGGEQRGPQGAKARRKEKRAHAKRKYLMLLGILVASVTYQAGLAPPGGAWQSNDGTHTAGDPVMHDYRRARYLAFFYSNSTSFVASVVVVVLLLPESLHKKWWWLGVMNATIVLDLLGLLIAYAAGSSRTWKTSVVVSALVLAVLAYFAIHVLLSSCVRRGKKTAPDSPSPPQDQENREENEAATKEVELQGPAC

SEQ ID NO: 68887 - DNA, 434 bp, Zea mays
  misc_feature: Ceres CLONE 1545894
gactcccgcggtggcggccgctctaactgtggatcccccgggctgcaggaattcgtctcacccctagaaaaacatacatatatgtatgtgtgtgggtgccttgcgtgggcttggcgtgatgatgtcataaataaaagaaggtggggtgtgccttgccggtattcatggaatgggccatgggattctgaaacccccttggaccttttggaaatccttttccctttaagggcctttcccggggggaaacctttcccaaaaaattggggaaaaaaaaaacctctttaaaaaaaaaaaataaattttcccccccccccccccccagggggttttggggcccctttttgcccccttttaaaaaaaaaaacccttttttttttaccaccccccccccccatttaaaaaaaaaaaaaaatttttgggggggggcacaaaaa

SEQ ID NO: 68888 - DNA, 654 bp, Zea mays
  misc_feature: Ceres CLONE 1545897
ctccccgcggtggcggccgctctagaactagtggatcccccgggctgcaggaattcgtctcacccctagaaaaactccccaactcggcaactccgcctcccgagtcacgcccccgctccctcgctcaccggacgaactagcggacctggcaaagccgagccggaaccgctaagatcttgcgtggactccttttcccagatcgtcactgtgccgctcgtgccctccactcccggtccgcccaatcaataatccatccatccgtccaccaccaccacgccgctgcggagatgtgcggcggcaccatcctctcgggtttcatcccgccgtccggggtggcggacactaccgcggcgggctagaacaacagcagcagcggtgccgtgtgactgcgcgactgctctggccagggcccggcacttacgaaactccccaggagcagcaggaggacttactagacctacttcagctagtcagaacgaggccctccgcgaggatgacgtgggacggcgctggttaaagcggggacccccaagtccgggaggttccttccgccggaaccaactaagtttgccctttcccccccaaggcaaagggaacccttttattgcctgagtttccaaaaaccccaagaggtggcaaaggggaaaaaaaaaa

SEQ ID NO: 68889 - DNA, 687 bp, Zea mays
  misc_feature: Ceres CLONE 1545899
  misc_feature: SWISSPROT Homolog: EC 3.2.1.23 Beta-galactosidase
  misc_feature (533)..(533): n is a, c, t, g, unknown, or other
ggagctcaccgcggtggcggccgctctagactagtggatcccccgggctgcaggaattcgtctcacccctagaaaaaaaaaaaataagtatatctcatctttagctttcttattgaggattgtcacttaagctagcatgtattttaaaacttataaatgttttatacattcaaattgtaattcttttgaatcacttgcttttgtaatcaactctgatgatatacattgtaatcttgttataacttgtaaatgttgtaacttgtaaccattttgtaataaagaatttccgctacaaaaaaaaaaaaaaaaacgagacgctcgaggtacccaattcgccctatagtgagtcgtattacgcgcgctcactggccgtcgttatacaacgtcgtgactgggaaaaccctgacgttacccaacataatcgccttgcagcacatccccctttcgccagctggcgtaatagcgaagaggcccgcaccgatcgccctttccaacagttgccaagctgaatggcaaatgaaattgtaagcgtnaatattttgtaaaattcgcgtaaatttttgttaaatcacttcatttttttaccaaaaggccaaatcggcaaaatccttttaattcaaaaaatcacccaaaaagggtttaaggttgttcccctttgaaacaagatccctttttaaaaaaaggggc

SEQ ID NO: 68890 - DNA, 644 bp, Zea mays
  misc_feature: Ceres CLONE 1545900
ggagctccccgcggtggcggccgctctagaactagtggatcccccgggctgcaggaattcgtctcacccctaaaaaaaaaaactcagctctcactttaactcctatccgctagcggcgccgggaagcgtgccgtacaaagctgctcaagccgttatccaaaaccaaaactcacccgctgggggatcccaattcccctcttcgtgtgatccattccccgcacgcattaggccgattttttccaaggggcgtactaggaaaaaccgtggagtctcctagtttaatcacctggacgaaattccccatttccccgtctgggtaaatcccaaaaaggcccgccccgttcgccattcccaatatttgccaatcctgaatggaaaaagaaaataaaaagcgataatcttttggtaaaatccgcgtcaaattttggttaaaacaactcgtttttttaaccaagtaggccaaaatcggcaaaatcccttataactcaaaagaaacccccgaaatagggttgaaggttgtcccactttggaacaaaagtcctatattaaaaaaggtgaactccaatggcaaagggcaaaaaaccgtctttcagggtgatggcccactactggaaccgtcaccctaatgaagtttttgggggtca

SEQ ID NO: 68891 - DNA, 650 bp, Zea mays
  misc_feature: Ceres CLONE 1545914
  misc_feature: Encodes the peptide sequence at SEQ ID NO. 68892
ggagctccccgcggtggcggccgctctagaactagtggatcccccgggctgcaggaattcgtctcacccctagaaaaagtcgcgtcccttcctccccccaccttcctctcttctcccctcacccctttctggctttctcctccgccgaagccccgagtcctgccggaattctagatcccggaggcaacttgccacgggctcctccgctccggtcgctgaatcgtactatcgtgctctcgacagaaagcccggccgaaacccagccggaccaggaccaagccctgttcgccgtgcgcgcggtgccccgggccagatctgcgagatctgcaccgacaccgctacgcctatcacgagcctgtaggtggatgctctcgtgatctctcggaggccgcggggactgagcggcatctcggcggaggcgtagcctgcttagctggtggcctgccgagatgcagcggaacggggtggtggaatgcagcgtgtgtcgctcccgggtggtggtgccgagtccccggagcgtgtccagggcatacgacaagcaccgcagcaagatgtcgtccaagttccgcgcgctcaacgtcttcctcgttgtcggcgactgcatccttgttggtctccagcccatcctagtgttcatgtcaaaggttgat

SEQ ID NO: 68892 - protein, 67 aa, Zea mays
  misc_feature: Ceres CLONE 1545914
MQRNGVVECSVCRSRVVVPSPRSVSRAYDKHRSKMSSKFRALNVFLVVGDCILVGLQPILVFMSKVD

SEQ ID NO: 68893 - DNA, 672 bp, Zea mays
  misc_feature: Ceres CLONE 1545915
  misc_feature: SWISSPROT Homolog: EC 3.2.1.23 Beta-galactosidase
  misc_feature (380)..(380): n is a, c, t, g, unknown, or other
tccccgcggtggcggccgctctagaactagtggatcccccgggctgcaggaattcgtctcacccctagaaaaagtactagcttgctagggttcgtgtccggcggcggcgactgcagctggaacgccggcggcgcagctcagtggatgctcccatcgaccattcccagaggagcagactgttcaaccaataacggcaggtaaagtcgtcagtggatggccatgaaggccggtcagtggatgcaaaaaaaaaaaaaaaaacgagacgctcgaggtacccaattcgccctatagtgagtcgtattacgcgcgctcactggccgtcgttttacaacgtcgtgactgggaaaaccctggcgttacccaagggaggggccgtgcancacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgtttaatcacctcatttttttaacccataggccgaaatcggcaaaatcccttttaaatcaaaaaaataaaccgagatagggttgaaaggctgttccaatttaggaaaaaggagtccccctattaaaggaacgggggacttccaacgtccaaaggggcg

SEQ ID NO: 68894 - DNA, 674 bp, Zea mays
  misc_feature: Ceres CLONE 1545920
  misc_feature: Encodes the peptide sequence at SEQ ID NO. 68895
  misc_feature (624)..(624): n is a, c, t, g, unknown, or other
gcggtggcggccgctctagaactagtggatcccccgggctgcaggaattcgtctcacccctagaaaaagcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtaccggatgtcgcaggtgaacatcgagggcaatgggtgcgggcgggcgctgccgccacagccgaccgtgaaggtgtactgacgcgccaaccccaactacgccatgagcgtccgcgactggaaggtggtgctggggccggcgaaccccaaggaacgaataccagccctggatcaaggaacatgcggtggagcaccaccatccaggacgagaaaggtaaccccgggcgttcgcgctggtgaacaaggcgaccggggaaggcctcaagcccctccctgggggcagtcccaccccggggccccctggtggccctacaacccggaaactttttggaacaaacccgccgcttgtggaacggaaaancccgggaagttccggagaaaggggttttccgctggggttcccgcatggtt

SEQ ID NO: 68895 - protein, 59 aa, Zea mays
  misc_feature: Ceres CLONE 1545920
MDGGYYGGRDQRYSGGYYGGGGIATPGYAPAVPYRMSQVNIEGNGCGRALPPQPTVKVY

SEQ ID NO: 68896 - DNA, 632 bp, Zea mays
  misc_feature: Ceres CLONE 1545921
  misc_feature: Encodes the peptide sequence at SEQ ID NO. 68897
  misc_feature (331)..(331): n is a, c, t, g, unknown, or other
  misc_feature (355)..(355): n is a, c, t, g, unknown, or other
  misc_feature (414)..(414): n is a, c, t, g, unknown, or other
ggatcccccgggctgcaggaattcgtctcacccctagaaaaaatcccacagctcatataccagagccggagcagcttagcgcagcccagagcggcgccgcgccaagcacaacccccacccgccacagccgcgtgcgcatgtgagcggtcgccgcggccgggagaccagaggaggggaggactacgtgcatttcgctgtgccgccgccgcggggttcgtgcgcgagcgagatccggcggggcggggcggggggcctgatatggaggctagcgcggggctggtggccggctcgcataaccggaacgagctggtggtgatccgccgcgaccgcnattcgggagccgcgggccgcggcncggcgccgcgggccgaagccccgtgccaaatatgcggggaccaggtcggggtggcctcnaccgggagccctttcgggccgtgggaaaatggggctttccccgtttgccccccctggtacaaattacaaaccgcccgagggcccccaaggtgtgcccccatggcagggacccccttaaaagcgcccccaagggcctcccccccggggggcccgggcaccagagagggggagacggcgccccccaaccccggggggggggagttccccccctggagggc

SEQ ID NO: 68897 - protein, 124 aa, Zea mays
  misc_feature: Ceres CLONE 1545921
  misc_feature: SWISSPROT Homolog: EC 2.4.1.12 Cellulose synthase (UDP-forming)
  misc_feature (25)..(25): Xaa is any aa, unknown, or other
  misc_feature (33)..(33): Xaa is any aa, unknown, or other
MEASAGLVAGSHNRNELVVIRRDRXSGAAGRGXAPRAEAPCQICGDQVGVASTGSPFGPWENGAFPVCPPWYKLQTARGPPRCAPMAGTPLKAPPRASPPGGPGTREGETAPPNPGGGEFPPWR

SEQ ID NO: 68898 - DNA, 665 bp, Zea mays
  misc_feature: Ceres CLONE 1545924
  misc_feature: SWISSPROT Homolog: EC 3.2.1.23 Beta-galactosidase
  misc_feature: SWISSPROT Homolog: EC 3.2.1.21 Beta-glucosidase
tggagctcaccgcggtggcggccgctctagaactagtggatcccccgggctgcaggaattcgtctcacccctagaaaaaaaaggagtcagccaagtggttaaaagagttcaatactgcgaagaagcctagcaagaagattattacgccagcttacacacatgggacctcgtgatgtgggtacggtgccacccatgaaataaaaacctagtgtgtggtttgaaacctaaatttttctttttcttttttgcaccatgagagaggtagtggagtcatattctccagcaccgtggctaataatgtattgttgcagtacaatctagcattgtcgtcatgcaataaataaagtgactggtttccctatttcaattgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttta

SEQ ID NO: 68899 - DNA, 643 bp, Zea mays
  misc_feature: Ceres CLONE 1545932
  misc_feature: Encodes the peptide sequence at SEQ ID NO. 68900
ggcggtggcggccgctctagaactagtggatcccccgggctgcaggaattcgtctcacccctagaaaaaacaactgtcctggcctgtccacggtccacacacgccttccttatatcggcgctcacggttctataaaaaaaaacacagtacgagcagagcaaggcggccgtgagctgagctgagggaaggacgacgtacggcacagttgctagcccggccgccggagctctccgtgatcgatctgggccgccagcaacagcatgggtgccgcgctcttggcttcttggccatgggacaacctcggcttctacaagtacgtcctgtacgggccgctggtgggcaaggcggtggcgtcacgggcgtgggaggcggcgagccccgaccgctggatcctcctcctgctcctcctcttcggcctccgcgcgctcacctaccagctctggagctccttcagcaacatgctcttcgccacacgccggcgccgcgtcgtccgcgacggcgtcgacttcgaccagatcgacaaggagtgggactgggacaacttcctgatcctgcacgccctgatggcggccgcggcgctgtgcgcgttcccgtcgctgcggcatctcccggcgtgggaccggcggggggtcgccgtcgcgct

SEQ ID NO: 68900 - protein, 127 aa, Zea mays
  misc_feature: Ceres CLONE 1545932
MGAALLASWPWDNLGFYKYVLYGPLVGKAVASRAWEAASPDRWILLLLLLFGLRALTYQLWSSFSNMLFATRRRRVVRDGVDFDQIDKEWDWDNFLILHALMAAAALCAFPSLRHLPAWDRRGVAVA

SEQ ID NO: 68901 - DNA, 824 bp, Zea mays
  misc_feature: Ceres CLONE 1545935
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
nnnnnnnnnnccccnnttttttcctgcggcgcctcgccaaccaaacacctttttttttggactccccgcggtggcggccgctctagactagtggatcccccgggctgcaggaattcgtctcacccctagaaaaaaccggacccattcctccacccgccactataaatctctgtgcttcggaccagccttgattcgtccgttccagcgacgcactactgcggggaaatcccgctcccgcgttccccatcctccggccgcctcgcttcggcctccctccggatggtgtcttaaatcatggttactggccaacttttctcagatactagccaagcctgattactacaattactagcaagttcccatccaacgagatgcttgatttctgagttacttttgtgtggagagaaacaccattctgttgctgggagtattgaagtactgcgtgccgaatggtcttccagtaactttttgccttggtcccacacccacacgcgcccacttccgtggtcaattctcactttcctaatacccacgtggctgtcggccccaacccaaacaagctcgagtgtacattagtgtatctaaattcattcaaaaccaggacacgcgctgcatagctgtataacaaccgtcacagcataatagaacgccggaccaaataatacatactcacgtggtcaacccatttatcccgctccaacgctttgttcacagagaaaatttgtgacctgcccacgcaccatccgtcattatactttcctatccaacaccacgctcaaggtaggacagaaaaagcgtcaccacacgcagggccctcctgcttt

SEQ ID NO: 68902 - DNA, 666 bp, Zea mays
  misc_feature: Ceres CLONE 1545938
  misc_feature: Encodes the peptide sequence at SEQ ID NO. 68903
  misc_feature (396)..(396): n is a, c, t, g, unknown, or other
ggagctccccgcggtggcggccgctctagaactagtggatcccccgggctgcaggaattcgtctcacccctagaaaaagctctcggtgggtgggggcatggacgaggcagaggagatgcaggtggagaggctgcacgaggaggccgatgcggggggagccgacacggacaagctcagctacgagatattctccatcctcgagagcaagttcctgttcggctataccgacccgcaccagctctggctgcccaagccggcggcggaactgccggcgcaggcgtccgcggcggcgccgggtaaggcggcgcagcgcgggaaggtctgcgtgctctgcgtggacggcggcgggggcggcctgcaggcgctgctgccaggccgcgcgctgacgcacctggnagccgcgctgcgccgcgcgtcgggggaacccgacgcccgcgtcgccgactacttcgacctcgtcgcgggcacgggcgcgggctgcgtgttcgccgcgattgttcttctcaaggactttgggcggggccgcgcctgtcccagcccgaaaaaccgggggcgtttcttccggaaccacccccccggcatgttccgaaggccccggggctccctgtccaagtcccttttttggccggggaaaaaaggggacccggggccggccaaagggggggc

SEQ ID NO: 68903 - protein, 189 aa, Zea mays
  misc_feature: Ceres CLONE 1545938
  misc_feature (100)..(100): Xaa is any aa, unknown, or other
MDEAEEMQVERLHEEADAGGADTDKLSYEIFSILESKFLFGYTDPHQLWLPKPAAELPAQASAAAPGKAAQRGKVCVLCVDGGGGGLQALLPGRALTHLXAALRRASGEPDARVADYFDLVAGTGAGCVFAAIVLLKDFGRGRACPSPKNRGRFFRNHPPGMFRRPRGSLSKSLFWPGKKGDPGPAKGG

SEQ ID NO: 68904 - DNA, 628 bp, Zea mays
  misc_feature: Ceres CLONE 1545940
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (429)..(429): n is a, c, t, g, unknown, or other
  misc_feature (430)..(430): n is a, c, t, g, unknown, or other
  misc_feature (442)..(442): n is a, c, t, g, unknown, or other
  misc_feature (449)..(449): n is a, c, t, g, unknown, or other
  misc_feature (456)..(456): n is a, c, t, g, unknown, or other
  misc_feature (459)..(459): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (542)..(542): n is a, c, t, g, unknown, or other
  misc_feature (559)..(559): n is a, c, t, g, unknown, or other
  misc_feature (582)..(582): n is a, c, t, g, unknown, or other
  misc_feature (583)..(583): n is a, c, t, g, unknown, or other
  misc_feature (600)..(600): n is a, c, t, g, unknown, or other
  misc_feature (601)..(601): n is a, c, t, g, unknown, or other
ggatcccccgggctgcaggaattcgtctcacccctagaaaaaaccactcatcaccagctagtagctctagcaaagcacttgccatctaccgactgccgcattccaaacagcccgacgagcttgcatagcggcgggccccctcctccaagaaaatggccccccacgcaactttttgcaaaaatggccaaaggcctgggtggcccttgggcttcttggggcggggcaacatagaaggcggacattacctcccgggaggtggggttttggattttggggccgggtttttttttagccatgggggggggggtagaggctcccccacataatttttaaggggtgtttggggttttataaaaagggggggttctatgtgtgatcccccccccctccttttttgtgttaaaaaaaaaaacccagccccagnnntgnngggtcccctctntccgttntacaagnagnccccgcccccaccgggggggagggcaaaccacaccacattatannnntctccccccccccccatctgtgaatggggaggaatnaacacaaagaaaaaacnaaacactaacttcccctcacggnngggccgccgcaccccanntcctcatcacaccacccctcccccccc

SEQ ID NO: 68905 - DNA, 619 bp, Zea mays
  misc_feature: Ceres CLONE 1545948
  misc_feature: Encodes the peptide sequence at SEQ ID NO. 68906
tggagctccccgcggtggcggccgctctagaactagtggatcccccgggctgcaggaattcgtctcacccctagaaaaaaggcgcgcggtttccaggcggttcctcctccagactctagagaaagaaggcgcatcgtgagcgagagagagagaggctatggcgtcggcgacgttcctggaggtgctcctcgccatcttcctcccgccggtcggcgtcttccttcgctacggctgcggcgtggagttctggatcgacctcttgctgaccgtgctggggtacattccggggatcatctacgccgtgtacgtgctggtggcttaagttgtgcgaagaggaggacatgaagactctcgatctgtccagaagtacgtagtgatgtgaggacttctcccagtcccagtgtgcatgtctgtctcgattacgcgaattaggagtgactatcggctgatgttgttaataaaacgtgtgtgggtgctgcaagcacagttgtgtacaaaaaaaaaaaaaaatgagacgctcgaggtacccaattcgccctatagtgagtcgtattacgcgcgctcactggccgtcgttttacatcgtcgtgactgggaaaaccctgacgtttcccaactt

SEQ ID NO: 68906 - protein, 54 aa, Zea mays; identical to SEQ ID NO: 64576
  misc_feature: Ceres CLONE 1545948
  misc_feature (4)..(54): Pfam Name: UPF0057 Pfam Description: Uncharacterized protein family UPF0057

SEQ ID NO: 68907 - DNA, 639 bp, Zea mays
  misc_feature: Ceres CLONE 1545954
  misc_feature: Encodes the peptide sequence at SEQ ID NO. 68908
  misc_feature (499)..(499): n is a, c, t, g, unknown, or other
ctccccgcggtggcggccgctctagaactagtggatcccccgggctgcaggaattcgtctcacccctagaaaaatcacatgccattgccaacctctcactgctcgtaccgcctctccactccacctgctgcccctgcgccctgaccgcgaggggagggcgctgagctaccaaggaagccaaccggcgcggaccgggtcggtcaacgcttgctgtgcacccgaccgaggaagctaggaggatcgagcacggacatgttggcctcggcgtcggtgccggccgtctaggaaaagctcgcccgcagaggtaatggatgggcggaagaggggcggcggaactatggcgtggctgctgctgcttctcgcctcgctgtgcaccggcgcgtgcgggctcaaatgcgacggggtgctgctcatgtccttcagaacacggtcacccgcgacccgctgggcgcgctggccggctggatctacagcgacgccgcgccgtgcgcctggaacngcgtcatctgcaacggcttcccgcaggacgacaccgcgccggcggcggcgtacgtgacctcggcctccgcccgacggcacggcaccgcgacggtcgcgcgcaccccaccggagcaaccgcggcggccgccctcggcgcgt

SEQ ID NO: 68908 - protein, 82 aa, Zea mays
  misc_feature: Ceres CLONE 1545954
  misc_feature (36)..(36): Xaa is any aa, unknown, or other
MRRGAAHVLQNTVTRDPLGALAGWIYSDAAPCAWNXVICNGFPQDDTAPAAAYVTSASARRHGTATVARTPPEQPRRPPSAR

SEQ ID NO: 68909 - DNA, 661 bp, Zea mays
  misc_feature: Ceres CLONE 1545958
ggagctccccgcggtggcggccgctctagaactagtggatcccccgggctgcaggaattcgtctcacccctagaaaaagtcaagtgtcaacccaaccgtccacggtccgccctcctccttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgcacgaatagtgtgggggggggctacctttcattgcaattaccaacaactcgaaatggacgatgataatgggcttgagcttagtttgggcccttcctttggcgggtcatcagggaaggccaaggctagagatgcacctctagaaccaaaagcagaaccccccaggggaaagaaagcagtagccaaagggggttttacaaactcccggatcgcccttcctggcaaaatttaaccaaaagaacccctgaaaacccacggaccaaaatagtaaacaaaaggccccggccctggttggcacagaag

SEQ ID NO: 68910 - DNA, 631 bp, Zea mays
  misc_feature: Ceres CLONE 1545963
  misc_feature (566)..(566): n is a, c, t, g, unknown, or other
  misc_feature (631)..(631): n is a, c, t, g, unknown, or other
tccccgcggtggcggccgctctagaactagtggatcccccgggctgcaggaattcgtctccccctagaaaaatacacagtcgactctgtctgaaaccggtagttggactagctgctggagtgtggaggaagacttggggaagctgccttcatatagcgggctagtggagcccaacgctcgccattgcaagcccttcccggttactgttccctagcaaggtcgggaccgcatggcccttggacctgcttaccatccctacttggagctccccgggaaccctggcccccccacaaaggattgttccccgggggaatttttttcccccggaacccccctaatatccccaagggaaaaccgcaaaccctctggcaagaaagttaagggcaccccgggttttcttcccctttttcccccgggaaaagtgcccttttagggccccccctccctatgtggggcccaaaacctaatttttttttgggggtcttctcaccccaaaacggggataaacgcccgtcttttcctctctgaaagggaccccccccccccccttttttttcccccccccngggaccgcaaaaaaacattgtttatcacaaaaaaaaactttttttttatcgcagcccgccacgan

SEQ ID NO: 68911 - DNA, 642 bp, Zea mays
  misc_feature: Ceres CLONE 1545967
  misc_feature: Encodes the peptide sequence at SEQ ID NO. 68912
agctggagctcagcgtcggtggcggccgctatagaacataaggatcccccgggctgcaggaattcgtctcacccctagaaaaaacacccacaccacacctcacgtctcctcactacccgcgctctcaggcagcgcacctcgctcctcctcccccacagcgctttccattttcgtctatctcccgagaaccctcctgcgcctcccaaagctctcttgttcgttgctccccccccccccccccccgtgctggttaatcatccccttcgatttcgatcacatacatataatctctctcagctatcgcggccgcgcgcctgatcgacgtacgaccggtctggtacgtacgtgtgctcgcccgccatggctcgcggcgacggcgagctggagctgtccgtgggggtccgcggcaccggcggcgcggcggcggcggcggcggaccacgtggcgccgatcagcctcggcaggctcatcctcgccggcatggtcgccggcggcgtgcagtacggctgggcgctgcagctctccctcctcacgccctacgtgcagactctggggctctcacatgccctcacttcattcatgtggctatgcggtcctattgctggcttagtggtccaaccgctggttggcctgtacagcgat

SEQ ID NO: 68912 - protein, 94 aa, Zea mays
  misc_feature: Ceres CLONE 1545967
MARGDGELELSVGVRGTGGAAAAAADHVAPISLGRLILAGMVAGGVQYGWALQLSLLTPYVQTLGLSHALTSFMWLCGPIAGLVVQPLVGLYSD

SEQ ID NO: 68913 - DNA, 563 bp, Zea mays
  misc_feature: Ceres CLONE 1545968
  misc_feature (162)..(162): n is a, c, t, g, unknown, or other
tccccgcggtggcggccgctctagaactagtggatcccccgggctgcaggaattcgtctcacccctagaaaattattagctcgctgcgggggtcgaaccgaggctcctagctgatcgcgcgcgcacaggggcgagcggacaagaaagcttgctttgtgctcnacggcggcacggaccccctgcgatggtagccgtcggcgtcatcctgcccccgtggcggccccgaaaaaaaaaactgcttgacctcaggaccccttcccgcccccggaaaggggggcccaagggttcccgggggggaaaagggggaattaaaaaaaattggggggggggaaacccggtacaatgtttagggaagttgcccccccccgggttttttgccccccctccccaaaatcccaaactcttcccaaaaaacccggggttttttttccttaaaaaaattttttttcaaccccaaaaaaaccccccccaaaaaaaatttttgttttaaaaaaaggggggggggggccccccttttttgggggggggcgccccaccgggggggtttctcccccccaaaagag

SEQ ID NO: 68914 - DNA, 617 bp, Zea mays
  misc_feature: Ceres CLONE 1545970
  misc_feature: Translation starting site: 149
ggagctccccgcggtggcggccgctctagaactagtggatcccccgggctgcaggaattcgtctcacccctagaaaaaaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggcctgagcgtgagaaagtatcaccatgatattgctctgtggaaagttgagacaccagtactactgcacgtcattgatgcccctggacaccgtgacttcatcaagaacatgatcactggtacctcccaggctgactgggctggccttatcattgaccccccaccacctggggggggtttttgaaaggctgggttatccccccaaggaatgggccaaaaaccgcgggaaaaagggcctccccttttgggtttcaccccttggaagtaaaaaccaaaaaa

SEQ ID NO: 68915 - DNA, 574 bp, Zea mays
  misc_feature: Ceres CLONE 1545972
  misc_feature (282)..(282): n is a, c, t, g, unknown, or other
  misc_feature (292)..(292): n is a, c, t, g, unknown, or other
ctccccgcggtggcggccgctctagaactagtggatcccccgggctgcaggaattcgtctcacccctagaaaaaactgtctcccctgtcccctctcccgcgtgctcgtctaccttcggctcccccatgggatgagagcgccttcctcgccatggccgcctcccacctgccccccgcagccaccctcgtcaagaagtacccaactgctcctgccaccccgtgtcgggcgccataacccacacggccccaagaggctgatcttcaggtgccgcgcgaccagcancgtaggtgcngacgatagctgggcgtcctttgtggacaacctcagaagtcgctgcaggtggaccccgtccaacgcgtgattagcaacccggcccgggtctcaatcaataagaactcgtcacgggctgccactgaaacctcccgctggtcgggtgggggaaaacgaacactgcccctgccgggcgggataacagcccctggggctggaaccctcaggggcggtggccccccccaaccccccccggagatccccggggggccctgggagggtccaaacccggggggggaggggg

SEQ ID NO: 68916 - DNA, 883 bp, Zea mays
  misc_feature: Ceres CLONE 1545975-R
  misc_feature: Translation starting site: 280
attggggtactcgagcgtctcgtttttttttttttttttagaaatttaaaccatgcatttttattgtttcaccacaattccatcttctcttattcgttctgacagcagcaggagaccccacgagtggcccccacgtgacagagcacacggcatggcgtagctgtggcatggtgctacacgaacacgacacactaacgagacagattaaagctaaccgatcgaagggaattcattcgtccaacaacaacaaagtcccagattaaaagaagaaaccccgtgatggcgccggcccagataagacgctgcttgcatgctggcgcgtggatgctcgctcaggcgtccacgacctcgtcgtccttggacgcaatgaagaactcctcgcgcagcgccggcgacacctcggggatggtgccgtccacggcgttgggcctgcccagtgccttcagcgccaggtgcgccgccttctggccggagatcatcatggcgccgaacgtcgggcccatccttcgggcgccgtcgatctcggcgacctccatcccggtgacaattatgcccgggcacaacctcgcgcgtgaagcgcacaatctccgtcctcggggggctttcatgtgcgaaggcccttcacccgggggacggcgccttatacatgccgaatgtcctgggaagcctctttgaatccccgtgggggcccaaaagggcccctcccggggccgccaggaagcttgaacccccacccttgggcctcccattcacggttggggggtcccctggcaccgaaatgggcgtgttctggggggttccaaggggaaacccaatacggcccccaaatttggtggggaaaaaggacggctgccctaaaaagggggccgccgcgggagggaat

SEQ ID NO: 68917 - DNA, 638 bp, Zea mays
  misc_feature: Ceres CLONE 1545975
  misc_feature: Encodes the peptide sequence at SEQ ID NO. 68918
  misc_feature (449)..(449): n is a, c, t, g, unknown, or other
gcggtggcggccgctctagaactagtggatcccccgggctgcaggaattcgtctcacccctagaaaaatccgggagcttagacacctgtaggctagcgcattgttctcaaggtcagagcttcgccgaggaggcgaggacgatggcaatcgccgggcagtgctcctcctgctattatacgtcacccaccctgcagctccagctccaccgacggcacagccacctgccgcggcagccccaagccgcacgaagagcgcggcggccgaggttgcaggtggccgcagctgccggcagcgggcccatcagggcggccacggataccgagttcttccagccttccgacaccaggccaatcatgctcttcgacggcgtctgcaacctctgcaacggcggcgtccgcttcgtgcgggagcacgaccccaacaggagcatcaggtacgtgccgctgcanagcgagtccgggaggaagctcctgcagaggtcaggaaggtcccctgacgacatctccagcgttgttctcgtcgagaaagacaggtctttcatcaagtctgaagcggtgctgaggataatggagtacctcaacctgcccttcccgcagcttgcccgtcttcctcaagttcgtccccctctgtcctgaagg

SEQ ID NO: 68918 - protein, 164 aa, Zea mays
  misc_feature: Ceres CLONE 1545975
  misc_feature (65)..(161): Pfam Name: DUF393 Pfam Description: Protein of unknown function, DUF393
  misc_feature (103)..(103): Xaa is any aa, unknown, or other
MAIAGQCSSCYYTSPTLQLQLHRRHSHLPRQPQAARRARRPRLQVAAAAGSGPIRAATDTEFFQPSDTRPIMLFDGVCNLCNGGVRFVREHDPNRSIRYVPLXSESGRKLLQRSGRSPDDISSVVLVEKDRSFIKSEAVLRIMEYLNLPFPQLARLPQVRPPLS

SEQ ID NO: 68919 - DNA, 653 bp, Zea mays
  misc_feature: Ceres CLONE 1545976
  misc_feature: Encodes the peptide sequence at SEQ ID NO. 68920
tccccgcggtggcggccgctctagatctagtggatcccccgggctgcaggaattcgtctcacccctagaaaaactagaaaaaacccccgcccttctcaccccccgaaaaaattcccccggaaatcagagacgcgaatccctccctcgccccacgtccgaggtcgctcgccaattcgatccgcctcatcgtcgcccgcccgcccgtccgccggtcgaccttgactgctccgtcgcacgtggcgtttcgcagcgcggaatctaccctgggttgggttgggagatccggggaaacccttgttcccgggcgctccgggctcgaatctcgctgcagacgggcaatgtgagcgctctccatcggagagggacgatctgcggggcggttgttggccgggtgaatcgtgcggtgcggggttgcgggaatggagcacgtgatcggagggaagtttaagcttgggaagaagatcgggagcggatctttcggggagctctatctcggtgtgaacgtacagagcggcgaggaggtggctatcaagttggaatctgtaaaatcaaggcatcctcggcttcattatgagtcaaaactatacatgcttctccaagggggaactgggaattcctcatttgaaatggtttggagtgggatgggggagtac

SEQ ID NO: 68920 - protein, 78 aa, Zea mays
  misc_feature: Ceres CLONE 1545976
  misc_feature: SWISSPROT Homolog: EC 2.7.11.1 Non-specific serine/threonine protein kinase
MEHVIGGKFKLGKKIGSGSFGELYLGVNVQSGEEVAIKLESVKSRHPRLHYESKLYMLLQGGTGNSSFEMVWSGMGEY

SEQ ID NO: 68921 - DNA, 631 bp, Zea mays
  misc_feature: Ceres CLONE 1545977
  misc_feature: Encodes the peptide sequence at SEQ ID NO. 68922
cgctctagaactagtggatcccccgggctgcaggaattcgtctcacccctagaaaaacctagaaaaaagcctcctcgcaggcgaccttgcgtacgtacgtcgtagcggatcgtccagctcgctcgccaccgccatggacccgtacaagcatcgcccgtcgagcgccttcaacgccccgtactggaccaccaactccggcgcccccgtgtggaacaacgacagctccctcaccgtcggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactggggacctggtggggcacaacttccccgtcttcttcatccgcgacggcatcaagttccccgacatggtgcacgcgctccagccaaacccgcggacgcacat

SEQ ID NO: 68922 - protein, 166 aa, Zea mays
  misc_feature: Ceres CLONE 1545977
  misc_feature (18)..(166): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWGPGGAQLPRLLHPRRHQVPRHGARAPAKPADAH

SEQ ID NO: 68923 - DNA, 636 bp, Zea mays
  misc_feature: Ceres CLONE 1545985
  misc_feature: Encodes the peptide sequence at SEQ ID NO. 68924
agctccccgcggtggcggccgctctagaactagtggatcccccgggctgcaggaattcgtctcacccctagaaaaaagaccagagcaaaaacccaccgttcccacacccagcgctcaatttgaaccaacgcgaacgcgacgctctcaagccccaacctaatctacgatctccctccgaccgaaacgaaatctccgcctcccctgcgcccctgccctgcgcccctgcataggaggaaagaaacgcacgcacgcacgccccccgcggcaaagggaaccgtcgccgcgttgcgagagtccgggaaactgaagcggagcagcggaggagaggccgaggccaggaggagagggtaccggcggccatggagcggtaccatccctcagaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcggtggcggccctgtccgaccacggtgtctgcgtccgcaagggctacatctcctccgacgacggccgctggttcatggacgtgttccacgtgaccgacgccgcgggccgcaaggtggccgacgccgacgccg

SEQ ID NO: 68924 - protein, 92 aa, Zea mays
  misc_feature: Ceres CLONE 1545985
  misc_feature: SWISSPROT Homolog: EC 2.7.7.59 [Protein-PII] uridylyltransferase
MERYHPSEVYELFVRHMNTPRVVVDNGVCATATLVQVHSARKHGVLLEAVAALSDHGVCVRKGYISSDDGRWFMDVFHVTDAAGRKVADADA

SEQ ID NO: 68925 - DNA, 686 bp, Zea mays
  misc_feature: Ceres CLONE 1545987
  misc_feature (306)..(306): n is a, c, t, g, unknown, or other
  misc_feature (307)..(307): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (406)..(406): n is a, c, t, g, unknown, or other
  misc_feature (410)..(410): n is a, c, t, g, unknown, or other
  misc_feature (411)..(411): n is a, c, t, g, unknown, or other
  misc_feature (477)..(477): n is a, c, t, g, unknown, or other
  misc_feature (478)..(478): n is a, c, t, g, unknown, or other
  misc_feature (576)..(576): n is a, c, t, g, unknown, or other
  misc_feature (592)..(592): n is a, c, t, g, unknown, or other
  misc_feature (593)..(593): n is a, c, t, g, unknown, or other
  misc_feature (606)..(606): n is a, c, t, g, unknown, or other
  misc_feature (614)..(614): n is a, c, t, g, unknown, or other
  misc_feature (629)..(629): n is a, c, t, g, unknown, or other
  misc_feature (630)..(630): n is a, c, t, g, unknown, or other
  misc_feature (648)..(648): n is a, c, t, g, unknown, or other
  misc_feature (651)..(651): n is a, c, t, g, unknown, or other
  misc_feature (652)..(652): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
tatccgcggtggcggccgctctagaactagtggatcccccgggctgcaggaattcgtctcacccctagaaaaaaccgtgccgagactgccgactaccgacagacacggtggtctgccactgccagtctgccactgccaggcgccgtcctgcagagatggcagcggcgctgaagcccaagctgctcgtgctgctccgcgggggcggccgccgcaacggggccgtcgtggcgccgcccccgggcgcgtcgacctgtgggcaatggccggcgtcggtcccccctccgcccggaaaaagcttcttgttannaaggacctcttggttgtcacgggccgggaacaactacccccacgggtttttgtctcccccccccaaggggggagggagggagggnnnnccnnnnntnancctnnacccccccccttaaagggaacatacccccgggggcccccccccggccgggccggggtgtccccttnnccctcccccttcccccaaaaaaagaaactcacatttcggggggggatagaatccccaacgggtttgtccggggccccacccccgggggaaatcccccnttttcccccccatatnnaggttttaaaaanatttaagngggggccgtctttcnngggcgggggaccaccctnacnntgtggctcctcccccaccttggagaggcncnngg

SEQ ID NO: 68926 - DNA, 668 bp, Zea mays
  misc_feature: Ceres CLONE 1545988
  misc_feature: Encodes the peptide sequence at SEQ ID NO. 68927
  misc_feature (616)..(616): n is a, c, t, g, unknown, or other
ctccccgcggtggcggccgctctagaactagtggatcccccgggctgcaggaattcgtctcacccctagaaaaaccgtgccgagactgccgactaccgacagacacggtggtctgccactgccagtctgccactgccaggcgccgtcctgcagagatggcagcggcgctgaggccgaggctgctcgtgctgctcgcggtggcggccgcggcgaccgggccgtcgtgcgccggcgccggccgcgtcgacctgtggccaatgccggcgtcggtcgcccgcggcgcgcagacgctcctcgtcagcaaggacctcaagctgtccacggccgggagcagctaccccgacagcaatggcatcctcacggaagcgttccggcagatggtggcccgtcgtggacctgggaccaccccatcaacgggaacctactcccggggcgcgcccgtggctcgcccggcttccacgtccccggtccgctccccccaaagaagaacctcaacctccggggtggatgaaatcctaccaggttggcctggggcccccccccggggggattccccttgtttccccccaaatcgagaggcccaaaaaagttttaaagaaaaccctcctcttggccntgggagaaaaaatttttgtgccaccatggggcccccctttttaaacctttac

SEQ ID NO: 68927 - protein, 171 aa, Zea mays
  misc_feature: Ceres CLONE 1545988
  misc_feature (154)..(154): Xaa is any aa, unknown, or other
MAAALRPRLLVLLAVAAAATGPSCAGAGRVDLWPMPASVARGAQTLLVSKDLKLSTAGSSYPDSNGILTEAFRQMVARRGPGTTPSTGTYSRGAPVARPASTSPVRSPQRRTSTSGVDEILPGWPGAPPRGDSPCFPPNREAQKSFKENPPLGXGRKNFCATMGPPFLNLY

SEQ ID NO: 68928 - DNA, 634 bp, Zea mays
  misc_feature: Ceres CLONE 1545989
  misc_feature: Translation starting site: 195
  misc_feature: Pfam Name: DXP_reductoisom Pfam Description: 1-deoxy-D-xylulose 5-phosphate reductoisomerase
  misc_feature: SWISSPROT Homolog: EC 1.1.1.267 1-deoxy-D-xylulose-5-phosphate reductoisomerase
  misc_feature (456)..(456): n is a, c, t, g, unknown, or other
  misc_feature (477)..(477): n is a, c, t, g, unknown, or other
ctccccgcggtggcggccgctctagaactagtggatcccccgggctgcaggaattcgtctcacccctagaaaaatccatccccgtcgccagcatcgcttccacttcggtctcagcgacggtcgccaccaccgctcccctccctctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagctatttcactgagaaggacatgctgttctatgcaacaggctccaccaccagcatggcctgagcgagctgttgctgatcctggccggaggtcatgggatggcccaaagcctatctcgattagttggtcaactgggtccatangaacacagacattggacattngtgcagagaatcctgataagttcagagttgtttgctcttgctgctggatccaatgtcacgcttctagctgatcaagtcaaaacattcaaccctagttgggttgctgtaagaaacgaaatcattagttgatgaattgaaagaaagccttggctgattg

SEQ ID NO: 68929 - DNA, 681 bp, Zea mays
  misc_feature: Ceres CLONE 1545990
  misc_feature: Translation starting site: 213
  misc_feature (444)..(444): n is a, c, t, g, unknown, or other
  misc_feature (471)..(471): n is a, c, t, g, unknown, or other
  misc_feature (657)..(657): n is a, c, t, g, unknown, or other
  misc_feature (659)..(659): n is a, c, t, g, unknown, or other
tccccgcggtggcggccgctctattactagtggatcccccgggctgcaggaattcgtctcacccctagaaaaaaacctcacgccatttcccagcctgaacagcccccaaaaccaaacgaaaatcccatcgcccacacactccaatccacccttgttcattcctctcccttcctacttggtcagtcgacctctcaccgcaccgccgtcggcccatggcgaccacgaccttccccacctcgaccccattcttcgcggcccaccacggtccccgccggagccgaccctccatctccgccgcggtctacgcccgcggccgccgatggcgcccgctgcgggtggcgtgcgagaaggtggtaggcatcgacctgggcaccaccaactccgcggtggccgcctatggagggcggcaagcccacgattgttaccaacgcataggggtcgcgnaccaccccctcggtggggggcgtaacnaagttcaggaaacccgcctccttggccagattcgcaaagcgccctgcccggggtccaaccccggaaaacaactttcttccccccgcaaagcgctttcatccagcctcccaagaagaaacaaaggtcccacgaagaagtcccaggccagcgtccccttatctcggccctccgaggggagccacaaancngtccaccctcacagcctccgta

SEQ ID NO: 68930 - DNA, 2081 bp, Zea mays
  misc_feature: Ceres CLONE 1545991
  misc_feature: Encodes the peptide sequence at SEQ ID NO. 68931
aaatcgcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccggcggcggcggcggcgacgacgacgacgaggggcagggccgacgacggcgacgccggcgggccatcgagggccgtcaccggcgcggtggaggatccggaggccgtggccaacgacgtgcacgtgtccatcaggaacagcacggcccggcgaaacctcgggtacctgtcgtgcgggacaggcaacccgatcgacgactgctggcgctgcgactcggactggcacagcaaccggcagcggctggccgactgcggcatcgggttcggccgcaacgccatcggcggccgcgacggcaaggtgtacgtggtgacggacccgagcgacgacgaccccgtgaacccgcgcgagggcaccctccggcacgccgtcatccaggaggagccgctgtggatcatcttcaagcgggacatggtgatcacgctgagggaggagctcatcatgaacagcttcaagaccatcgacgggcgcggcgccaacgtgcacatcgccaacggcgcctgcgtcaccatccagtacgtgaccaacgtcatcatccacgggctccacatccacgactgcaggcccacggggaacgccatggtgcgcagctccccgagccactacggctggcgcaccatggccgacggggacggcgtgtccatctttggttccagccacgtctgggtggaccactgctcgctctccaactgcgccgacggcctcatcgacgctatcatgggatccacggccatcactctgtccaacaactacttcacccaccacaacgaggtgatgctccttggccacagtgactcctatgtgaaggacaaggcgatgcaggtgacaatagccttcaaccatttcggcgaaggcctcattcagagaatgccaaggtgccggcacggctacttccacgttgtgaacaacgactacacccactgggagatgtacgccattgggggcagcgcggagccaaccatcaacagccagggcaatcgctaccttgctccgacgaacccgttcgccaaggaggtgaccaagagggtggagactgcccagaccgtgtggaagagctggaactggaggtcagagggcgacctgctgctgaacggcgcctacttcaccccgtccggcgcgggcgcctcggccagctactcgcgcaccatcacctcggacgccggcgcactgtcgtgccgcaagggcgcggcctgctagcgcggatcgcgctccctctccaggaacaggaaaagaaacaggacaacaggaaactaagccacctcaacaccaccaccaccatggttacagtttcttcttcccttctttttaggggtcgcttttgacaagggttatattatatatatatgatggtcctccttgatattttcaccatttgctcaacctccccccctgctcccgacatggaaagctacctggagcagcaggcgtgaagcgttgctgattggtcgctcggtctctctattagtcgtctgatctgagtgttgcgtgttgttccctctgcctacaagcaagtggtgtatgttgagggcagggggtgcgtgcgtgcgtgttgtgtgtgatacttactcacttggttgttgtgttgagaaaaaaaagggtcagattgttagtagtggtagtactacatgttacgcctggacagactgggatggaatggatgtacaagacgtggaggaatacccatgttcttaattcttcttcttcaaaaaaaaaaaaaaaaa

SEQ ID NO: 68931 - protein, 467 aa, Zea mays
  misc_feature: Ceres CLONE 1545991
  misc_feature (212)..(397): Pfam Name: Pec_lyase_C Pfam Description: Pectate lyase
  misc_feature: SWISSPROT Homolog: EC 4.2.2.2 Pectate lyase
MAEAGCSAVRTRTAGLAAAAAAAAALLVLVVVAGSAALPGARVRVLDGLRHRSTAVAAGGARRWLRYSSWPAAAAATTTTRGRADDGDAGGPSRAVTGAVEDPEAVANDVHVSIRNSTARRNLGYLSCGTGNPIDDCWRCDSDWHSNRQRLADCGIGFGRNAIGGRDGKVYVVTDPSDDDPVNPREGTLRHAVIQEEPLWIIFKRDMVITLREELIMNSFKTIDGRGANVHIANGACVTIQYVTNVIIHGLHIHDCRPTGNAMVRSSPSHYGWRTMADGDGVSIFGSSHVWVDHCSLSNCADGLIDAIMGSTAITLSNNYFTHHNEVMLLGHSDSYVKDKAMQVTIAFNHFGEGLIQRMPRCRHGYFHVVNNDYTHWEMYAIGGSAEPTINSQGNRYLAPTNPFAKEVTKRVETAQTVWKSWNWRSEGDLLLNGAYFTPSGAGASASYSRTITSDAGALSCRKGAAC

SEQ ID NO: 68932 - DNA, 639 bp, Zea mays
  misc_feature: Ceres CLONE 1545993
  misc_feature: Encodes the peptide sequence at SEQ ID NO. 68933
ggagctccccgcggtggcggccgctctagaactagtggatcccccgggctgcaggaattcgtctcacccctagaaaaatctgtgtacagagacctcttgaaccgtagcccgcctcctgcaagttccagaggtgacgaatctgctcctgggcgagtgatacagagaccttcacatttcacgctgagatcaaccaactgctctcagtgatgatcaagatgttgtattccaactaggagatcttcctccgcgagcttatctccaactcttccgatgcgctcgtacataccacgtgctacagtctcgctaaagagagcaagctcgatgcgcagcctgaacttttcatacgcctagtcccagacaaggccacaaacacgctctcgctcatccacagcggcatcggcatgaccaaatccgaccttgtcgacgacctccgtaccatcaccaggtgccggacgaatgagttcctgcaagcccttgatgccggcgctgatgtgtccatgattggccagttcggcgtctgctgctactctgcctacatcgtcgccgatacagttgtcgtgaccaccatgcagaacatgacgagcattacgtgtgggactctcagcaggcgggtcgttcactgtgaccgtgacaccttag

SEQ ID NO: 68933 - protein, 79 aa, Zea mays
  misc_feature: Ceres CLONE 1545993
MTKSDLVDDLRTITRCRTNEFLQALDAGADVSMIGQFGVCCYSAYIVADTVVVTTMQNMTSITCGTLSRRVVHCDRDTL

SEQ ID NO: 68934 - DNA, 1019 bp, Zea mays
  misc_feature: Ceres CLONE 1545993-R
tacgtgggggaagacggggccccccgcaggcgacggtttcgaaaagcttttttttttttttttttgataaaattcccatgttcttttcaggtccctaaaccaaccccccaaatttagcactactacacttgtccagaatctagggagatagagagagaggaactacaatccatagaggaaaggcaaataaacgaaaaatacagcctcaaaacccatgatccatcattgcaaaacccaggtaatcatccttctattcctaaatacgggacacgccagaatccggaacattgactttcaccaaaataccagttaactacgtaaacttttagcctccatgaaacttttgggaataagctccatgggaccttcaaaattttctttcaaaaaccccggcggtggttttttggggggggcccccccacacgggtgggtggacggcccctaactttgccaaaaaaattttgaaagagcccttttggaaccccggcccaggcgtatgggggtgggtggggttttttaggggtcttcgggggggggggggaaaaaaaactgccttattggacgggggcgattttttcgtgctacctggcgggttggggaaagagaaaaaaggcggccgtgtttttttgccttttggacccgtctaatggtttttataaaactcgcccgtagaaagagagcctttattggggtgagtgatataagaggcctggttctcgtgttaatgtgagtagctcctctatttgtcatatagggtgtggtggggatagatacctggggagttggattttttcggcgcgcgagtggtggctcttttgtgttctagcacacaaattccaaattgtttttagggcgcgtgggggatctaccccagccgcgattttttccccgccgtttaattcgcgggacgcatattggttaggggatcgttctgggatggtaagggtattgttacggagagatataagcgggggaatgacgagggagcaatggcgttgggtatggtgttatatgacccg

SEQ ID NO: 68935 - DNA, 626 bp, Zea mays
  misc_feature: Ceres CLONE 1545996
  misc_feature: Encodes the peptide sequence at SEQ ID NO. 68936
ctggagctccccgcggtggcggccgctctagaactagtggatcccccgggctgcaggaattcgtctcacccctagaaaaaactggtactcgcagtcgcactagtgctaggcgcatccggcatccccatcccttgcctccgaatcggatcgccgccgccgctgccgctaccgccgagcggaagcagccatcaccccaaaccctagccagccatccaactatggagccgcccgccgccgactcctcgcccgatccgacgccgcaggaccagtttcctgccccgtccccttctccctccgcctccccggtcaagcgctccgcctggaagcacccctcccccaacggccccgccgtcatggatgccaaccactggcccgcgctctccgacgccgccaagggcatcaagctcccagactcctcgtcttcctcgcctgcgcccgtcgccgccccatcggccgttgccaattcctccagttcgcaaatgcacggcgcccatcacgtccgccactagtcccccaggcgtggcggcggcggggaacactctccacgagaccatcctgaccggacacagccacgggttgggaccaccccggcgcgtggggggggtaggggtgcccagaagaacata

SEQ ID NO: 68936 - protein, 96 aa, Zea mays
  misc_feature: Ceres CLONE 1545996
MEPPAADSSPDPTPQDQFPAPSPSPSASPVKRSAWKHPSPNGPAVMDANHWPALSDAAKGIKLPDSSSSSPAPVAAPSAVANSSSSQMHGAHHVRH

SEQ ID NO: 68937 - DNA, 601 bp, Zea mays
  misc_feature: Ceres CLONE 1545999
  misc_feature: Encodes the peptide sequence at SEQ ID NO. 68938
  misc_feature (601)..(601): n is a, c, t, g, unknown, or other
ccccgcggtggcggccgctctagaactagtggatcccccgggctgcaggaattcgtctcacccctagaaaaaatcccacccctcgcccaatgcgtagttgtgtctgcatctcaaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacaccgctcccctactcgtacacgccgctgccggccgccgacgccgcgtcggacgaggtctccggctccggcaggacgcggagcaggcggcggcccctctgcgcggcggcgctcgtgctctccgccgcgctgctcctagccgtggccgcgctcgtcggcgtcggtagccggcccggcgcgctgaggatgacagaatcagcggcctcatcgcagacgccgatcatgagcaggggccccgaggccggcgtgtccgagataactccggcgcgtctgacgacggcggcaggctccgtggagccggcgggaacgccttcccgtggagcaatgcgatgctgcagtggcaacgcn

SEQ ID NO: 68938 - protein, 124 aa, Zea mays
  misc_feature: Ceres CLONE 1545999
METRDTDATPLPYSYTPLPAADAASDEVSGSGRTRSRRRPLCAAALVLSAALLLAVAALVGVGSRPGALRMTESAASSQTPIMSRGPEAGVSEITPARLTTAAGSVEPAGTPSRGAMRCCSGNA

SEQ ID NO: 68939 - DNA, 840 bp, Zea mays
  misc_feature: Ceres CLONE 1546000-R
ttgtggtcctcgagcgtctcgtttttttttttttttttcttagcaggcagacgaatcaatgagcagcgtatacaaaacctaccgctgatcagatcataacaataatgtaagtatgtaaccaggaagacgataagaatccgcaacaacgatctccatcacctgtacagagctacaacgagcctactaaacatgtacgtacgacgacagcggcgggcagggagcagagcagagcaccgagcgcgcgtgcatggctccgctcctaaacgacgcaatggtggatcaagcgtacccgcccttccacccgccgcggtaggcgttgtctctgcggttgttcctgaaggcgcagcagccgacggagtagacgatgatgatgaagacgaggaagacgatgcagacgacggcgacgcgcttccagttccgctggaacgtggccaccacgccggccttgcacgactggcagttgtagcagagcgcctaggcgtcgttgctccaggtcttgcagtccgggaccgtcaagttggtggtcaccggcgtccagtccgtgccgccgacgaaagtgtagccgcagcttggtggggggcttgcatcagccagactgcaggggagaagacatgacccgaatgagtctttgaaacacgggcacattatagagcaaagggggggctttcgctaaccctctataacatattgagccacgggacaacattccccatcagagttgggcttaattagctgcggcagaataattaagacagggaaaattccaatttcaagttttaatttgggcggaagaaaataatctccaaaatgtggagcagccatcccgttgaagaatgtgtt

SEQ ID NO: 68940 - DNA, 583 bp, Zea mays
  misc_feature: Ceres CLONE 1546002
  misc_feature: Encodes the peptide sequence at SEQ ID NO. 68941
  misc_feature (400)..(400): n is a, c, t, g, unknown, or other
gtccccgcggtggcggccgctctcgaactcgtggatcccccgggctgcaggaattcgtctcacccctagaaaaaaagccgctcacgccctccgcccaggccgagcaggagcaccgcaagcgcgtgctccgcgagctcaactccctcatctccggcgcggcggcggctcccgacgaggccgtcgaggaggaggtcaccgataccgagtggttcttcctcgtctccatgacgcagtcgtttctcaacggttcgggcctccccgggcaggcgctcttcgccgggcagcccacatggatcgcctctggcctctcctccgcgccgtgcgagcgcgcgcgtcaggcctacaacttcggcctccgcaccatggtatgcttccccgtcggcaccgggggtgctcgagnctcgctcccacggacgtcgtgttcaagacccgccgagagcatgggctaagatcccgctcgctcctttgggggcggaaccaagggggtgggctcgtgggccccccgtgcagcctccggggcccccgtctttccaaaaaacccggccccccggaagccgaacccccccggaaaacgaaccccgtc

SEQ ID NO: 68941 - protein, 148 aa, Zea mays
  misc_feature: Ceres CLONE 1546002
  misc_feature: The sequence is a functional homolog of SEQ ID NO 116 in the 10/374,780 US patent application
  misc_feature: The sequence is a functional homolog of SEQ ID NO 386 in the 10/412,699 US patent application
  misc_feature: The sequence is a functional homolog of SEQ ID NO 596 in the 10/225,066 US patent application
  misc_feature: The sequence is a functional homolog of SEQ ID NO 894 in the 11/479,226 US patent application
  misc_feature (133)..(133): Xaa is any aa, unknown, or other
PRGGGRSRTRGSPGLQEFVSPLEKKPLTPSAQAEQEHRKRVLRELNSLISGAAAAPDEAVEEEVTDTEWFFLVSMTQSFLNGSGLPGQALFAGQPTWIASGLSSAPCERARQAYNFGLRTMVCFPVGTGGARXSLPRTSCSRPAESMG

SEQ ID NO: 68942 - DNA, 664 bp, Zea mays
  misc_feature: Ceres CLONE 1546005
tggagctcaccgcggtggcggccgctctagaactagtggatcccccgggctgcaggaattcgtctcacccctagaaaaagagctcaaacacacatcaagaaagcaagatagaaaagactgtagctagctagccaccgcgcgcgcgcacgagtagtctagctagaatacactcgcgttcaaacaaacacacagcgtcgtgctgcgtgatctctgaccgcgtcgacaactaccgcagcaccaagcagctgatggcggccaccgtatcttcctgcctgagcctcgtccccaccgtgcaccaccggggccggcgggttccccagcagtgtggcactgacaaacacgcttcagcgccgtcgtcgttctccccgctatcttggtctcgcctccgcgacgagagccgaacagggagccccccctgtgacgatcgaggacgtggacctcagctctcatcaaggccgcggccaacaacgggagctccccccgcggtggccggaaggtccacggcaccaaccactgggaggggtctgctggaaccccttcgacgggggtggcccccccagggactccatccgcttacgggggagttcccccaaggcccacctacgaaaagctttcaaaataaagaccggctttccccccccttactgggggcaagcctggaaat

SEQ ID NO: 68943 - DNA, 648 bp, Zea mays
  misc_feature: Ceres CLONE 1546008
  misc_feature: Encodes the peptide sequence at SEQ ID NO. 68944
  misc_feature (528)..(528): n is a, c, t, g, unknown, or other
ctccccgcggtggcggccgctctagaactagtggatcccccgggctgcaggaattcgtctcacccctagaaaaagacaaaccaacgccgggtactcctctctactctctgccccgccaccgagctcgaccgaccgatgatcctcagccgcctgcatgtccgcgtctcccgccgatcccccgcgtccgccgccctccgcgatgcggcaacgcgcgccttggcctccgcgggcctcttccgtggcctccacggcggcgcctcctccgagcacggccgctaacccgcaggtcctcttacgctctacaggaagcttgtgagccaagggaagctctcgcatgatagttaccaggaaaatgtagcttccgaattagacaacctacttagtaggcttcgacggcacgagacggaaatggaggattatgcatgaccagctgtacttctgggagaatagcaaggagaaagagcggcgcaggcttcttgtcgaagaagctgaacataaacagcgtggtggtgtctggattgatgagangaagggctcttcctgacaacttggttgcgcggagacgaagacgatactcacaacctggacctgggtaagtgggtctcgcacctgaaccgagagaagtaactagatacattgggagggcct

SEQ ID NO: 68944 - protein, 47 aa, Zea mays
  misc_feature: Ceres CLONE 1546008
MILSRLHVRVSRRSPASAALRDAATRALASAGLFRGLHGGASSEHGR
